United States Patent 8,153,369 (ASSESSMENT OF RISK FOR COLORECTAL CANCER) - sequence listing, part 5

SEQ ID NO: 1782 - DNA, 1503760 bp, Homo sapiens
  DLG2 gene - 82848327 - 84312086 of chr11; NCBI Entrez Gene ID: 1740; Build 35; sequence includes 20,000 bases upstream of initiation codon and 20,000 bases downstream of termination codon of the gene
tgcaggaaggcaggaaggcaggcagttaggaaggcagaaaggcaggcaggaaggcaggaaggaaaggatgactacaaaacaaccaaaaaacaaataacaaattgacaggaataagccttcacttatcactacgaatgttgaatgtaagtggacaaaactcttcaattaaaagacagagtagctgaatagatacacacacacacacacacacacacacacacacacacgcacacacacacacgacccaaaaatctgtggcctacaggaaacatgtttcccctataaaacacacatggattgaaagaaaaagatggagaaagatatttaatgtaaatggaaaccaaaaaagagcaggagtcactatacttgtatcagacaaaatggttttgaagacaaaaactatataaagagacaaagaacgtcattatataatgataaggggtcaagtcagcaagaggatatagtaattgttaatatatatgcacctaacagtggagcacccagatatataaagcaaatattattaaagccaaagagagggaaaaatctcaatacagtaatagctggagacctcaacaccccactttcagcattaaacagatcatccagacagaaaataaaggaaaaatcagactcaatctgcaccatagaccaaatggacctaatacacgtttacagaacagttcccccattggctgcagagtacatgttcttcaccttagcacaggggtcattcttaagaattgcccatatgttgggccatgaaacaagccttaaaaaattttaaaaaattgtaataatttaaaatatcttccctgtccacaatgggataaaactaaaaatcaataataagaggaactttgggaagtattaaatatgcaaacacatggaaattaaataatatgctcttgaatgtgcctagtgtgtcaataaaggaaatgttaaaatctcttaaaaaataaaaatggagacagaatataccaatatctgtggaacacactgaaggcaatactaaaaggaatgtttatagcaataactcttacattaaacaagtagaaaaacttcaaataaacaaccagtgattcatcttaaagaacaagaaaagcaagagcaaaccaaaccccaaattagtaaaataaaataaagatcagaccagaaatagatgaaattgaaacaaaaatacaatagataaacaaaataagaagttagttttcataagatacaagtgacaaacctctagccagaccaactaagaaaaaaagattcaattaaataaaatcagaaatgaaaaaggagacattacaactgataccaccgaagttcaaagtctaattagagactactatgagcatctatatgcaagtacattggaaaatctggaggaaatgcaaaaattcctagacagatacaacctatccagattgaaccatggagaaatctaaaaccctaaaacctgaacagaccaataagaagtaatgagatggtagccataataaaaaatctcccagcaaggaaaagcccaggacgtgatgtcttcactgctaaatttttaccagatatttgaaaaagaattgataccagtcttattgaaactattctgaaaaagagaagaggagggaatcttttcaaatgcattctgtgaggccagtattatccttatgtcaaaaccagaaaaagacacatcaaaaaaaaaaaaagagaaagaaagaaaactacaggctaatatttctaattaatattgatgtaaaaattctcaacaaaatactagaaaactgaattcaacaacacattaaaaagatcactcgttgtgatcaagggggatctatctcagggatacaaggatgcttcaatatatgcaaatcaatcagtgtgatacatcaaatcaattgaatgaaggataaaaaccatatgatccttttaattgatgctgaaaaaagatttgataaaatttaactctacaatgaaaactacaaaacactgaagaaagaaactgaagaggacacaaaaacatctaaagatattccatgttcatggattagaagaatcaatattgttaatctattaattaatccatacttctcaaagcaatctacacattcagtgaaatccctatcaaaataccaatgacattctcacagaaatagctaaaacaatcttaaaaattttatgtgaaaacacaaaagatacagaatatttaaagcaattctgagaaaaagaacaaaactggaggagtcgtattgcctgacttcaaattatactacagagctatagtaaccaaaacagcatattactggcatagaaacagacacacagaccaatggaacataatagaaaacccagaaataaatttgtatacctacagtgaactcattcttgacaaaggcaccaagaacatacattggggaaaggacagtctctttaataaatagtcctgggaaaactgaatatccatctaaagaagaatgaaactagatgctatctcttactatatacaaaaggcaattcaaaatggatgaaagacttcaaactaattccagaaaatatgaaactactgaaagaaaacattgaggaaactctctaggtcattggtctgggcaataattttttgagtaatatctcaaaagcacaggcaaccaatgtaaaaatgtaaaataggatcacatcaagttacaaagcttctgcacagcaaagaaacaatcaacaaactgaagagaaaacccacagaatgggataaaatgtttgcaaactacccatttgacaagggattaagagacagaatatatactcaatagctcaaataactcaataggaaagaaatgtaagaattcaattgaaaaatgggcaaaagatctcaatacacatttctcaaaagaagacacacaaatggcaaataggtatttgaaaaggtgctcaacatcattgctcgtcaaagaagtgtaaatcatggctgggcatggctcatgcctgtaatcccagcactttgggaggcctaggcaggtggatcatctgaggtcaggagttcaagactagcctggccaaaatgatgaaaccctgtctctactaaaaatacaaaaagattagccaggtgtggtggcacatgcctgtagtcccagctactcaggaggctgaggcaggagaatcgtttgaacccaggaggcgggggttgcagtgagctgagattgtgcaactgcattccagcctgggagacagagcaagagtccatttaaaaaaatgcaaatcacaactaaaatgtgtgatatcatctcactccagtaaaaatggcttttatccaaaaactaggcaataatgaatgctggcaaggatgtgaagaaaagggaacccttgtatactgttggcagaaatacatgttagtacagccactatggagaaaagtctgcaggatcctcagaaagctaaaaacagaactactatatgacccagcaaacacactgataggtatatacccaaaagaagggaaatcagtgtaacaatgagatatctgcattctcatgtttactgcagcactattcacaatagccaagatttggaagcaacttaaatgtccatcaatagacaaatggataaataaaatgttttacatatacacaatggaatactagtcatccactaaaaaagaatgagatactgtcatttgcaataccatggatagaactggagaacattatgttcagtggaataagccaagcacagagagacaaacttcacatgttcttactcatttgtgggagctaaaaatgaaaacaattgaactcatggacatagtacaaggatggttaccagtggctaggaaggatagtggtgggaagggtgatggtgggaagggtgatggtggaaatgggaatggttaatgggtacaaaaatatagttagataaaatgaataagatctagtatttgataacacaatggaattattgcagtcaacagaaatttattatacatttcaaaataactaaaagtaaaattggaatgtttataacacaaagaattgataaatccttgaggtgatagataccctatttactctgatgtaattattatgcaatgtatgtctctataaggtatcttatataccataaattgatatacctagtaagtacccataaaaattaaaaataaatatttatttttaagatctgttgttgtaaatgatctggccatttttttgtatagtcaggctctcaaattgagttgtatacttgttataatatctttggggagctataaggacacttagtcaaagttgtataaggtcacttctcatgtaattttgtatttttaataagtaatcattaaatttgtattatttggagataatcatattgttttatcttatgtatttatctttctaatttatctccttttgaacacttaaaggaaattttagccgtttgtctacaaagtttccatccaactataattttgaatgtgcttaattttattttgggagtacttcaagaaatgcaaacatgtgcacacaaagggttatatttatctatgtttataatttatctatattttagataaatttcccataatcaaatgttcttatataagatgaagcatttcccctaataaccttattgctctcatttcctgtgtactcacagttagacacccctggcgaaaattagaaagcatggttgctggctttggggaaggtagcatatgcagatgtggccagctgtggattgttccatatacattttgccaatggaaaaagacaacacatttatgaattttaattctaattgcattctggttctgaagtctaattatttaaggatttaagtaaatctgtatgctttacaagaaagaaacatttcccatagggatctgttggctgaatttctttagtgggaaatataagactttcaaaatctaaacagtttacttttttagtggcagctagtgatctataatcaaggcaaaactcttaacaaaagtaagctatgtttaaaatttatatgtaattaaattcataatttatgattttctcaattatttttccttctttagtcacctagtattctctatccataaaatcaatatatatgatccttatcaagagtaatgaataatggctgatattttattgatttttgttgggtatctaagaaccctgtggaagatgctatggggacataatagcagaataaggcaatatctccattcataagaaggtcattagttctgggtgagatgagctttggttccataactttgtagaagttacttaatttctctgagctccagtgactgctggtatgaaatagttattataatacaaacctcacagaactgttaaaaagccacacagtatttcaaggttccttttctaggaactgaccccagaatgaggactgagctgacttggattctagtctagttttatgacttttgacaacaatttctctgttctgggccagagttttctcagatgctctccaagtcccctcctacctctaagtttctctgtgtttgaaaacacagacagtgcaatgtgccatcatatgctgtacttttaagactagtcatatttctagtatgtcaaaatattatagattttctagtattctaaccccactttctgttgatctttgaagtcctatcaaatttcaattccctttactgattaaacaaaattcctgtatttaattcatttctaaccagtctgcctacaaacttcccccaaaatttcatgaactatccatttacctctcacttttgttcaagtgtcccttggtaagaaatgcctttcctcatgtcctctcccccatcttcagttattaaaatcctactcgtcctccagagttagctaaactgttaactcctgtatatacgcttcctttgccttctcactgtcaagtaaccaccccttctctggactcccagttgacttatatatcttttataagtacctgctgaaaagaacagaagttttgatatcactgagactttagtttgaatttgatttttttttttttttttggtctggtatgacctagcagtttgtttaaccccagtggcctcagtttcttcatctattaaatgaatatgataaaacctaactaatgtggttgttttacagatttcataaattaatgcatggaaagcctgggatgtagtaagtgctcattaaatgattatgatggaaactgttcttaactttttttcttatctaacagttatctagataggtattgattggattgttttatttaaagagggagtttagctctgttgcccagactggagtgcaatggcatgatctcggctcactgcaaactctgcctcctgggttcaagcagttctcctgccttagcctcctgaatagctgggattacaggcatctgccaccacacctggctaatttttgtgttttagtacagacgtggttttaccatgttggccaggctggtctcaaaccccggacctcaagtgatccagctgcctcggcctcctaaagtgctgggattacaggccagagccaccatgcccggccggtattttatttttataattcatttgaaaacctctaaaaggtaaggtttatatcttattctttataacatagcaactccttacagtcccttcatagtgtaagacgtgcttttccgcactcatttcttacctttttttaaatttcaaaagccatgctcattgtagaaaaattaggaaagtcctgaaacagaaaaagacaattaaaacttgcataatcctgtaattttaagataactactgccagtattttgatatttagatttttttattgtacatgtgtatacatgtgtataaaatatgtatatagaattgtattatattgcacatatatatcttccttatcaaatatacattatatttaaaatattcactatagttcatttatttatttaactaatgataaaatccacatagctatatttttgcttagtaattttttcataaatttttataagtgaaatatttaagtaaaaatatgtgtttaaggcttttgtttcatgttaatcccttccatgtagttgtaccaatttttatgctaacctataatttctaataggactacaaaatactttagaattatcaaaatatttaatcctcataaaactcattatagtaaaagtttatataacttaaaatgaggccacatgaagggttaaaggacttattcagagatatatctagttaatgccaaagctaggatcacttatacagtatcgtaggcctaacattcttctttctaggtaacagcttcattcattcatccgttaatttactttttaataagtatgttgagtatctagccagatgataaggatattgcattaaatgtatttcctaacctcacagagcttaaaatctggcatggaagccaaacattaactgaataagtaactagttttaaattttagtaagggctaaaaaagtaaagaaaaatattataagcgtaaataggaggtagacctgacctatagacaaaagtcagggaggttttactctgaagataggccacttaagctgacacaggatatttaaatatgttttggctagatgcagggtcatgtggggtacaggtagaagggaaagctttctagattagagttttctaatctcagcattagtgacgttttgggctggataattctttgtcatgatatgctctcctatgcattgcaggaggatcaacattgttgctgatctctacccattagatgccaataacactcttccccagttataataaccaaaagtgtgtccagacattgccaaatgtcttctagagggtgggtgagattactcctggttgacagccactgttccagacctatggaaaagcaggtaggagggtcctgtgttgaagagggcatagtactttagaggaatcaaaacaagttcaatgtggctggatcatagaatatgaagtgatacctgattctaaatcaggctgggtttataccatgcaggaccttgaggatcctgttaaatatctgggactgtatttaaacagtactgagaagctagcaaacttgtgaggaacagagaatgatataattcatatttatgtctagaaaagatctctttcatagatctgggtcaaaagtggattagaggggtcaagaatatatttaaggaaaacatttaggtgatttctgcaataaccactcaagaatatggataattactgtgaatctggtgaaaacattacacattctgcaaatatctaagaaaattagtaggacttgataatttactgactgttggaagtacagggaaagagattgtcagaggtgactgctagatttctgacttatgtaactggataaatgaagtgccatttcttaaaataggaaaaagagaggaggaagaggaagtttcaggcagaaattcagtttagttttggcaataatgaattcgaagttccagtaacaggcaaacaatttggtaaatgggtctggagctcagagaatggatgtgggttagaaaaagacttggaagttatcatcacagaagtgataataagatgtaatggaattaacaagaaaacctaggaaaaggtatgaaatggaaaaacaagagaaacaaagtctgagtcttaaggaactcgggcatataaaagtctggtactgcaggaagagacagtaaaaatactaaaagggattcaatttctttctggttcaatcttggaagggcgtatgtgtccaggaatttatccatttcttctagatttgctagtttatgtgcatagaggtattcataatattccctgagggttgtaacagactaataatgaggtctgaaattgagacagtaataaatagcctacccaccaaaaaaaaaaaaaaaaaaaaacaaaacaaaacaaaaaaaaaacacccaggaccatacagattcacagatgtacaaagaggatgtacaaagaagagctggtatcactcctactgaaactactccaaaaaattgagacaggactcctccctgactcattctgtgaggcccgtatcattctgatacccaaacctagcaaaaagaacattaaaaaaagaaaacttcaggccaatattcttgatgaacattgatgcaaatattttcaacaaaatactagcaaactgaatccagtagcacatcaaaaagcttatccaccatgataaagtaggctttatatctgggatgcaaagttggttcaacatacacaaatcaataaatgtgatttatcgcataaacagaaataaagacaaaaaccacatgattatctaaataggtgcagaagaggatttcaataaaattcaacatccattcatgttaaaaattctttaaaaactcaataaactagatgttgaaggaacatacctcaaaataataagagccaggtagaacaaaccgacaaccaacatcgtactgaatgggcaaaagctgaaagcattcccctgtaaaaactggcacaataaaaggatgccctttctcatcactcttgttcaacatagtactagaagtccttgccagggcaatgaggaaagagaaggaaataaagtgcatccagacaggaagagaagaagtcaaattatttctatttgcagatgacatgatcttatatctagaaaaccccatagtctcagcccaaaagctttgtgagtggataaacaacttcagcaaagtctcaggatataacatgaatgtgcaaaaatcactggcattcctgttctgcaaccacaatcaagctgagagccgaatcatgaatgaactcccattcacaactgccaccaaaagaataaaatacctaggaatacagctaactagagaggtgaaagatctgtagaaggagaactgcaaaccactactcaaaaaaatcagagatgacacaaatgaaaaatattctatgctcatggataggaaaaattaatatcattaaaatggccatactgcccaaagcaatttatggattcaatgctattcttattaactaccatttagattcttcacagaactagaaaaaactattttaaaattcatatggaaccaaaaaagagcccaaaaagccaaggaaatcctaagcgaaaagagcagagctggaggcaactcactatttgacttaaaaatatactagagggctacagtaactgaaagaggatggtactggtacaaaacagacatacagaccaatagaacagaatagaacctagaaataagactgaacacctactgatcttcaacaaagctgacaaaaacatttatgtggccaacaaacatatataaaaaagcccaacatcactgatagagaaatgcaaatcaaacccacaatgagataccatctcatgccagtcagaatggcaattattaaaaagtcaagaaacaatagatgctggtgaggctgtggagaaataggaatgcgtttacactgttggtgggaatgtaaattagttcaagcattgtggaagatattacggtgattcctcaaggatctagaaccagaaataacattttgacctagcaatcccattactgggtacgtacccaaaggaatataaatcattctactataaagacacatgcacacacatgtttatcgcagcactatttataatagcaaagtcatagaaccaacccaaatgcccatcaaagactggataaagaaaatgtagtatatatatatataccatggaatactgtgcagccataaaaaaggaatgagatcatgtgtttcacagggatgtggatgaagctggaagccatcatccccagcagactaacacaggaacagaaaaccaaacactgcatgttctcactcataagtgggagctgaacaatgagaacaggtgggcacagggacgggaacaacacacaccagggcctgttgtgtggtgggggtgaggggtgggaacttagaggacaggtcaataggtacaaaaaaccaccatggtacatgtgtacctatgtaactaacctgcatgttctgcacatgtatccggaacataaaataatcaaatcaagcaatggagaaaggattccttattcagtaaataatggtgctaactggctagttatatgcagaaaattgaagatggaccttgttccttacaccatatagaaaaattaactcaagatggattaaatacttcaatgtaaaacctaaaattataaaaaccctggaagacaacctaggcagtaccattcaggacataggcatgggcaaagatttcattataaagatgccaaaagcaattgcaacaaaagcaaaaattgacaaatgggaatgaattaaactaaagacctactgcacagcaaaagaaaccatcaacagagtaaacagacaacctacagaatgggagaaaaattttgcaaagtattcattcaacaaaggtctaataataagcatgtgtaaggagcttaaacaaatttacaagaaaaaaagcaaacagccccattaaaaagtgggcaaaggacatgaacagacgcttttcaaaagaagacatgtatgcagccagcaatcatgaaaagaagctcaacatgactgattattagagaaatgcaagtcaaaaccacaaagagataccatctcacactggtgagaatagttattatcaaaaagtcaaaaacatagcatatgctggcaaggttgtggataaaaaggaacacatacactattgctaggagagtaaagtagtaaattagttcaaccatattggaagacagtgtggcatttcctcaaagacctcaagacagaaataccatttaacccagcaatcccattactggctatatacccaaagaaatataaatcattttattataaagacacatggctgcatatgttcattgcagaaatgtggtatgttttcttcatgtagtacatgaaatactatgcgtccataaaaatgaacagttgttatgtcctttgcaggaacatggatggagctggaggccattatccttagcaaactaacacaggaatagaaaagcaaatactgcatgctctcacttacaagtgggagctagatgatgagaaaacacggacacatagaggggaatgacacaaagacattcaatttcatatatcagaaaataaagggtgggagaagggagaggatcaggaaaagtaactaacagatattaggcttaatacctgggtgatgaaataaactgtacaagaaacccccatgacacaagtttacctattaacaaacctcaacatgaacccctgaacttaaaattaaaaaaaaatactgaaaggttgtggtggggaaacctaaggtcagaagccgtagggtaagggtgtttcaagaggaggggaagctcagctgtttggaatctgcccagaagtgtggagggtgagggtgaagatagagaagtgacagttaaataagtgacatgttggttgtgatgcccaattttaaggggctggggacaggacataaatcaatgtgttaagaagtcagagtcagtgtggaaaatgaggaaatggatggagagtgaggggctggctttcctaaaaaggttgtgtgtcaaggaatgaggaaggatagtagtagcttgatatggaactgtgattagaggaagtagttatagttttgcatttgtttttagatgggaaagtcttgcacatgaatataaattgtcataaggaggatcacgaagagagaaagatccagtcttgatgagaggggaacatacactgagaggagcaaaagaaggaagggcagtcactgatttttcttttattttgcggtaaaagttgaggacttgtgtgttggcttttgttttctctgtttgttttgtttttgttttcttcttagtagaaggcaactatctactaagtggaatgaggatggaggaaggtgtgaggtttgaggagagtggagaatgtttgcaatcgcctttcaaaagaggatggaggaggttgttcaaagaacagggtaggattatcaggcagtgttggagcctttttgaggtttttcattaatttttttccagctgctcaccaatctgtcagttcatgaagaataattaacaatactatgtgctcaagggaactattttccagctcatagttgtcctttacttttgaagtgcttaatgtggggttgagatgaattttaggcacaaaaggcaataagagaacaatacaagacactgtataatcaggtactaaattgggcaatacaaataatacatgttgaaggcattcagaaaaaagactctgtaggggctgatctcataaaaagatagcctctgatccaaccattaaggagtaacaggattttgagatggtcactccctgaaggctttttttctttattggttaagatatgtccattccattgtcctttcagtcttttaatttagaatgtgtgattgcttgtgaggcactcattcttagacttttctcttatccagaagagtaggctttttacactctgaaagtacatgtagaacttccttggtacagggtggtgagtaattgtggtaaggaatttaaaaaaatctttgcaagtatgtattcctaaatctacatttactctcaggctgtgcgttcaagtggttctcattaaggccagtactaccctctttaaatatcttactggacattaatttatattagatacttgataaaatttcctgagcctggaatcatacttcgttttatgtatttaacacaaagcatctcttgcattaagttgatatacactgaagttttcaataacgcaatttctctataagaaattccgttctgatataagggaagaatgttctttgttttactcagaactttaccaaaagttttcaacagttcagaatattgtgtcactgatagcagtgctgcttttaagctttgtgtagccaattcaatatacctgcatctgtctatacatgtgggtgcaagcacctgcccatttaattatgccattgatggaattttgcctgagtattgccattgaagtatacgttattttaatttcaactttaagtttaattctttatatcatatgttatgttgagtttttaaattccatgtaaaagtaggttatattatcatggttgtaagtagaatatgaaacatatttatatataaaagaattgttttgtgtgaaagagttaatcaaccactgtataggcactggggtcttgagaaatttcctctgggctttacaattaaaagacttagtattggagttccacctctagcttctgtataaatctgaataatttgcttaatcactgtgtcagttttcctcactggacaccaggggatggtggcagtatctttagggcttatgtaaggatcaaaaatcaaatgggatatatctttacttgtgagctgaggcaagaatacccctacccctaggcattcacagtaatatatatatatatatatatatatatatatatatatatatatacacacacacacacacacacacacatatcagagagtattataagtattgcatagccttcttggcttgttaaatttatatcaatttttaagataagaaatgaaacaaaatgacatccaattttatatattttatacacttccaggtatataaatgcattatcttatgactttagggatacttttgtggaaatttttgagaagccctgaaatgatttttaatttgtaaattgggtattattatctcaggaaaatcccaaggaggatgcaagaaattccaataatagtaaattgattcagggtttataatgagattgccagactttctgagaatcctctttatggctgactggaaatactagggaagttctagatgatctacaaacccctgaaagaatcgtctaggtatttaaaagaagccagtcaaaaggaatgatagcacctttttaccttcacctttacctctatcatttcagttctcttttcactaaaaactaccacttattacatttaccatgttctaggtaatgggactagcaatgtgcacaagttatatatttgacttctcacaacatccctatgaagtagatttgttacctttattttacagaggaatactctgtggcagagagaagttatgtaacttacccaaggtcacacagctggcaagtgcaagaaaaggaatttaaaccaaggtctgtttttattttattttatttttttactcaaaggcccaagagctgttagagtttttaagagagaaaggattctaaattatcaggtattatatagttcctttctcaagtggcatccatctcagaatctttagcctccactctaaaattatctcatttacaacagaaattaccttctgtttgttttctatactttcctcttctataaagttaatttttatacctgtgctctggagttgatatcttcctattttttgtgagagccaaagccatcaattttcctctctttcttcagagcagtgattctcaaaccttagcttacttgaaaatcacctggagggcttgttaacacagatacctgagccacatacctagtgtttttgattcagtaggtctggggtatggagaatttctatttctaacaaattcctaacatacactgatgcacctagcccaaagactgcactttgagtaccactgctctagactttagagaaaaaagtcggcaatttacaagctaagaaatggtgtacatttttaaatggttaaaataatcatcatcataatattttctgacatgtgaacattatatgaaattcaattttaatgtttatcaataataaagttttattggaacacactatgtaatgtctgtttaagtagatatttatgtaggctactttctctctacaacattaaaatggagtagttgtgacagatcgtatggcttacaagcctgaaatatttattatccggccatttacagaatcagtttgctgacccatgctctaaggcagtaattctcaatcctagctggacactggaatcacttggggagctctatagaatactgattcctgattcccaccctcagaaattctgacttaattggcctgtagtacaatctagagaatccttaacgtataaacttacctaatttgtcctatctaaagaaaacaaaacaaaaagcaaggtatctaacaaaactactctatctacctataagaactagatagtccaatctccttattttatagattaggaaaaagatgtctagcaatatgaattatttgtccatattaaaagagggtgttgctgttattgtatttgtaacaaattgtagttgcatattgctttaatattgaaaactttttttataatccaggttatgttttttaaagtattacatgcccactgttaaaaatacaagccaaatatatgtagataggtttaaattcagtgcataaggtgaaaatcaactagtccaattttcttgatagtcactttttccttttgggaatcaaggtagttggcttgtatttaagggctatgctttaagaaaaacatacatacacactagaattacatgcattactgggagatgttcacattcagagagacactcagatctaagatcaattcagaaattgatagattcttatttctcctctcacaatcattccctgacttttgctcatggagtgcaatggggtaaatcccctcacagtttctagtatttccttcttccttatatctgtatttctctcatttactgacaagggatagttggattggataagttgttcattgtgaatgatttcctatagtatagaggtataaaataaaaactgtcatgcatcccttcctaagccaatagcaacactgttaaaatttcacacatgcacagacacacacccacaccccacacctctccctacaagtgtatgtaaatatacaaatacaaatagcctcacacaatatcagttcttttgcaaacttatttttacatataatattatatataacttggacatctttccacataagaatatgtatatatatcttatattcctatgttatgaataaactgtaatttaaagaaataaattccatactgatggatattttagatacacatacacacatatatctgggataaattcctgaaagttgaatcactacatcaatcataatttgcctctttaaatatttgatagataattccaaactaccttccaaaaagtttttaccaattaatgcatctccataaatacttgatgtgtcaattttaataaccttttctaacttttatgttttttcttaaatatgaggttgagcattttaaatgtgttttgtggtctttttgtgaattgctactttatgttctttgagtgcttcattcagttttatgttttctcttagtgatttatgaaagttctttgtatattaaaacaattcccaatggaatgtgttgtaaatagtttcccagtttgttgtttgtcattgtgtataatttacccaaggagaagttttatattttcatatagtcacaattgtctatcttttcttgcatggcttcaggctcctgtattccaatattatgcaaaatcaaatctgtgttttcttctagtatgtttacagtttcaatttttatatttaaatcattgatccttccagagtttattttgatggcagggttcatcattaatattctcattggacactatgagatacatgttatccccattttacaaatgggaatctggcatggaagtgattttccaggactactcacttgcagtatggaagcctagacttactctattgcctacaaaaatatgcataggcagttataactttcttctactatagcaaatgttattattcttgcagatatactgttctgatgaattccttgccttaaaatatggaatattctttagtgggacattgccattgtagttaatgccccatttcctgcatctataaaatgagaatagtaagttggctatcctagtccacttaagaaaattaggcagtaaatctacaggtatagcactgggattttgtaggctagacaggtatactcaggtgttttaaagaagtttttaaggctaagggcctttttaaaaaaatgtatacacattaaaatggtatctaaagccctgttagaagtcctccctgatagccttgacagggaaacctacatgtacttcttcacctgtaacttgtttcatttaatccttgcttgcgagctgttctgagatttgtaacattttccagttctttttggtctctctctcctgggccatccaaatatcccggcaactactaaaataatattaataaaataggtaaatttcattttcccagcttctaatggaaaaaaatggtacttattcacaggttgaataaagtaggtttttaaaagttcctctgaatcctcagtggagaaaggcatttttaagttcttctatgttttgcatggcattgagttgttatatttgggttcatttattaggaagagctgcaggaaatgtgacctgctataaccttgggaggggaaagtgttattaactgaaatactcagttttgcatttaaagtccgtagaaaaagttgtggaatgatgagagctgggcatccatgtcgattttttaatgtcctggaagtcactggttgtgttgtaagtgcttataatttgtaaattacctaggctcctaagacagacggaactggaaatcaaaataagtggctgccttctcttacgttgcccaaggatctccagcttaggataagactgcctttttcttcctaaaaaaaggcacaaacaatgacagcccaaaatagctatttagtcagaactgacgacactttctgaatgcttgtcattaagagagaaatagaaaatcctgcttttcttcttcctttaatttctctccctgaaatacctttcttcctcctgaagctgcctcacctcattgcccaggagaaatgcccagtaactctgatggtgcttcagcacttctgcaggctccagaggggaggtggcttatgcaaagcatattaaagaaagatcctaaaagtcactgcagctttttctagtgagttatgctgatcttccttgttgctggaagctgatggggagcatcgtggcaaagacataaccactttttttcctcccactatttttgctgcagtgaaaactgttcatttctgcttgcattttgccagatagctttagaattctagctgagaatcggcttcccaaggctggaaataagggtatagcaccctaaattgtactttgtccttttgattaagtaaaaattgagttaatttgcagcatccggtgcctgacaggaatgacaacagatagaaggatctgacggatgtttttaatttttttttttccttacggacttataggggcagaagcttttatttttctctcttgctctctcccttctggagcctgctgaacattttacattcagcagcagttgctactgaatctgaggttatgttatcccctgaaatcttctgtctccatttcaaccccatctcattactgattgtcatgtaccaataaaacatagttttggaaaattggccacatcattttattatggagtctggcaactttagatagctctaaaagatgtaacagggcagggaagtaggagaaggtggtacttctcagtcctttaaccacagatcaccccagaggaacccagttcacattttaggggactttatatgacaatgatcctctggtcctggtcctgttccacatggagaagcagaatgagacatgcttgcggtgatttgtagtatttgccaaacagggtgctgcaccagaatagcctggaatatagtgcagagctcatattaaacctccaaaggaagaagggtttcctcttcatttacagtctgcgatgcgatcccattgtaaagtatttaataggataacaccggggctctccagaaatataagtaactcattggttaaatttcaattcttcacctttccccccctccttcctgagtgagctcattcccccctccttcttcttcttcttttttttttttaatccagtgatttaaaatgctagaaggaaaagcaactgaggtcttaactttcagacgctgaattctcatctaattgaaattactgggcataatgctatatatagccaatgaagagattttgagctctcactcagtgccttcaagacatgtcgttttgtagtcagagaaaacagagatcaatgcattttcaaactgacagagggaacggatgctctttagtagcacatgcccaggatcgtgtgtgtggggcttgcgctgtgctgagaagctgaataccggtccatatgctccttatttactgcaatgttctttgcatgttactgtgcactccggactaacgtgaaggtaagaggaggcgagccggcaactgggcacaatatacatgttaaaccagctgcagaaaatgtctaccttgtgtagcttcaggacttttcggattgctggctgagcaggcagattattacaggtggttgcaaaggctttgttttattgttgccgtgcagcctcgctgggggagcatgttggaacgctgctgtgaagtgaccttcaggtttaactgtttgtaattcaggttcacgctcatagttggggggtggagaggggggaagaaaagatgaaaattatttaggtaggccagaaccaagaaatcagagaaggtaaaaagctataaagcatgctttgaattatgattttgtctttcttttaaaaagtgctgtgagcttcctgtgttcttgcagctgaattgtttaagagccggggggttaaatctagtgactgtaatggcattagatgtgctctgtgggatacctgaccatcctgtgcatatcaacaaatgattttcactggaaattggtgatactgattatacaaatcgtcagctctgggtgggctggttgcttcagctgcgtgggcgctgctgtcccgctgttgtcaccccactgacattcacttgctgtagctaatgagcctctgaagttgagcccaagtttgggagatttaccccttgtcacgaacagggcattattattgagaaggttttctgacactgtgttcattcagcactgagccggccagaccagctgtggaattccagttgcataatttaagtgaattacatccttggttaacattttaagcttacatttcttggagaaagaagtccaaaaggaaagtgattgcctttgagaaaaaataattaagaagcagttaagacaacctaaaataggaatcttttttttttttttttaaagtcaatataaagtgtttcccctttttattttactaggggagtgttttaatgtgtctgggtactaaagtttcattttctgtgtttgcaagttttattaaagaactccctgctgctcactcttttgtaagcctttctgttttctatttgaatttcaaacaggtaggtatttatgttttgatgaccaattcttttacaactacaacccggaagcattctgtggatcattttgcagagttctatagaatttgctttttactacttttaaaatgaactttagcagtcaattttcctccatgtataagatgtagacagtaaacaacatgaaaaaaataattaaaaatatgaaaagtgtgcccaaatatcatcttggattttctctattatcatcttctgttccaaagtatgggtatgacatgcattgttttgtaaactcagtaaattgtaaatgttttccctcctcatctttttgaaaggagaaaagtactttattcagcggaagctccataaataatttagataaagagataacaattgttttgctatttcattgttatattttggaagtgcaggaaaacttaagtccaaagttcctttcataatgggctttgggaaatttctttttactcttacctactaacagtcgtctttatgaatttagctttacatttttctcatttaaattcataagcaaagtaataaaagcttcactaacaatatcttaactaaattcagattacttttgaataataaattcctagtactttggctaatctgtactgagatatacttcttatgtattgattgatagaaattgagaccatatgcattgccacaaacagcatatataaccttcctttgagtagattagttttaatttgaattatgcttctaccttttcagtaattagctcttgcacttccttagataattcataattttttagggttatcttgtctttctgagacaacaagttttgccaaagagtttgcagttcatttgcggtctattattttatcacattggtgcaataaagtttcatctaatatttttatctattttgacttttgttttattttatttatattacattttaaaagtgtttgcttttatttctattgttacaagaactacttatcacttggttctgttgaattctctcttatggtatatagtttctcatgttttaacatgatttaacatgattcttgttacagttatccaaaactttaagatggttaaaattcaaaggatagaaacatttttcgtcttttttttctctgcacacaatagaccactaatgtcatgatcttttattctagaataaacttttttgttaataggacctttataaaatataacaaagaattttattgagagtggtatgttttaagatatttcatatatttttatgtaacaagtcattaaatctggaccactagtatagacacacacacacacatatttacaaacatcagaatatgactcctgggtcaccatttattcattcatctattacaattttttgaatgacatctatgatttatgcactatgttagagtcttggaaactaggatagatagaaacagtgcttgcttttaagaagcttccagtcggaaaaagacacagactataaacaaataaatgctttgaagtatttctgacccataatggacatctatgcagggtttgttgtaggagaaagaaacaagcaaacaaaacaaacaaacaaaatcacaggctaattttacctggactaatcaagaaaggttttgctgtgaggtcacttttaagttgaatcttgacagctaatggacttctgccaagcatcttggagtaaggaaggcatgctgggtaaagggagtggcaaaagcatggagctaagaagcagagcacttcaaagagctgcaaatagtttgaaatggttagaacatgggttcttacaaggctgaagagtgaaataatgggtaaatcataaaagaaagataaaccaatgctgcttgaattgactgagtggtcatcacaatctaacactttgtaaattgttttactttgctacctattttctagaaggagagctttcaacagaaggaaatgaaatgaatgaaaacttctaatcaatgtccattatttatgtcctgtgttttcttgttagttttaaatagagtttgataaaggttcacattacattggcttgggtttttattttaactttttacaaaatatgatttagttttacaaaatacaatttagttttagtctactcactaaaaagaagcaatgtgatcatcacgtacacagttcagtttccatctgaaattgtctatattataggaaaagtgcctctttaatgagaaaatatgcaggaagcttgttgcatcagatgtctgtatcattttgtctttggaaatggatcaatttttgaaggtagtgatactgacgataattttctaaataactttatcttcctcatcgcactatttcccttttttcattgctactacaaacatacccacatgtacactcacaaaaccacaatccctgaaatatgaattgcaagtattagacctatagcacaggtaagaaaactaaggtagagagaggcaatgactagttactcttttccacagtgtgtcagaagcagagtctcttgagcggtgacttactactctttagagtaaatcctgctgcctactgcataaattcaagaattctgctcctttatttttaaaatttactgagcgtaaatacaataacttttaagaaaaagagtgtaacagaatggttttaaagcatggatttttgggatttcaaaagaactactttgaacttgtcttccccatttattgcatagcttaagaaagtttagttttttctcatctgtgaaaaaggtttaataatagctcttagctgttataagcagtaagttagataaggcatgtgaaccctataaaaagttcttagactatagtaataactcaatcaaattaactcatcattgagaaaatgaagaccaccaagtagcagtaaggcttcagagttgccttcaataagaatcacattagaaattgggctcaattaaaatatggctataattaattagaaacacatttaggtataatatttcctgtcccaccataataaccatcacaatgacatatatgcatattcacatgttagctccatggaacctggagttctagttgttttgttcacctttatatcatcagcacaaagaacaatgctaagtacacagtaggtactcaagagatgctttaaatgaatgcattaagcgaatctcacatttcttttttattcactcagcttcttttcagattatttgtttatcttaatgctggttaaattattttgagagaaagaaaaaaaggaagaaaaaacctcatagcctttgaagtcatataggcttcagtttgaatagtactggatttgccaatcgcaaaccacttacactaagtcacatactcttttggatctgctcagccaggttgtacagctagtttggagggagtcaataattcacactaaaacaatttattgaagcctaaacactctagaattcagacatttatcatgctaattttcaccaggtttattcagtgaaattgctcttttccaaacaccccaccctctctgccccgatcattttctagagttgttttcctgtgatgggaatcctttctctgcattgaccatatttgtctaaattctgtccttcctttaataaacagtacagggtgtctatatctatcttcgaagaactggaacccagtcacactaactccagtgctttatctctcctttgacttagtgagtacaatttctccatcatttatggcaatacatcttatactgccttatatcataacttgcattattattttatactggtagttaattttgcttatgtttgggtattgccctcaccccaactaaattttaagaattttgaagacaggaactataaactattttcttgattttttccttacagtttatttatatttaggaattcaaaaaatgatcagtggactaattgaaagggaaacttccagaaactctgtctccttatgctgctgacacctactctttgctagatcctatgatgtgtcccacatattgatgcttttaataaacacataatttgttgtaggcaggacttggaattatgaatcacaatgtatggaccgttcgagtaacacctatggctcataacaagtcagagatggtacctcttagggttccagttgaataactctctcttttaggatacctataacgtattagttccttactggactcctttagtatggtctccaaatggttgtgagccatttggacaccaatttggtatattgggtttataatatctaagcctacttaacgtgttagatttacaatttctaacaaagcccattaactcaaaacttaaaaaattaaacaaggagttaataagtaaaggataaaacagcacattgaacaataacaataatagctaccatttgtcaaactcttagtatggaccctagactacatcaacaagtttgaatgtattttctcaaaatgcttcccaatgacctaagatttatgcattttgatcattattattttatatatgaggaaactaaagtttagagaacacaaataacttgcctaatattacaaatattaagtgccagtgaagtcaccttctaaaccaagtctgttccactggaaacctttttagcaatctacctaaatagataatatagatatgaaaactacaatgaatatgttacagacatctcaaatctttttttaaaattaggtaaggaattaagtaaacaataaaattgcatatgtcttacatagcatgaccttgccattccttttcttggcttctttctaatacatgttggccagagtcaggcctgaggctttcttttgtattctgcgttcatccttcaccaaatatttgatatagtacctattacgggtcaggcacagacctaggtgttataaataaagggtaaaataaaacagacaataatctctaccctcatagaacttattgctagtgaggtaggtagaacataagacagttaagtaaaatacatagtacatagtgataagtgctaagtcaaaaaatcatggaaggatattggaagtgtgcattgggggatgggttggtttagagttttagataagatggttagtgaaggtctcactgagaatatggcttggagtaaagacctaaaacacataaacaaaatatacatgttggaaaaggtagcagaaagtgcacatgcaaaggccctgagctagaagcctgcctggcattttagggaacatctaagaagccagtgtggctgaagagagaaaggtcaagagcatgtcacagtgaaaagatcgtgtaggactttcccagtgagatgggaagccagctgtgttttgaacggaagggtcacatcatttagctaacatttaaataggatcactcaggttgctatgttgaaaagagactttaagggagcaagggcaggagcagagagaccaggtagaagttcctgcagtaatccaggggaaatatgttgaaaacttagatcagatgggtgccagtgggactggggacaagttgttcaattctgtatataattataatttttgatatctatcttcttgtctttttcgacactgatattgagtcctccttaggtgtggtgtgtgggttttcagctctgctgtattaattagagaaaaatactttgataagtaattaccatgccattttactgcttctttttttttttttttttttttttttttttttgagacggagtctcgctctgtcgcccaggctggagtgcagtggcgcaatctcggctcactgcatgctccgcctcccgggttcacgccattctcctgcctcagcctcccaagtagctgggactacaggcgcccgccactacgcccggctaattttttttttgtatttttagtagagacggggtttcaccgttttagccgggatggtctcgatctcctgacctcgtgatccgcccgcctcggcctcccaaagtgctgggattacaggcgtgagccaccgcgcccggcctgcttcttaatcctctgaacatttttagaaggtaggttaccctagatttgagtcatatgtatacgttcatgatttccttttcttttggtctcagttcttctgatcctcaggggatgctgccctagttcttaaatgagtcaactataagctacttgagggcaggaactgtgtctcttatatgtatttttgtacacattgccttgcacatgacaaatgattaataaatatttgaaaataatggactgaatgaatgaatgttagccgttcagaaagctggaaatattttataaagtacctctttggactggatgtgttaccaccaaataagaatagatgcacaacaaggagagtttcctctctaatgaaaaattaagattaattaattaatctctaattaatttcctctctaatgttcattatgatagtatgtttccagcatcagaatcttaggaaagcagcctgggaatctgaaaatgaccctaggtaaaccattcataagacaagtttggaaaacactgtcatatagcatatgtttggaattctcaagtgtgttcagaaattgctatgtgttaatagttgtttaagtaacatatagacccaaagattttccaaatgctggattgcaacatgcagcaagaaataaatttaaaattgcaactcagtatgttttaaaaagcaatacctcctttagcaaaagttatgcattgtgatattttccgttccaacttttaacaatttctttcttttttataatgttggtcaagattaaatgtattataatcagaaaaataatggggggggaaatacaattcatattgacccgcttaaaagattccttcattaaccttctttattgactttgaaggggtgtagaatgggtcataactcataatttgaaaaacactgtaacatgttccctgccttaagaaaaatacaacctcaattaggaatatgcaaatgaaaagatgatgaattacaacagtcagacaacactaagaagccaacactagggcttctccatatagcctggttcatttgccgattagcatattcatctgggaattcatagatcggtgcttacttccctgtccctggcctttgggatttagcctacccacttacatacctcaatattcttaataataataactaatgtttgtttagtatttatgatgagtcaggcactgtgtacatcactcatttcatcttcacaataaccccaagagaaagttttctattaaacctatttttacatgtgaaaggactgggccatggaggtttagagccttgttccgggcctcacagcaagtaactggtgaaaccacaataaatgctaggctcaggcaccaatgcttaggacaggccagtgcctcgaaaggactgctttgcatccatttggttttgatgacttcattgggcattcctcacccttattagacttaggttcccctgacttgagtgtgtcacagtttctttcattagccagggaccagaagaattcttatgggcctgataacctatattctcccatggatctggggtcagggttggggtgcttatacttagaagacttcataacaaattgaagtttgagcatccgttgaaagaaatctatttgctaatatctgcacttagtattaatgcagtgaatatgataataaaactccccacgatgaagtgatattgtactgtgtcttggggaacctagctcttgagaattgacaagagaaaagtagacaataaaataaaaagtcatttgaccatgggagggtctggccttaaatatttctcaaatttcagctggaggttttgttttttctttctgtgtagactttggcactttcaaaataggcagaatttgaaagaagccaagggaatacctttctttaaaatgaaagttagatgactagtgggaggcttattttgagtttttaaatttatttgttatttatttctataggtataactagatttacaactttaaaaaggtacacatacatttatttattttaaaagtgtctaattcatttttcaaggagtacttacattggaagaggaaactggcccaaaggagtttacagtgagcctggatgggagggagtaagggagatttctgaaatggacctctgaatcttggcgcaaataaaagagccctttgcatttgtgttggatgtttagttgactaatttatgaactgcactttttcagactcgttaggaaaagtaaactaatgaatcagttttaagtgggtcagaatacattatatttttcaatgtttttaacattataaaagtaatacatgtttattatagaaattatagaagtacagaaaatgacaaaaatgtatacttcttcatatccttgctattcatatatagaaatgtatattcttttatcctatatatatgtatatgaatgcatgtctattggattaagatgtattatttgtcatgtgttcttgctcatactatgtgataagataagaatcatgtcattaataattattcataggcttctttttaaagtggctgcataatagggaagcttttttattctctttttgaaaagtaaataaatacaggtaagcagggactgaaagcattgtttttcttggaccattacttttcagcagaggttagaaagctttcaagtgtaaccttggaatagctttgagatgagatgcagttgggaaaaaaatatatatggtgagtctgaatttcaaaaggataattgccattgtagttctaacaggggaaaaaatacatacttcatgcaaaagtttctctagctagtctcctaacattgtctcaacacccagtcctgccaaataatggctttgagctggggttttaatgattcttttaaacagaagccaaccagacaattttcttactatcactattctcccaggcacttagattgaaaacattgaaatcatttttactctccagagaccatggagagctaattaatccacaaatcctgtagaatctacctgtaatttcttcgactttgtctctttctgcctctcctttcctcagtggaggctctcattttttctcactgtgttgccccgggaaacattgtgactggcttccctaatctccctctgtcctctccaaatttgtcctccccatattggcaccagacttatttttgttaaatacagataagaactggccatccatttctctgttcaagagcttatgtgtttctcactgccttcaaaattttcatcctcatgatggcctcagtcactttccatcattaccttctgcgagacctactgtaacctcattcagtccacacagccagaatcaattccagctatacttcccatccacggctcacgccatataggagatgtggaaaaactggggtgtttggtagaaagcctgggttgaaaatccgtcatctccatttacaaagtagtctgcaatgcttctaggtgaggaaatcagtttttctgatgcttaatttcaagatggtgtaattgaaatggttagtaatgataagaatctaccttgtatcatgagcaaggctttagacaaaaaaagccccagatatatgcaagattcattcagaagatgttaaaatatttcagtaaaggccgggagcagtggctcacgccggtaatcccagcactttgggaggcccaggcgggcggatcacaagatcaggagatcgagaccatcctggctaacacggtgaaaccctgtctctaccaaaaaatacaaaaaagtagccgggcgtggtggcgggtgcctgtaggctcacctactcgggaggctgaggcaggagaatggcgtgaacccaggaggtggcgcttgcagtgagccgagatcgagatcgcgccgctgtgctccagcctgggcgacagagtgagactccgtcttaaaataaataaataaataaataaattgtgaaagccaaggaaatgttaactgaagcagtgaaggttagctttaaatttggtggttatctcaaactggcttatgtagctgaacatttccttatggtatactttggatcccaagaacatgggctaggacctaactcctttgtaaaattttgggatattgatgataaaatgatgcttagtcttacagttgaggagatgaaaaaaattaactgcagtatcggcagttatatatctcccagccaagacctctacgtaatatacaatagtaatcatctaaatataaccactccccaaattgcttgggaaagcaatcacaaagtttgcattaattgtttctttggtgcatagaggtcactaatcctgaaaagatttagattaattacagaataatggaggaaagtaaactttttaattaatatttttatgttaagatatttgtacacatttggatttatatatatttgtgtttttaaagataatttgccagattagaacatttaacagattggtgtttggatgtcaaggaattgattttgacttgcaattttaagattaaggatattttaaaaccttattcatttgtaagttgtattggagcatgtaaaaaagcttaaaatgttcacactttgttttattaatatttattagatttaaaagaatgattcaaataattgagaagttttttgttgtttagataaaatgcttttaaaattttaatatattaaatttataaatacaggttaaaatatttaatgggatataattaagtcataaaactcccttaatgatgattgtaaaaaacttgataggtttataagtaaaacagtacaattatgaattaaaatttaaaagttaagcaacatgtaggcttttgaatttataactttacaaattaaatatgaatttcacaagggaaagagctccacataatcttttctgtccaagaaagatgccttaaaacaacaaagtattaacattgcaccttattgggttgttatgaagcataaacaatataacatgtgggattactttgtgaattctagaatattataaaaatattaataattatttttcattctaattgcttttgcttaatctgtcacttcagtacagaaaaatatttacctttcctttcctctacataataattgtcttgtccttccagaccctgccatctagtttcttctctaacatggaacttctttgttttctatacatttattactttgtacttctagtgtaacacttaatacactttgcattcctagtgtaacactagtatatcccttgttttggagatgtttatatctgcttttctttaccagaatgtgaattctgtatctgttgttgttgttgttgttgttgttgttgttgttgttttttcttcctttttgtggaagggaatctcgctatattgcccaggcaggtctcgaactcctgggctcaaactatcctcctgcctctgcctccctgacagctgggattataggcgtgagccactgcacctggccaaattctatatcttttccagttcatttgttaaaagtaaacattaattgagtctctcttatgggctaaacactgtattctgtacaagggccagagtcattaataagaaatgttatttgtgtctgtctgtaatgggtaataatgaattattaaatttttatttattaaagttaatttgatttgaagtaaaaaaaatcattctgtctaaaaaattttataatacaaatttctaggaaagcatttgactagttcaagaaaaaaattcaggtaatgaaaatagcagataagaaaaattcaaaatacattaaagaaaaattgaagcttcaccagtatagcacttactttttcccttaggcctaaaacattgttttcattcttataaacaatttggaagatagttttgcagaaatgattggagcagtagaggctgaaggagggtagaggttggttagacaaggcggttgatctttaatcactcagtcagggatgtctgcccattctcattaggaagatctgctgcccacctccaatttcctcccttccttccagtccactgcagtcagcaaggctgttttccttttccttttgtccagcagtcaataacattgatttttacagcactaggtgattctcacctcttccctcattatcccctccttcagggctaaacaaagccatgttccctggagtgcagcacaatctgcagagcctgtaaaaccaaaatggccagaggcaggatgcagggatttggctgggtatgcgggggatggtcagtgccatcaaatctcatgggaacatcctgggcagaatatttttgatatagtcttaacttaaggggtaatatatcctccagaggaaaaacgcacataaaatgtctatcttgttcactgcaatttcactgagtagtgaaagccctgagatcctgtttccatgtataattcttactgagcctattcggatagatagacactactcctggggaagaggccacctatcaaaatgggtcaaaagagcagtagtacataattgggccgtagatgaccagaagaaattgcagaagaaaagaatgtactcaatgattgctttttgcatgctagaaatttcttaatttttatttattttaatcatgattaaaacctgtcaggtgagggttactgcccccactaaacagactctaaaactgaaacttagaaacgcaaattagcatacccaaagtcacatagcaagaaaatggcaaagctagtctttctatacacacaattctgtcttccagaactgcagacttttctttctgagagtttatataaaagctatgataattaaaaagagtggaaacattacccctctgtttaaagatcaagggaaagatactggaatttgttttgattcagtaatcttgtaaagaaatgagcaagaacggttttgtagcttagctaaggaagagcaggaacagagagaaacctcaaatactatttaggaaagatttagctcaggctggttaaaaggtgcatcgatgcagggtttcaaagacgagaaaagaaatttcaggtttctggactattcagaccatgattgctgtggaattacatgtgaacaagtagagttagctttagtaaccctgccacttaagtcttatagccctaggtttgaatttatttctacctcttaccagctgtgtgatcatgagctagttatttagccagtcttagcctttgtttcttcagctgtaagatgggatactaatgtcgatcatataaacaaagattttgttgaaaaacttatatgttgaaagcatataagtgcttatatgttgaaatatgctttcaacatatgtttttcaacaaaatctttgtttatatgatagacattagcatcccatcttacaagccctccatggtgtcttatacataaaaaaaatctgattcaatggtagattccttcttttctcagtgatgtcccacccttccccacaacataatgtgaaaactaattcccagtctttctttccgatgaggtctaaataagggcaatgttactactcacaggggaaactttctgagaatcaaagccttaaaaatctgtatcaaattcagccataacaataaatttcaagtctaaaccctcatgtggaagagaaatatggatgtccctagggctatccagcagcttctgaagacacacacttgagtcgtactgtctgatagagtaacgactggacacatgtggctgttgagcacttgaggtattggtagtctgaactgagatgcattgtaagtgtaaaaaacacattgaattttgaagatttagtatgaaaaaatgaagtatctcattaatctttatctttgattatatgttgaattgataatattttgtatattttagtttatataaaatgtagtattaaaattgatcttacctctttttttccacttttttcaatgtggctactagaaaatttaaaattacatatatggctctcatttgtggttcttattatattttttttagacattgctgttgtggaggctaaagggtaactcgttctttccatggatggagaggcccttgacattgatattctgaaagggtttttataatcagtgtggtttgtgctcttcctccctatcttgagaaagacagataggatgggtaagaatctttctagctctgtagtcctggatcttgacacaaccattgaatgctagatttaaaagggaactttgagattccaagtttcaacactcaactacagtccaaggaggttaagtgacttgcccagaaggctaatgtccagcactttttccattaaaatgtacagcctctcaagtgcatgaccactcttctcaatatttatattgtcttgggagaatgcaaactctgtcattgggtgcagacaggttttcttggaatggaaatttttctcctctgccatgttctaagtggtcccagaggagaacccttatttgactttcaaaattatgtactagtataatctcctcggtggatccctcctatcccaggcaaaattagttaatttctattcttccttctttacatagctctatttcagctccgaagaaactgttttgtgttgactgactcacacataaactccttaattcaaggtgcttgttttgcgggcttagcatcaggcacatgttaggcctgcagtaaatattagtttaattgaactgttgttgggaaaactctcacagactccctttgatgtcctgaatcttcctattctattcttgttattcaatttcattaaaatagtaaacaaaaccctcaactttctctttctttacatatatattttttctcaatcactcatacttggaaaatgctgtcatgttttggaaatatcattccttcactctttcttaatctcccagttagtcgtatgttgaattgcctcatcaaagggaccctctctaaataaatgaagtcggacttgtcagtcaggggcggattgagtaggcctgaagaagccatgattcatgcagtctcatttccatggtgtatgccttaaatgccacatctccagttagcagttagtctctcatgaaaacaaattcagctttcattccttttgggttttaaaaattctattttgaaatttgtgttaagaatatactccttttggccttttggctttctcaaggtgggatttagaaatggctccatttccccagaaaattgattataaaacctgtgtatactgataccctcattttagcattaaacatctacaacagtttaaagaagaagggaatgaattttttagctttccatgccttggattcagttcttttctctctttctatgcagctatgtcaggataggagataatttgaatatggataaatcctagccctagtcccttggcctcactatttccatttttttccccctgcccacactttgctaaaatatgtgtatttctttgattatttgattacgacatgcctccctgatagacttcaaattccatggtggtaggaaccatatcagttttacctacattatatccttaggagttatgggcgtcataaatggtagaaggaggcaagcttttttgttttttttaataagctgtcagttaattgtctccaaattatcatgtctcctgtctcatatgtttttatttgataatatatccatcatcccgtcttccctgacttaaagcacactaattattgccaccccttggctctctgtgtgtgtgtgtgtgtgtgtgtgtgtgtgtgttagccttgctgtgggtaatggacaacacaggtcaagtcatcgagtacttttttccctgtcacacacatgtgcccatacctcacctgctgtattttggtgtatgttaaaagttaattttttagggatgtaaaaaaaaaaaaaacaaaaaaaccaaaacttgtttttatattagttcaagataaagataaaaaaaaaaggaaaaaagggaacttaactctgttgttcaagaaaataaaaattatagagtgtattcctaaggtaaatatttaaaattatatttgactgatcatatattctagctatgccatgtgactccattagagcaattatttgtgctgaatttgctgaactaggaatcttagtttaaactaggctttaactgccagatgaggtttatacaaggcatttttaatcattggtgtgatttgcttatactttagacaatctggaagtggtactaaaaaccaattttaggaacatgttaaactgtaccatgtgtatgcaatcaacaaaatccagactttggggaagtctaaaggtcaaatggctcaggcttttcaacagattaataataagaaaaagaaagagatggagtaaaaacctgtaaagtttaagagacatagaaaactaagctatagtgttcaggaatagactataaaaaatacaagaaatggattattatagaagtcagcccatgcttacttttgaaggaaaggagggtgtttgattggcctgaggcacatggagacttctgtggtggctggcaaagttccatttattgacgtgagtggtggttacaggagtttgtgcttaaataattcatcaaatcatacatttcctgtggttatctgtgtctgttttattttacaatacaaaaggttttaaaatgcagaaaaaaagagaaaatctattttattaccaatctttttgaattccaaattaaaatatctcagaagtgtattgtgttaagtcatagagtctattgggggctgtcttttaatggcagagagagaaagcattggatacttcattcggatattagattttacaaaattctttgagttttgaaaagtatttaacattggaggagagactaaagaagtagaaaaagaagaacttgtacacagatatgtaaaccgatagaaaaacttccagatgtttttctaaacaattaaaaattcaggtcatgcctgaatttttagggcgcagtggcccatgcctgtaatcccagcactttgggaggctgcgatgggagagtcactgaagccaggagttcaaggccagcctgaccaacatggtgaaatcctgtgtctaccaaaaataaaataaaatacaacaattaactgggcatggtggtgcacgcctataatccaagctacttgggaggctaagatagcaccactgcactctagcctgggcgacagagcgagaccctgtctcaaaaaacaaaacaaaaaattcaggtcaagccagttggctttatagagatatacattacaatgagcctaataaacatcagggtgctcattaaagtaaatttctccattatttgcaccgtgaaaatgtaagaaattgtggtgtattcagactttggcagggccttggcagggaaatggggaagaactttgttccataaatgtttattttgccttttttgtgtgtattagacactgttttattaaaacttcacaatgaccatttaagattggtttattatctacattttacagatcaggaaaaactaaatgacggaaatagtttcaatagctggacttaaaggacaaatgggattcaaaccctcagttatgggcagcagaaaagccatttctagcaaaagaagtagcgaacggcaatgtgtgacagtaggaaagcatagaaaacatttaggaaacagtatagtctgatttagttaaaaaataagatctgaaaaagtaaacggaggccatatcatgaatatcgaggtgagctttcagagtggaaaagcaacattatgaagtttttggaatattattttgttcatgatgcatctgacaatgtaattacacaaacaaagggatataattgcaattaaaatgaaatttaagaaaatgtgatcttgaagaaaaggaagtgtatcattacacagtaggtagaatatagatagaatttgttgcaccattatgttccagaggaaatggtgtgacattttaagacttggtgcgtatgggtctagttgctctgctagaagatttctatactcttatcaagggtatatgatgccaattttaaagaattattgttaaaactgagtacttttgttatggtaatctttgtcagtttggttaaaacttttatctcagtgttgattcacttcttacgttctcaataatgttgaacattgcataagcctatagtcatttgtatttctccatttgtaaattgcctttcacatcatgttattgaaaaaactggaaattttttcatttatctgtaaaacttttttacatattaagaataataatgatttttatcacctgttggaaataatttttctgaggtggatgtaacttgcctttaatcattattggctatgaatctcaatgaaccaaaaaacatttctatgtattgtggctccttttacttttaatactctctaaaattttattcttactaaaactttttgaagtagagaaagaactgcacaactatcctaattttgtagttgagggaaactatattcagcaacttgactctagctttacctgtatgataatatgactttttgaaacatctatgaaatggagataacactatatgtgtacattacttgattcaactaagtttgtgaacaatgccaactatcagggatatgaagatgagtaagaaagattcctgcccctgagtagcttatattcttaagggcatactggtacctatgtgcttatatcattatgatgatgtaagcatactctataggaatggtggggccttagctaactacgcaaaggggtgttggggaaattttcaactcttaaagaattagtaggaggtaggagatatctgttagttaaaacataaggcatgaaagtggtgaaagatgctgatcttgtttaggaaatagcatatatgtctactgtgttcagagagtaaagaagggaagaaataatttggagtaatcttgtgaaggtctttgtattcgctaaaggtttagaattcattctcttgtatgttttatagtatcaccagtttaatttttcttatgtcttgaaatagaggagtgttctgaccagatttgtgcttttaggaagaccattttcacaggagagttggaagatggcctgggtatggaatcagagaggaaatgatgaatagagttaagaagctattgtaatgcttcagaaaagaaaaggtaaaggcttgacctatgaaaataacttgggaaaggaagaaagaaccctaatgaagaaagatttaggggagtaaaagtaagacaataactgtgagctattatgtgagttacgggagtggcagagagggagaagctgagactcatacattcagcttggatagcggaaaagattatggtgttgttagctatcctagagaatttcagcacagacctggagaagaaaataacagtttgcacgtgttgagtactatgggtaagccctgagaggcattcagtggacagctatacatgccagtctgcatctctggtgtgaatagcaagctggaaatagacatctggccatcatcactatgtaagtggcagttgaaatcacaggtgtggataacatttcccagggcaactgtgaaaagtgaaaggagaatagctacggacagaaccctgggggataccaccattgtggggagagatgttgtgaagatcagatctatatctgaaagcactttgagtgataatgcactttttagatataaggtattattattaagatattcggcttctgtaaggggatagagataagtgctaccacatgatgcattgaagcagaagaataattgccattttaacctcagaggcattgtgaaaatctgtaagcagatactttataaaaacatttcaaatgctaaggtaaaagaagcctttgtaagactaaacaagagccagagttcttagttttgcaggttccaactgtagccatggatttgccatctgggaatttgtagtaactgtaagcaagtatgttgccactgagtcatctcccatggagtgctggagaaacaaggcctgcgtccagatttccattcaagaattttacaaaattgccttccaagaaagcccaagagattttcattaacaaggttagcttaacatttgtacatagttttttttgaatttgtagtactggagatatttttattagggcaataggaagaaaattaaataatttcttattataacctatatgtttatctcccaaaatatttccagaattcctatattttgaatttagtgttgcaaactcagccttcctttttttccccccttaattcaacactaagaaaatgtttagtaaactgtgtggtacaatagaaatggctatagaatttggattcaaatatattaagagtttgttttctacttttgataattgttgatgtcaaactagattttcatgaatgtcagttacttcatctgcaaaatgtgagtaatagctaaattactggtctgctgtataaatcaaatgaccctataacaacattttaagctgttaaaacacattattaatataagggagtatctaaatataaaattatagttaactctcttattctgaaagaagtttgattttaaagatttattctagttaatggagtaacagagtttaagattaattaactttcaccaaatgtttaattttgaaggatattcatttttctaagtctcaagaagagggaactacgtggaaaattcctgattgaatattgaatgtgtggtatcagggctcaaaaccaacttatctctttagtaaagtgcgtgagtaacttggctatggcatctcttatcccactgattgtcaggatatattgcggagacctagctctcagtttcattaaattcctcatcccttccttctcagcctgtgaccctcctgaagccttgggcttactaaaagaagattctcaatgactactactctagttgctcccactgaagattgttgtaatttctcatagcatttatcatgtggaaatatatattatggctattgttggggatcttttctagtaagctgaaaacatggtgtcagagggtatgtcttcgcttttaaatggatttttaaatgtctattaattgctttttcttttacattaaaaacattttattctaccttttattttgttagctaatttacatatggactcgctaagtatctgaaagaggaaaagaagaataaaagaaaggctggaaggaaaaacatgaactttagagaattataataaattcttataatgatcctcaatggccttgcatattgtgtactgaaaattaatactgaggttgacattttgatctcaagggttaaaataatgtattatttaaaaccttacgtaacctatgtagatcagaagcttggtaaatagaaaaaggaataaaactcccaagaaatatattttcatttctgttgcagaagatcatttttaaatgtgtgaaaagtgaattgaagagctaatttcatttagttctatcttcaatgatccagttatgcatgaacataatgttgtttcttattatgaaaataaccaccaaatgtagtactctgcatgtatacagtgatatctaaatttgatttctttatattttaactactaagctttatgatattaaaatagttgactaatagagattttcacattgttaaagtatgctgaaggatatatcccttttatagaagaatgtgattctctagttacttttcattcccccaaaagagtaaaagtatcttgaagacaaggatgcttatttgcgattgtattcccagtgcctgttagagtttaacacataatatagtacagaatatttgtgggttcaattaatgtctatattacctaattaatttgctaagaatagagctgttttatttaagttaggttttacctacaatccttgattttaaaattcacatctatgttcttgataagtaaaatgatttaagaaaaataatttagaaaggtgttgcttaccagaaagaaaagtttcagtaatgtattcagtattgcctctgacaaaatattcaaatcattaatcaaatctatttgtcctacaaattaggtgagagcatttcttaccaccagccatcatatgtaagatactgaaggtcagaggaaatattcttaatgatctaaggcaaattctctcagcctggaaataattcccaaggaattaagtcatgtaccactagatgctgcattaactctttcaggccactaaggtactattgagtgcactgaagctgcagtttaccaaatggtaccccagtggtcttactcagttattgcagcctccagaagggcctgtgtcttcccagagagaagtttaagcattggaaaaatctggttcagaatatattttcccaaggtgatgcttaaaggaaacagctaatgcatagctttaccttgtagcacacacagacaattctttatgtaaatgtatctctgagtggtgaagatgctccctgcttctcttttgctcactgccatttctaggggaattggaatagattatggggtagctttatttaaaattgacatttatgtaatataatggtttatataaaccaataatattggtgcttccaaactgtccttaagcagaagcagatagcagaggtggcgggaagaagagaagttatggaagaaaaatgttacgtgtttttggatgttaccaacatttgttgcacggtgaggtcccttgggccccagtaattgctagatgcaagtgagattaccaacatttttagttctttgtcttttaatttagtcatgtgggctagctaggaggcaacagtgttgaaataattgtggcagtgactcagatttgacatttgctacacaattagattttctttaggtcaaccatagcagatcaaactttgccttcagcaaaccttcctcaaatctattgtaatttcatcagagtggggaagcatgacactagagggggttttgtatctgaagaaccatcacacattctttgatacatttttcataggttttgatgttttctctgttcagtgaaatatcagttttatttatttaattctctttatagaagattatttagtgatctattctgttggccggaattgaagcctattttaagtcactcactcattcacaaaaatttgtgatttcccaccatgtagcttctgcacaagcactgggaatacaaaaatgaataaaattcaatctcacctttcaaggaattttacagtttagtacatagaggtaggcatatgaatgaataattgttataaagtgtaataatagctgtaatagagatatacagagcttactacacaaatgactaaattcaatctgaatctttgctggggaggggaacatacagaggaaggaagtgatgttttaagctgggccatggaagatagctagatagttttttagaagaaaaggcaggtaaggtaagaaaaagcattctaggaagagggtatgccatgtagtttagaacagtggaggggagagaggatcttggtatacttgggaatggaagccaaaaaaagagcttctaggaaaggataagaaattgtggcacattttccagaaatattaagtgggatagtaacagaaataattctaaatttggcatttggttttctaatgtcaaagaacatttgcagtagaagggaaaggacagaagctagtttactctcacatgaagtaagaaatgaaattgtatgatgaagataatgcaggaggctttgagtactctttcaagaaagtggtagagggaaggagattgataggatggtagctaacgaaaaaagcatggtttataaaagtctttggggattgggtagatttgatattttagaacaaggaaagaaaccaataaagcaaaaacatgaagatactattcaagcaaaatgactatttttgtttaataaattagtgaagtattacagctgattagaaattttttactctcccacctagctctgtgctcaactaatacaaacttagcttatttaacaaagtcatgtaaaaactgagtaggaaaaaagtacattttaattatataaagtgaccatttttattgttatatctttgcaaagtgaagccatattttcaacttaaaattatttttcacactgagttatttagggaattgtaaagatccatctcaaacttacctaccatcaagtttgctgtcttcagggtagaaaagcacagttaatttgaaatagacttcagtcttttttataggagcttatgtatttttccaacaataatagttcatgtgggtagaaactatgtgttccatattatctctggaccattttacccaatattttttacacggccagatccagtaagtgttaaattaccttaaatgctttactctaaagaagttataaaatcataagactcctgcttcccaaagcctcgatttaggaaacactatgtaattgagatacagatattttccttaaaactcagcatctaatttttatttagtctttttaagaaagtcacagaagaatttaatctttatagtctcctagaaattctaggaatatatttgatgagtatcttcagtagaatgctgttcactctagaaagatatatgataagtgagttcttggaaaaaatgatcatggttgccagataccaggatagattcatggttgaagagaagagtataaatattattttaatctctaggaaattacttgggagaataggagagaaacaaggccatgccctttctctaggttcatttaataactgttgaattaacagaacatgcttaagctatattgcttatagcattattgttcataattgcaaaaactagaaacaacataaatgtatgtactttgtgacttattaatacaatggatactatgtagtggtaaaaatgaatgaattacccatatagaccataaaatggatgaattgacaaaagagaagacaatatataaggtgattctatttacataaagttcagaaacagacaaaattagaaagtattatttaggggtatatatatatatatatgtaactagtacaagaaaagcaaaggaatgattaacaaaaaatattgtggggtgaaggagtgtgatttgattagttatggtacacaagatgcttcagagtcagctgtattaatacatttcttaagctggttggttggtacatagaaactcattttataatgaaaaaaattgtatgtacagtagtccttagccacaggggatatgctcaaaacccccaatggatgcccaaaactgtagacagtacctgaatagactatgttttttttttccagctatgcatacatacatacttgtgataaagtttaatttataaattatgcacagtaagagatgaacaattattaataaaatagaacaattataataatataccctaataaaaattatgtgaacatagtattgctttctcacaaaatgtcttactatattgtactcatctattttctgaccagagttgactgtacgtaactgacaccatggaatacaaaactgtggataagtggcaactactatctctgtttatgctgttttcatatgcatcatacatttttatgacaaaaatgacagtctggcatatggtgagaactcaacaaatggcaggttctgttattattgatacaattactatttatcattgttactcagtaaatacttgttaaatggattacaccttctcttatcaaagatgtgttagattttcccagatttcttgctgttgatgagtatatcaacaacatcgtgggaaatattgggaggaaaaacttgtagcacttaagcatccacatctttaacaagcatctaactgtttgagaacatgtaggtggttcactaaattctccatcttcatcaccatctttggcacaatattagtggaccctctgctcgttgtagaatttgcatataagtttggataatgatttgttgctggcataaatatattaaagatcatattttcattctgcattgaaatagaagtctacaaaatgtatataaagctaatgatttaaacaatttgaagagtcaatatttcacagttaatattttctcctcatagaaaatctgactgaagcccactgttaatttcattgttttctgtgctcactcctaactaatcaaccagttaataaatgatacatattgatagatacagtatatctattaatacattcataaattcaaaaatattaataaagtagccatttgctgcaagtctgctaagtggtaggtgccctggtgaacacctacatgcactgacaggttgttataaactatctggattctcagatttcatacaaagatgtcacttaatctccattctcagatgattattatagtgcatacctctgctcttaacttgatacatgaccaaaatacttattcaaactataacttcacattagtcaatacccaataactagtaaatattgcctcagagaaacagatatttttggaagattgccttaaactttgtgaaactccccttacaataaaactaataaaactaaaaaactatctgccttttaatttggtactggtgtgcttctcactgcccccaaaattactttattgaactgtagtttgaaatgatgtcatagatgtaggtggtaagaaaagcaaagctatgatatcattgctctgtctacagtagtgttctgccattgtattaatctttatcagaacccatggaagaaatatttttatgaccttatttgattcttgagtcatttgcgttggtctttttggtcttttttaaaaaataataaaatcacagtgaaacaggttactgattatatctttctcccactgctgaggtgcctagtatcatatttgtattcaataactaaccattgctttgttttaaaatagcatcaatgtggttccactaatatcttttcttcttctatttattttttacaaccttatttaaactaatattaatattttaattttaaattctgttatgtttaaacgtcattttacaccctctctaaaatgaggcaaatcatgtaaataagttgagtaaacacaattttgtaataattctacaattaaattttaacttcatttaaattaaattttagatgagaatatgtaagtggcttatccaatgtcatacagtgtgttaataatggaaacaatattaaaatccagtttgtactagggattcaagtatgagtgagacagacattgccccgtggagccccctttgcctggtgagggcactagcaggactaagctggctcagaatccgcaaggggtctcagcaggtgtgctgtggtgaaagacactgacataaattgtagacatcctaggccagaggcaggagattggtcttagcatctctgagcatgtaacttaagtagtcagccttccatctctatcccagtaggcactagtcaaacagtgatccttgcctgatccatgtgatatagagtatcattgaacctaactcccaacaatgcctccctcctgctccttccaacaatgtggctacttactcttcaaagaattccctgccttagaacttcatatttactcaaacaattcttgtcttcactggaacaagaatgtagagttctttttcttatttaatgaaagcccttctttactaagtactccaccaagtaggagacccaggagtttgtgtgtgtaaacatgtggtgagtatgtgtatgtatactaaattacacgccataatttggagcttaacatggaattgtacaagaatagcggattcatgaaatggcaattcatgaagcttgagtggtaaagaagagtgagcagaagaggaagtgggagaagttggaagggacaatttaaagaaaattatttaagtgaaaggcaagataagatttctgctttttaaatactgtcctcctaggaacatacactgattaacatgaaatgattaaagactaaataaaaactaaagtcttgttgatgaccttgactgtacaaggattccagagaagggcaaccaagaagctttacctaggaggccaagcttgagaacctttgaaagatgagaaagtttaatcagtcaaagaaaggatggcattgtatacatagatttatagaacctcagtgaccataattcatttgagactgttttccatagtcattacagagaactggcttcataaaattctgaacacttctgagattattcttaaatttcttatgtatataatttataatatccagcgaggtcataaataccctaaagcctatgctgtttcttctctttcttttgtactgcccaaatgtgcctgtacagtgctgtaagctaacaatttcctgtaaatacttattaattgactatacaatcaccttgtaagatattaataataatagcatctacttacacagttactatgtctcagggagattcattcataacatttatgtggcttgaaacaaaagttcaaatggaagtcatataccaaatattttaaagttctaaaacaagctaacaaaccgtcactgaatatatttaatcctcctactttaacaaatattttttcaaaatgaacctgcaaatccacgttcaaagtgagactcaactgagtaaactttcagactcttcagaattcctagccataaggaggtagcataggaagaagggacctgagctcctgggctaagaaccacctcgttttcttccctccccatgaagatttcttctgcactgtctcatgactcacatttagagctattgacactttagcacatgcttttaagccacaccatttgaaacccattgtgatacttaggagtacacacacccgcagagatggtccaccattaaaaaatgaattaggcacatatctagggtctagaaacaggacaatttgggcaggatgcagggtcgaactcttgatgaggtggtgcttaggcaccagatgggcacatccccttgatcctacaagctcctcacctgatgaggaggagttcttatcagagaaagatcggagtgagaccttctaaagtatgtgaacagaggaaacggatgctccagcccagagctattggcaagtaatatgctaagcgcttaaaatttttattgacaagaagagtacgcgtcaaaattgtttaatgtctactcggtttctgatgggcagtatataaatggtgaaattagcatttgaaccctagtctgtgtaacttctgagtctcttaccttcacttgagggttcttggggggctgtggaaaacctgccttattctctggtttgttttttcttctcttctcttcctctgttttagtgtatgatgatagagtgaggaagttgctagggttggcaagtataggaagtaaaagggtaagagggagaaagggcatgtgggaattttgaaaagtgaattggtgggaagcaaaagtagaagagaagagccagaaaacggatatcacagaaaaaggaagagttaggtttaaccctatggtttttaaagggccaacagcacccttaattaatattaaatatttcttctttaaaggagaaaaattctcttaagtccaccagtgttatttttattataaaatatatttaaacacatgtcaacacaaaacaggcataacttttattaaactataagcataaatttagaaaacatatataaataaataaaaatactcaatttatttattaatccatccagcaaatgtttaataggcagttatgagccaggtactaggggtatagcagcagataaaacagataaagccttttttttgccatagagctgcattctagtggaatgaaattaacattaacaatggttatttaatataaagaatgacattttgctgaaacaagatctctgattacagcatgaatatagttctaacagcttttgagtttggcatgaccatgccatcctgcacatcccaatatgactcaattatctggccatttgtcactattcaaattattggcaaatatcctatgacatcagttgcctttcatgtgtcacaacatatcatttatatttaggtccctttctcattagccaagactatgaaataatactcagtactatgcaattatattcccaagtataactgtagaccttgaagtcctgtgttagcactcagttataaggtgccatttaaatgattctgaaaaacttgcttaattaaatagattaccatataaatataaaattaagacttgtagagaaatctaaaattcacttgaaaacacccacaaaacatggtttgagaagtattataataaatggtgcatcctatttttttatccctcatctgacttttaatatagattctttgagggcagagatgctctgctttaggtctgtattcacagggctgttcacatatctggcacaaagcagatgcttagacatggcttttgagtgaatgaagaagtgaatgattgaacaaactctgggtccaaaatatattttaatcttttactatgggaatctgcccaaatgacccttgttgccatgataaagatgatttcctctgccttttaaaacatatggctgtaaatatgccaatactatatatttttaaggtttgttatttttaaattaaaattcaagaatttaagaaaaaattactgttatcctgatgaaaccctcttcattcattaatttcctgtcatatttttccacatatatagggttgaaattgtggtgtacttatgtgtgacagtatttcttcctttaccattactttgtatatatttttaaatgtcagttaatagcatataatcccaatatatattatgctaatatttatccttattacaaaattaacacatttattgaagataatttaaaaatactaatattcctaccataaagggaaagctgctgttattttatattgtggtatatccttccattctttttctaatacatacatatgctgtacatgtgtctgtgttaaaaaaggaaagccaactgtgtagtcttttaaaatgtagcatatttaaaactgttagagaaatgctggtgtgtataaagtacaggtaggatgccaaagggaaatctaacatatagactgccaccacgtagctaaaataactacattatttggaatttggagcccctgtactttctgggaacccgggtgagggatggtaagaaaaagtctaaggatcagaagtaactaagccaaagtcctgagaattggacttaagagcaaagcatgatcttgttgctaggcaaccaacattccaagaggaatcatccagacagcacacacgctgctctgtcccccagcatgacatgtgcagagtatgtctgaggatggctggacccaccatgcacactggcctctgaagactggcctgcgtaatgcctgtaaaacatatccctgacctactcagctcagtctgccacagcccaaatggaaaagacagacagctctgggactgatattcagtaaagcccctgtgggatcacagtgaaactgtgctaggggtgatctgtcaagatctggctgtcattgccttttcctatgaatgacttcagtagggtgcaggtgggggaactctagactccacaggaaaaaccataatgacatgtcttttcaggcatattcaggacttgggaagaatgtttagggttggggagggggagatgaataaggcctgtttcttctcctccggggagagaacatatcagataggtacagaattggcaatgcaactttcttattcaaactgttaaaaatggcagctcccaattcttataagaatatgactaatcagtgttcccaaaatgcagtattctggaggacttgaccgcttcacagtacaattaatcatctgcctgatgtctgagaggtaacttggaccttttgtactttttctacagcacaagagaagggaactaacagttattgaacgcttaagtgtccacagtctcttagccacatttccaatatccaaaaagtactaaaaaataagcttagataaaaactgcaacaataattcaatcaatcctttatacccttcaatcaggtcccctaattgttaacattttgccatctagaaaataaaaagggtttcataagtttgtagcaaactagtctgtcaataaaacttggcctgaaatgccaagtagctatataaggtctttattcattctactatcatatgactatccatatatttcactgaggaactattatttgactatgaggcatctcaagattacaatggaaaatgtaaagccagattagaatctgtttcctgagggaaccacagtggtgtgttccctcatctgccatgtgtcttggcaaactcgagacttttgtaggtctctaggtctattcctgagtcaaggatggatgtatcaaaacaaaggagatagatgtacatgccattgcgcaagcacctgaactaaccctcagcatgatgggtaacaacaagggctttgccttggaagacctcaactgtttataattttctgataagaaaaagcgataataattatctctgaattatgcagttttaatttaatttaaaaaattaaattagcacagggcttagcagatagctataatcaaagaaattatcattatcacaccatcccctatttaccctgctgaacatttcacttttgtcccttcagacagttccttgtctatactgttgtctgttttctgtagtaatggttgtttgtaggaatactgaccaattaattttccccaaataccaccgctaaagcttcccactctatcttggaacacccatatcttgtcttcttgttttagttttgcaaatcagttaaggcccagtttaaatctccccctcaccatgaagccttcagagatttttacagccctcagtagtgttatcatctaatgcattcttatactgtttattctatttgctattacctagcgcttaacaatccataatgctgtagagtttgtcttgcccttttaagtaactatagagatgaggatcgtgcctttatatttctttgtccgtttgtcagtgataagccatggtagactccatgaaaaggtctaaataaatatctgtaagtttaagagattttaatgtgtccagaggtttcctcctgaaaacttttggatttgaattgagattattgaggccttatgccaaggatagaaaacataagacataggtatcattacctttcttcttcagtggaagacattaatattcaattgtgtcaatctttcataataaacccagatctacctcagaaccttttcagttgtggtgaagacgctttgccagtgggtcagaactgaagttctagatgatgtatatttgctgcttatcacttctgcctccccactgaccacagtaatagcagaatgatttagatgatagcagaaccagccaacatgggttgacatctctggaaagaatgaaggaagaagagggttgatagtgatctttcttggagatagggaaagaaattggaggatagaagctaataagaaaagatttttttttttgcctgagatgcaaatgagtttaaaagtaacaaaatatatgaacaagagtatattagggttttccagagaaatagccaataggagatatataaaaaggagagaaagagatttattatgagaattggctcacatgattatggaggccaagaaattccatcacttgctgtctgcaagttggaaaatggtatcattcaatttcactccaaaagcctaagaactgaaaagtaggaatggtgctgttttaagtcctagagtccaaaggaccaagaacaagcaggtctgatgtctgagggcaggaaaagatagatagcccagctcaagaagggagagcaaaaattcacccttcctttgcctttttgttttattgagaccctgaatcgattggataatacctgtccacattggtgagagtcgatctttttcactcattctactcattcaaatgctaatttactccgaaacaccctcacagacacattcagaaacaatgttttatcagctatctgggcatctcttagcccagccaagttgacatgtaaaataaactatcacaaagagaaatttctgtttgtttatcaatttgcagtgttctatggagaagggataaataagaaaatatgaatcaatgagagggccacagtattgttgttgttgttgtttattacaacattatttctgagaaacttcttcaactctcaaatagtttttgaggtaatgaattggtatgaggagctttaaattagttaaatgcagctgggtaattgtggatactagttacagcagatgtagtggtcatgcttgaggaaactgaaaggaacaaacaaatcccattatgcagctcagggaatcgatagtctcttcttgtgaagaaacggtatggaggcagatagacctagatttgatttcctcctctcccaatctctagaaatgtgactatgggcaagtaatttaactgtctgagcctcagttttcccacatgtagggatcaaaaggtggtacttgataaagtattattattccacagcttgacggaaaaatactcatttgatgcccattctcttgatcctaattaagtggactggacgtttatgtgtcatcaaatattagcgtgatgtcaccagtggaaactgacataattgatatcagaaggggatacatggatatataactaattgtggcatgtcagttgttatgagcttctttcaggcttttaatgaatattttgctattttaaaatttcactctgactataaccagatggtcagtgataaaatccagatcccaagacttcccaatatctatacatgccagcattttcactttcataaatcagctatctggtaggtttgaattaagagttttctttcttttcagggaagctgttttgctttcatttttaattataacctcacatccggatgtttccagtatactatttgtagagcaatttatgattaacaagttaaaaattttttcttcaagatttgagcatgaacagatggtgcttttcagtgtctttttaaaggtgctctgtatctctttcatatcagaacctaaagtatgaatttaacattgtataactgaaaatatatggaaaaggaaaagtgactgtatagtttcaagtccacatcaacacttctcccttaacagagagagaatctcttcagtttagtagcattcttgtgattgtttgatataattagaatctgaatgagaatctgagcttatatactactttgatagaagggtgagaactcctgaagatgagtagtttaaaaagattaatttcatgcaacctgcagtttaaaataggtatctcagaattatgcattagcatgcttaatcttttgcattgaaaatttgaccgtgtttgacaaggttgcatgtgaagatgaacagaaataaatacattctgtcaaacattcttcatgtcctcacctgatcactgtgttttctacctgtctatgttattattggttcccaaccaagtgaactgcttcattaaggttatgacaagtacttggcaaattaaatggttttgcaccttctaatgtgctatttttagataaattccaagtttatacacaacgaatatacaaatataaatgatctcatgagttgtggctgtggtccactcaaacctgacagtggtgccaagagatgtttgtgggtaagcatagtcatttcttcaaggcttcccaaggcaggcacaggatgtggaatctccctttaaggaaaataactctaaacatcttccttattttttcttctcattcattagccataatagattggtagacaatgagtaacagtaaagaaaatgatcttgttgtttcttctataaatatgataatcaataagcatatgtcttttctgctccccaaaagacatgaaaatttgaaagtagctctaggaaatatcttggggttgtggcagaggatgaggcagttgacagagattgatgataaagaaaacctgttacactctagcaactaaacctagcttatatttcagtattatccattcttcaaagcttttcctgaccttcccaggttaagctgttgcctccccttctttgaaactcctttaagggatttttgtgtttgtgagtctatctccctcatgagattgtaagccccatggaaacaagatccctgtcttaactaatctttaaatctcctgaacccaatgcaatacctagtgaatagtgggcattcaataaacatttgtggagcttatttaattgaatttccaagtagaatattatttcatgtatctattgagaataactcaatattattgagttatcttgcagtttttacacttttcccctggtaatgatttgaaattccttctaaccagtgcaaaattaaacttttccttggaacgttgtatcctaaaagggtcaatgttaaggtggtgctggttttcattgcttatagcgggagccacatttcatgaatacctactatgcaccaggtactgtgctacacacatttatcctatgagatgggtattttaatctccattttgcaggtatgaaaactgaagctttaaggaactaagtggtttgcctgacctcacagagccagtaatatgcaggaccaagaattaaagtcacttatttccaactctgatttccatactataaaacattacaaaacattattccaggccaggcatggtacctcacacctgtaatcccaacactttgggaggctgaggcaggaggatcacttgagcccaggagtttgaggccgcaataagctatgaatatgccactgcaatctatccttgggtgacagagcaagaccccatctcttaaaaaaattattctgtattgctttcctaatgtgcatacctttgtgcatgccagaaaatcattagatgcttaaaaaattctggttcattaaattgttaccaaaacatttttgaaagttttctaagttctttacgataaaatatttgtcctccagtatgcaaacaacctttgccagggtactgatctctgtgaggttaatggatatgctttccattttacagtagtcctcaaccttcttgtgatgatatgagatgacaaaatgcctgtatgataagaagaagtgaggtgagtgatgcaggcattgcgacatagctttaggtgatcctggatcttcaagccatgatgatgttgttggttagatgtcaggatcagacaatgttaatggctaatgggcagctagtttatatagtgtgaataccctggacaaagggacattttacattccttgtggcatagagtgggatagcacatgatttcagcatgttactcaaaaggcacacaatgtaaaactgatgaattgtttattgttgtaatttttcatttaatatttttggaccatggttggccacaagtaactgaaattgtggaaagagaatctgcagataagaaggcaatactgtatcccctggatatgctaatgaaaataaaatatactagtggttgagatcaggaaaaaaaaaacttctaaaaggaccactcacatcactgtccaccttacaaagagcaatttaaaaactctcactaaaaattaatctgaagttagttgtatagtcaaagttgtccaatcaaggttacattgaatggtcacccattactgtcactgcttttgaatttccttaggactataaagctgaaatacttaaatagatctgaggatgcttctgcataatattataatttattttttagttccttttaattgaattcaagtagcatatcacccttcattttttagccttctatttataaatcagaatttagtggttacttagagaccatagttttgttttgttttgttttgttttacatttagacaaatccatcacactaagacctcatagcctaaagataaagtgagcctatcttcaacagaaaatgctcaacagagataactaacatcagactatcaggtcacttaaaattaaaagcttttattttctctaaaaattgtctacagcaatagaaatcaccctcggaaagcaagagagtaaatatcctaatttgtgttttgactttgggtgacaaaaaacactctttaatttatatgtcatgtgtgagtagcttagaatcctttatttgttattgttatcaacataatattaagaatgaagaagttaaacaattctctttggacttaaaggtaccaggataatgcatagtgttttggcacaagaagtctcatgggacccatgtttctgttcactttacaatttcctgccaaaaggacttaaaattccatagaatacagattccacagagtgaatgaagatccagacacacagcgttcaggttagacaaaaccattttagtatcaccctattgcttcttacatgctgctgagagtaatgaaagaaacaaagcctccagaagaaactcactgataaaaactcatttaaattacttgtattttgagtgagaatatgatttaactaacttcttggaagttaaaaagtgaatattttagcaatgatggtttaggccaaggatttgaactgctagaatttttcttctacccacacaggtgaagggatattgtcagtaattagtgaggagaagtggaggaatggagattgatatgtgaacaatatttttttaattttctttttttaatgtctttgttttttaaaattattcaacatgtagatgtattttattttattttttacttttgtgggatacatgtgcagaacgtgctggtttgttatacaggtataaagtgccatggtggtgtactgcacctatcaacccgtcatctaggttttaagccccgcatacattaggtatttgtcttaatgctatccctccccttgtcccccaccccctaacaggccccagtgtatgaggttcccctccctgtgtccatgtgttctcattgttcaactcccacttatgagtgataacatgcggtgtttggttttctgttcctgtgttaatttgctgagaatgatggtttccagcttcatccatgtccctgcaaaggacatgaactcatccttttttatggctgcatagtattccatgatgtatatgtgccacattttatttatccagtctatcattgatgggcatttgggttggttccaagtctttgctattgtgaatagtgctgcagtaaacatacgtgtgcatgtgtctttataacagaatgatttataatcctttgggtatatacccaggaatgggattgctgggtcaaatggcaaattcctattgaaaattctgtatacaattctcacttaggagtgtggatttagtcatcctctctaaaactttcatcatcttaagaaaggctttaaagaactgttgaaaattctactacagaactaggttgactcatctgaatacaaggattctttaatttttaatgaagattctggtgccccaaaaggacaaatccaggcacacagaatgtacccatctcccttacattacttcatgtaagtgaataaggatagatttgatttaccgaaaacatttttaaaaataaggctgcagattccaaagtccaatctcaaatctctcacaatcactggaaaagaagagtgagtagatatttctcttatctccatgactcaggggcgctctggtgctgtttttctaactctcctctgattcttcctactacattttgcaaatgaccctatcagtgttctcttaaccttattttcctagtgtaagtgttcatgccctgaacacctgtaggagaaggcttgttttgttacttcttaagggagaaaaaagaaaatcccaaactttccccgattccagaagaaaataaacatgtcctcacacggcatttttttttcttttttgccttttgtttgtttaagtcacaaaccctttccccacaagaacctgttttcctaggcacttgacatttgctgtgccttgggagtatgatttacatttccttcagaaagtttggtgttgacacagctttctttcttcttatagtgatctcccaccttaaagaaggtgtactgtctcatttaaggacaagagatttagagtagtagtaatttcatttaatttcaaggattaaaataattcctttagaatcagcaagaattccataaagtgaccagcatcctattagcaaaactcaaatctgagaacaatagccacaaatcaattaaagcaaacattttaaaattatattttgaaagtatattaagaactttaaacagaataaaaggtagaatatgtgctgagtttttgaaactttaattaatcctggacagcatttggggctaacctagttcaggatagcattaaaagttataagaggtgtaggcctacagcctttggggtttctttgtgtcacttccagttgcttactttattactttaccatctgcctttctgatttctccaccaggcatcattacagtatcacagtctgccttgaatggtggtttacatctggaggcaatgcaatccccctaggcactttttggaaatgtttggtcaagtttttgtttgttgcaatgactggggaaagctatgggcatttagtgagaggaggccaggggtaataagcatccaacagggtgtgagacaattgtgcacaatcatgtgccccaaatgtcagtagcacccccgttaagaaatactggaccctttgaattggcaccccagttttgggttgactaaggtggcttttgcctttgagacatgttatttatctgggattcctacaacatgcttcaagtctaagtcagtgatcaggctgtgatctcccttgttggcttcagcctgagagagaggaggagtatttggcaaagagaaattcatgaaacttgcttgtcttggtgaactccattcccttctgttgggaagctgacatggagaacatggaattagttacatcttgtaatattttcaaaaccaaatcttataacctgttatcaggaagagataataggaggctttgcaaatgtcatgggaaaggtcacatctccaggtctgatcagcaggcacttactaatttttgttgtcccccacttattccaacactggtaggttagtttgaaaatatgatgacaaattctatatttcagtttggttacaatatgctacagtcttattttttgatatatctcacattcctcgtataattatttacaattatatctgacccacgaaaacgtaaagatctgttagtttttaatctctgtaaccctactattagaaacatgccttgcataataggtgctcaacaaattcttgttaaatgaataaatgaatgatttatttccttaattaattatttcacagtacaagtcaaaagatagtaaattattgaaagagcttagaccatattgaatttttatgtgtactctcctaaaagtcaaccaataccaatgcaataagcattctgaacacagttgactattatgtacaaaaatgccaaagtttaaaatttcagctacaccatgtcctaagcttgttagatattctactttgaaagaaggaaatgttatatttgaagtacttataacatgggagatagggtatattatcatactgcttatttgttcaaagaatcttcatcatctgtagcataagcatctgcaaggccatatatttatcttttaattattttatatttattcaaattggaagtgtgaaaaatatacctttcaaaatattcgggacaaagcaaccatgtctcaggctgttccagctctaaacttgtgcaccatttaatttgctaggtgtatggtgactgacataggaaggggctctgaaataagtcacccggtggctgggcactttaatgtctgtgtttcaatacagattcccagttggaaattattcatgttttaagtgtgctctcaattccaatgaaggctggctctgttttgtaggcaggggagagccaactttccttcctttacttttcctgcttatttccttagtcaggcttagggttatccttgtgcatcctcatggtgatttctttctccagtatttgatctctctgtctggtgagatgcttcccctccatttattctcattcactatgactactacatcatctctttgtcccaagtgattcatattaatagtatgattcttgtgcttttttaaaaaatcactttatagtactattcttatttccagcttgcttgttaacagcctttgaaattggttattttcctaggctgtcactgatttggaatttttctagaaacatctgttagtataaattatgctaggctgcgtttttgtctatttaagtgccagaattcactgccacaaaaaagaagttgggattagcggagcttgatatcttttacactttgatcaaaatgtattttgaacctcatagatttaaaactttgtaataaatgaacagtagtggtcctctatttttgatagatgacatacatatgattctgagatactgtcaggcagtcataggtatcaccaacagataatgattattgacaattgaacgtcctagccctaaaaaccagtacttttgcttcataccaacagacctccatcctgccttacaacatcccaaaaccatattgtacattcctaatcagactgaaaatgtgcttttcctctgaccctgtctcttgacatcttcatcattggaataccacccacacacaaacaaagatcaggcctcctcccaagtgtccctgctaaccactctgtcctgaatacataagcttaaatgcccttccaacctatagttttgtaaaatcattttgagctatcactaaattgtaagtttctgaaagccaagaattatcttatatttcttagtagtctacagtgttaaatatatcatggggttttggcactcaataaatatttggtgatttctaagagtctaattgaaccagaaattttatcctgtttgtgagcagtaggtattttatggagtcattaaagaagcaacttatctttggtgattgacttgcagccattagagtgattgacagagactccgagaagctcctggccattacaactagttgctaagaagctagagaaaccagatgtacagcctgaaggaacacaaatgcttcacaactatagtttagtgggggactcattctcattactttgtgggaagctctacacccctgctgattagcagagaagatctagcaatttcatattttacaaatgtaatcctacctcaaccacacaataattttgcttccagtctctagacaaacaggaattctagtccttgctttgccacagggggcaaatatcaggctttagcatggtgaaaccatctttcaaaaaatagtaagtcaatggaaaaaactgaattatccttgtcttctaatttgatacagaaaatgttgtcttgtagctcacttatatttttctgttagagaagatctgtttccacaatgactgaatataatttatttcttcttttttggattttttttctatactttaagttctggtatacatgtgcagaacgtgcagctttgttacataggtataaatgtgccatgtagtttgctgcacccatccacccattatctacattaggtatttctcctaatgctatccctcccctagccacccacccaccgacaggacccagtgtgtgatgtccccctccctgtgtccatgtgttctcattgttcaactcccacttatgagtgagaacatgaagtgtttggtttcctgttcctgtgttagtttgctgagaatgatggtttccagcttcatccatgtccctgcaaaggacattaactcatcctttttacggcttcatactattctatggtgtatatgtgccacattttctttatccagtctatcattgatgggcatttgggtttttatccttgctattgtgaatagtgctgcaatgaacatgcatgtgcatatgtctttatagtagaatgatttataattctttgggtatatacccagtaatgggattgctgggtcacatggcatttctgtttctagatccttgaggagtcaccacactgtcttccacaatggctgaactaatttgcactcccgcaaacagtgtaaaaacattcctatttcttcacatactctccagcatctgttgtttcctgactttttaatgattgccattctcactggcatgagatggtatctcattgtgttttgatttgcatttctctaatgaccagtgatgacaagctttttttcatatgtttgttggccacataaatgtcttcttttgagaagtgtctgtttatattcttctcccactttttgatggggttgtttttttcttgtaaatttgtttaagttccttgtagattctggacatcagccctttgtcagatggacagattgcaaaatttttctcccattctgtaggttgcctgttcactctgatgacagtttcttttgctatgcagaagctctttagtttaattcacacataacaatattaactttaaatataaacgggctaaatgccctcattaaaagacatggactggcaaatcggtaaaaagtcaagacccatcagtgtgctgtattcaggagacccatctcatgtgcaaagacacacctgggctccaaatacatggatggaggaatatttgccaagcaaatggaaagcaaaaaaaaaaaaaaaaaaaaaagcaggggttgcaatcctagtctctgataaaacagactttaaaccaacaaatatcaaaaaagacaaagaagggcattacataatggtaaagggatcaatgcaacaagaagagctaattatcctaaatatatatgcccccactataggagcacccagattcataagtcagttcttagagacttaaaaagaggcttacactcccacacaataatattgggagacttttacaccccactgtcaatattagacagatcaatgagacagaaaattaacaagaatattcaggacttgaactcagctctggaccaagcagacctaataggcatctacagaagtctccaccccaaatcaacagaatatacattcttctcagcaccacatcacgcttattctaaaattgaccacataattggaagtaaaacacttctcagcaaatgcaaaagaatggaaatcataaaaaacagtctctcagaccacagtgcaatcaaattagaactcaagattaagaaactcactcaaaaaatcacacaactacatagaaactgaacaacctgctcctgaatgactgctgtgtaaataacaaaattaaggcagaaataaataatttctttgaaaccaatgagaacaaacacacaatgtaccagaatctctgggacacagctaaagcagtgtttagagggaaattgatagcactaaatgcccactggagaaagcaggaaagatctaaattcaacaccctaccatcacaattaaaagaactagagaagcaagagcaaacaaattcaaaagctagcagaagacaagaaataactaagatcagagcagaactgaaggagatagagacagggaaaacccttcaaaaaatcaatgaatccaggagctgtttttttgaaaagattaacaaaacaaatagacagctacccagactaataaagaagaaaagagaaaataatcaaatagacacattaaaaaagataaaggggatatcaccactgatcccacagaaatacaaactaccatcagagaatactataaacacctctacacaaataaactagaagatctagaagaaatagataaattcctggacacatacaccctcccaagactaaatcagaaagaagtcaaatccctgagtagaccaataacaagttctgaaattgaggcagtaattaatagcctaccaatcaaaaaagtctaggaccagatggattcatagccaaattctaccagaggtacaaagaggagctggtatcattccttctgaaactattccaaacaatttatttcttatcagccaacacagggagctcacagcttgctatatcaaaaagagatatttagattagctgtgcgttcttgggtaagttgcttaacttgtctcattttcaagggcttcatctaaaacatagaattctggaaaatgtcaaggagaataataacagtaataataacgcaagtgaaaaggggaagaaaggccaggcatggtggatcactcctgtaatcccagcactttgggaggccaaggcaggtggatcacttgaggtcaggcattcgagaccagcctggctaacatggtgaaaccccgtctctactaaaaatacaaaaattagccaggtatggtggcggacacctgtaatcctcgttactcaggaggctgaggcagaagaatcgcttgaacctgggaggtggagatttcagtgagctgagatcgccaccactgtactccagcctgggcgacaaaagtgaaactccatctcaaaaaaaaaggagaaggaaataagatttttcttctacttttattgaggtccagttgctcctctttttagatcttatatgacagcaacaatgaaaaatattgctatcttcttgattgatgatgataggtaataatggcaaaaaacctaaagtgaattaggaaatgtgaggtaacataggattgtttggtgggagaaaggaaaaccatgatgtacatagttgatgaagaatcatcagtggagtttttttttttttccaccaggaaatcaagaattcatattggattcaaagcccttgagctcctaataggctgtttagtcatgtccatgtgtacattttccttgtagatgagggcctcagtacccttattttaaacattctcccaaggtgggataatttctttgcatgaaattagttatcatttatttactttttaccccaaatttgtatctgccactgaaacttctattctgaactcttaacctatatatccaactgccttctcagcattttcactttgatgccttacaaaagtattaaaccaatgtatccataactaagtttataattttttattgaaaaatcccctcctccgtcattcttaatatcacgaattggccccatcatttgacatttggtcatgtcagataccatgactcacttttctgccttatcagctttcatgcatcagtcaatattgactcctaaatctttctctttttttttttttttttttgagatgaagtattggtctgttgcccaggctggggtacagtggtgcaatctcgactcactataatgtccacctcccggttcaagcaattctcctgcctcagcctcccaagtaggtgggattacaggtgcctgacaccatgtgtggctagtttttgtatttttagtggagacggggtttcaccatattggctaggctggtcttgaatgcctgacctcaggtaatcagctcgcctcggcctccggaagtgctgggattacagatatgagccacagtgctcggcctaaatctttcttatgtatgtctttcaatctccatttccttctatcagtctaattcaaggaatcatctctcacatgaattgctaactagtctctccatattcaattcttattccatgccaatccatcttccacatagaagctagagtgagatttctaagagataaatcttaccacaatttgtccccacttaaagttgttgacagcatttcattttaaagagatagttcataacctttaatgatagcccacaaaatgctgggtgattaccccctgccagccttatctcaggccaatccctctctctctccttgtactgcagcctcactgctcttctttcagttccttgaatattatcaagctccttcccataatagaatctttgcacatgcttcttgccttatttggaatattctgcctctctttctcccaaggattttctacttttattctattgtcagcttaattcacatttcttcaaaggaagccttccttgactatttataagatagtcaggattctcataaaggtacttcctcataggatcctatgattttattaataccctcatgtgtgttatgccccaacaatcttttctgcaaactaagacacctgccagtggtggtgaagttgttgagaccaataattttcatccacatccttgttcctaagaaaaatgacaaaagatgtgagggtttagtttcccctagggtttttaatctctgtgtttttccttgtgctttgacactttctttgagctttatatgcaagatcagtaaggtgaagggtgatgtcgttcagatttgaccatcatgataaatgattccgctccatatcttgtggactgtcattagaccattagtcatctttcagtttccagttgatctgctaattttattcagataaggagcagttggcttatcaatagattgttaagattcaagttattattttcaggaaagatggttaaagagcctaaaggcagggtattattgctcaatgaacctcaacacggtttttgaaaattttaaggaaaagagcagggatgctgtagctttgctgaaaatgacaaaattcctgagtgatgatcaggagtaactctctccctaatctttcaggaaatctttgttctctcatgtagaattggcatacctgacacaggattgtatggctttccatgcttacttacttacatgcttactgctctagttatcctttcaaggctttggtaaatatattagttattagtgctaatgtaatgaattacaactcagtggtttaaaacaacacaaacttattatctacatttcctgaagtcagaagtcaaaaatgagtcttacaggtataaaatcaaggtgccagcagggctgtgttccttttggaggttctgggagagaatctgttttcttgtcttttccagcttctagaggctgcctgcatttctttgcttgtggctttttcctccaccttgacagtgcattgctccaacctctgcttctgtcatcacatcttcttttctaactctgactctctcctacctccctcttataaaggcccttgtgattacattgggcttacctggataacccaagctaatgataatcttcccatgttaagctccttagcttaatcacgtatatgaaatcccttttgccatgtaagggaatagtcaaaggttctggcaattgatacataggtatctttgaaagggctattattctgtctaccatgtgaaatagatgtaacaattccatatttctaaaaatgctaatcaggtaggatttgagtccagaaacaaaaatttgtagcatgtctttttctctttggtgcctcacttaaggtcttgatttttcccacataaaaagccatgtatgtatcgcagttgcttatagttagtgtctttaattaagtttccatcattgctcaaatgtgaagcataatttgttaacttaaattacaatctctgatctaatagaaattaccttgtgaaactgtaaagagagtaagactgtttaaaaatgtgagactatggttttccttgcttacatgtgaaattcgggcacattatagctgactaaaaagcaacaaagattagaggtaactaagcacatccaactcaactttcaagatacaacctaaatgttatctcttttgtgaaattattgatgacttccttaataaaactgggcaatacttacactttgctacgagggcattgtgtgtacaactctattatagcattccacagtgttgtattgatctagctacatgactatctcccaaactacccttaagatcctcaagggcaaggactctgtttcatttttcttagtactgatgctgcctattacactgtcagacacatggctggtgttttaatgatgttttataagggaatgaatccctttgcaagcctgttttatattcctctactaattaattggctagttagttttcaagattgactgaggagcacaataataagactgcttgaaagagtaaagatgaaacaataggaatctacttccattcctgagaaagcaaatctgaacacatgcccttactaatgatgagtcagtagcattatttcccagcataaagtgcactccaatacctgatcagtacagattcatagccatgtattcacgagtactggtaaagaaaagtaaatgtaccttcagaggaattagataggatataaacttgttagtgaacatttaaaatactgcattaactgagttaattagattaacttaaatcttaatcaggccaggcatggtggctcacgcttgaaatcccagcactgctggaggcagaggtaggcggatcacctgaggtcaggagtttgagagcagcctggccaacatggtgaaaccccgtctctactaaaaatacaaagattagccgcacatgctcgcttgaacccacaaggcggaagttgcagtgagccaggatcgtggtactgcactccaggctgggcgatagaggagactctgtctcattaaataaataaataaataaataaataaacaatgaaatgatgtagttatatactagattcagagcatatgaatctaattcagttctctatcccaccagtaatgtttatacccaattatatttcttttcagcttgcttttttgcagattaaaaaatcatatgcttttaatgtctacttaagagtcttcttcatccctttggttatttagcaacaatcttatggtttcctcaagcttcactatagctttcctcaaggttcaagcacacaaacaaaaagcctatgttacaaatagtggtccccaaacttccagaatctgggtaataggttgtgaaggttgttaagccactatagttttaatggctttccaaaccacactgtcatatgctttctggaagtcctgagaacaccacagccagtgatttccgatactgactcagcatcagaatcacttgtggttctttagaaaaataagattctagggagctatctgagatccttatgcaggaagcctggaaaagggtctgagtagctttcagaagttccactgtaaattctcatacgcaccagtggtgttggaaatctatggcctgtctttaagtttggagtgattatgcccataaattgagtagttgaaggcagagaaaagtgtgaagaggcatatctgaaacagaacatgtcccagccattatcctccgaaggctgtttcctatttgttagctgcaatcatgatacatacaatgccagtgcattttgtaaaaggatggttaaatgaaataataaatataatgaacctagaacagttcttttacataatagattctgaataaatgttagttcacttcgtttttgtttgtttggtttttgttgtaaattcaggtccaaaaactgtaataatctcttctgtcatgggcatgtcttcccctgaaagaagaggatgatattaatagtctgaacttgatcacatttatattctgtcacactacaaataggaagggtcaaaagagttcatgttactaagtgggaaggtatgtgtatatgtaaatatataaatgtgtgtattatgtacacagtgatgaatatatgtaaataggcaggaagacacacatatgcccatctatctgtatggcatttcacttcttcattgtcaacagctattgcgagttacttggagagtgattcagaagtgatcaataggaataatattaaaataggcatttttctcttaagaaaaaagcattcttatgtcattctctcataatcctattaatcggggaggaaaggaaccataacaggccttttcaaaaaaccagttggaatatcttagtcttttcttcctctaggtcacttgttaagcttgaagaataacaggatcttgctggaaagaaaatgagaggaagagtgtttttcaatttaacctctgacatctctaattgttctcatcctggttcacaggctcctctttttccacttactgctaaaacatcgctcttcccggggctggatacactttatctattctctttgggtgatgtaattcactcatattatgcataaaatgatgctaatgacacacaaatctatatgtccaccttgatggcatatatgtactccatactttgcatgtacaacattgaacttaatatattttcatcaaaacctgctctatttagtgtatttctcagcttcatgggttatccttttatgttttcaaaaacccatgcaataaaccaggaagccagtggaattgagtccttccatctttgtgctgacacatgtacatctccactggcatttttccaaaaacatattttctgccaaacggaagggaatattccaaaatactcttaagtattctagtttaggaaaaccctgaaatacctaatttaaattcacaaattgcataagttagttgttggttatttaggtttattaccaaccactgcctattcgtcctctaccaacccaggcgtggtactgggctctgaagttcaggagttgagaagagacagcccctttcctcagagagtatagtctagaagagacaaatggagaaaatcgttatacaaaatgatttattgtagggtttctcttagtggcaattttgtcaggagcctttaatatatcttttgatttatatagcatcttctctacatgcttaggttgtccatcagatgcataaaatatgtaatatttgtagattccatagctgagttagttcaaattgaagaggaagaagctttttgttcactttgattatatataaggttcaacctttcagagattgacagagccacactaatttaaaaaatggcatgaaacagaactatcttaactcatccttgtcatcttgcccgtgacatgtgaaggcagtaaaaggctcagccattgaatccagctatccattaggtaccgcctgttgcatctgatattctaaaattcaagcaagcctcttactaaataggaaggtccatggcaccacagatcactcagtagctaccacgtaatgactatttccagcctataaagcccagaaaagaaataagaacagtatcagtgacttgtatgttcaattccgtatgatgtgcattgtggacagattagaaataagccagatgcagagaaatagtgatattacagcagctgtaacaaataggcaagtaggaacctaaatgtacattttactctgtcctgttcttaattgataacatttgttagagatatgtaaaatttttcatatcacatcctttagggggtattaacaatatgctagcttgacatagtttagtcactcttgtcaaagcctggtctccagctgtagaatttgaaaactcatagtatagtcagatatgactttatccagttattcaataattatttgcttgtactatatgcccagcaccttgctgataaattttgctagtaaattttactttgttatcaagttttcctagtaaatgacctttgtagtcatttgttttgtctgagatattggcaacgtcgctgagctacagatctcttctgtgaatgaatcctacgagtctatgtcgggggtctgtgtctgcccgactcatcattgtgctgagactgagaagttcctgcctcgtcagatgtttacaacatctacacactcctatttcctttcaaaagtcaactgcctcctagcctaggagatttttacagaggtgggaaaagttgtcatttctcatcccatattcccccaaatctacagggagttatttctgtttctctggttacgaaatagacttttaaaactcaaaagccaaaaattgaatcccagtttgtttgttttggaactatctcttacttgaagcaatgaatgcagaatgaccttgctgactgaatagatcaaagggcatgtgtttaagaaaatgcatatgtttaaaaaggcttatttacttatttactactgcaaatttcttggcaagcctcgaatttgaacaagaggagacttgatagccttattggatactctgtctaggtcaggaagagacctaataaaataaaccttcaatggccatgatagttacatgcttccataacaataataataataatataatatattaataaatataataataaaatattaataaatataattattaatatataataatatattattaataagaattattattattttgagacggaacctcgctttgttgcccaggctggagtgcagtggcgcgatctcagctcactgcaagctccgccgcccgggttcacgccattctcctgcctcggcctcccgagtagctgggactgcaggcgccggctaccacgcctggctaattttttgtatttttagtagagatggggtttcaccgtgttggccaggatggtctccatctcctgacttcgtgatccacccgccttggcctcccaaagtggtgggattacaggcgtgagccaccacgtccggccccataattattatgaaacaaggtcctgacaattttgtgtttactctggtacccttgatgtgtttacattctcaggatttgtcagcataagagtctccttgatgcccatgttagtcctagagacacctatgtttctttctactaagtggccgtattattattactctgtgcttggcagtgttttctaattccctgcattttgaatcctctgtaagtttttactttgttcaaatctcttctttgttctaataatgctgctgatgtttagccttaaaaaacaaaggctaactagagacagaaaagctagctttagaagcatggtgagtatttgggtcctcataccttccaaaacttgaaccttgagactcaaagattacttacctggaaattccaaagtgggaaccgaaaacaactgtctctgttcaccatggctcattctctgcaacaagctaaaggagtccatactcccactctgagtgaggccaatggctagcagagaggtaacttcagacacttccagcacgtgttcaaataggagttcatgaattctctgaaacctcagaagataaaactaaaacctgtggaaggttgattttgtttctgtatgtgtctctcactctactgtgactcccttgagggccggaaatgactgttatttatctttgaatccctagctcccagttagaaacaaggtgtctgacaataaaatatactcaatgtttatttagctaaactgagctgaaccagtttatatacttaaagacattatttattattcataaaatctttactgcttacctactatgtaatgaatgtgtgcaagggatacaagaaaaatacaactatggcccctgcctttaaaaatgttacagtctaaaaagacagatataacacagagaaaagaatattaacttttgagtcaagacttgaactcttctcgtgccacttatcagctatcactttagacatttcacagcctctctggattcttcactttttaagtttcttcacttttttcaaaaaaatggtataactaccgcataggattataataaagattaaatgagacaatatgagataagttgtgtcttcagttattataatcttccctcccttctatttcttcataactatcctgtaaatagagcaagaaatggatttcattcaccccaatgagaacagtgtagttcagtgaagttagcagtgattccaggctcaaatagccaggctcaaatagccagtaagtagcaagacaagactctacctagcatctgcagattgagagggatttccattctacatctcacacctcctcgcactctgattcttttctgcaagtcattgccttccctcagtgtaacattgcttgtaccaatgataacttccaagtgaaatcttactacaagctttttgcaaggaagactgagaatctggctctggctttggctttggtctcctcacatgggtttgtgggttgtggtttttgtggttgttgttgttgttgtttttaatggtttggaagggacagacacatacttgatcaggctccagcagcaaatcaccttggctttgatgctgctcctgttgtcagaagactacactagtgggagctcccacagaaggagcacagaatagatgtgtttcacatgtaattgattgaaatttgagattaccctggcttctatcatttacaacctctataggaaactggtttttagaagaaatggtatcttgcttaatcattccctcaaccttttgatcctcttccctgttgataatcactgcttagcatatttcttgctgctgagaaagtgggcaggcagctgctgcagcctgtagcagattctaaggttgctccttagggggttggcaaaggataccttgtgaggctgaagattttaaaaatgtgtttgtttcttttaccctggagattctgagcaatcagtcttgggtttttcttctctaaactgtttatgcttatgaaggaaataatttaatcaacttgtgaaagtggatttttttccaaacattttcagctttgatggctaattcacatataagagcattgaagattgttttcggggctttgttctatgcagcctgtctatgctatttgttgtgttaggatacttttgttaagcagtgtgggctaacttaaaattaatttaaaatcaataactgttacctttgaaaaatctgcagttaattatgtggtttttggctacatttagaatttggtgtgattgaagcttgtcattttctctcataaatttagtgtccaaactctctgacccaaagcatagggccattctgagtcactgatggacatagtccaagataaatatagcagaaatgcattcctgggctctacatgtgtaaatgtgaggtataatgaaataatttctactggcttatcaatatatcttttagggtcattcctcactctcaatgcataacctacaacagtgttggaaatatgtttcatttcagtagttataggccttatataaatctctactggggaggattctgaggccatatccagccttagtaagacaaatgttttgattgattagcagtgtgttccacggatacagcaagagtcaggagtggtcctaccctggccatcatctctgtttgggctggacaattttatgttatatgatgttgcttcgtaatagagagtaaccttttatatatttgttatgaatagaatcctaagcagggtacctctggccactgtcaagccctttttaaagatctttagtcagatttttctttgtatatgcctaatgtagtgtattactctgtcttggtatattactcctgtgtaccaagaattataaataattcactccccaacacctatgaattttcatatctccatgcctttgcttaagccatctcttctacctaaaaatactgtcctttcttttctcatttagagaaaattttctcactattcatgggctgcccgaaatattgtctcttcctccgtaaagctttcccgaccttcccgggtagtataaatggctccctttttcatctatccataacaattagttgaatctctattgttacactgccatgttgctctgtaattacttgtttacatcccagaatctagccctgaatattatacatatgtttgtagacttgaagtggatcgaacattgttcagaaaaacccatagttccttatttaaagttactggatttctgaagcttataaagaatacagtgggtgcaaatatggtggcaatggaggctgagagggtagagggaaggagatagtaaagaaaagagaaatatatatttgatgtagaatccaacaaagaaaacagtaaaactatgtgtggccaaagaagaacattaacaggaagaatgaggaaattgatccaggctaatccatagaagtgtatgtataggttctgcatgtcctcagactgaggacagagtttactttttcctagatggacatatatggtagatctaaggcttctttgcaagtatctgagaacattaataaattcttgcctggtcagaagggaaataggtggggactaaatcaactgagaagcacacatcccttctaaaggtttccaaattctctttttaacgtactgtgtacataaaaccaaacatgtagtcagagaattgagctgcaacccatgtccaccagtctttaataaggttgtgtagaagtatgtaacctgtccaatatattcctctccactgtcttgaataaagtatctcttcccaggtagtagcctatttcattaaaattacctgaaacttcacagtttataaagaaatcccatgtattttatttcactgaatccttaccagcagtatttttttaaaaactcaaaccatacagacatggagctgtatccattttaaatatgaagtaactcagagaggttaagcaactggtccgaggctgcagaaaacaacccagctgggctttattcctagatcctcagtgcactgcaaatcccatgctcttttatttgaacttccagagtttttgctttatttcttttaccacagtcatcatttcttttattttattaactgtatttatctttccattttatctcttcatcagagtctaagctccttccttgcctttttcttccatggaagcccatttggtgctaggatgttgccttgttctttgcaaagaaatagtgccagatttctttatgtgtattttaagcaagtatggtgtttgttcaatatgtgtgttggtgtaatgagagagtaaaggaagggatggattaaataataagaaataaaattaatttcacaatgttatcaatatagatggtttccattttctacaacaaattaatatatgtcacaggataaggaaaagcgcatctgagacactcacttaactgagaaaacattatgaaggaaaagaagataatacagaggtttatccaggaaaattgtcaaacttcctcaaatagggaatttaagatggaaaggacagccatagtaaagatctaaatggcaagagctggcactgggtcagaagctattagaagaatgaaactggacaatccattagactgcaggcttttaaaactggaattgtgaacttttgcagccgcataaacagctgggcctggacaattaaaggtcagctttaaattgtgataaaaggatctacattaaatacgtacagctatttcattggtcaggtgaatcctgagttcacatgaactggctaataaattccttagggaagacaaggatagcaagcagagttggtgggagagaagcaggacggaactaatatctctttttaagattatactttaagttctgggatagatgtgcagatcgtgcagatttgtacctaggtatacatgtgccatggtggtttgctgcacctgtcaacccgtcacgtacattaggtatttctcctaatgctattcctcccctagtcccccaccccccccccccgacaggacctggtgtgtgatgtccccctccctgtgtccatgtgttctcatttttcagctcctatttatgagtgagaacatgcgacgtttggttttctgttcctgtgttagtttgctgaaaatgatggtttccagcttcatccaggtccctgcaaaggacatgaattcttcttttttatgactgcatgctattctatggtgtctatgtgccacattttctttatccagtctatcattgatggtcatttgggttggtttcaagtctttgctattgtgaatagtgctgcaataaacatacgtgtgcatgtgtctttattgtagaatgatttataatcctttgggtatatacccagtaatgggattgctgggtcaaatggtatttctggttctagatccttgaggaatcgccacactgtcttccacaacggttgaactaatttacactcccaccaacagtgtaaaagcattcctatttctccacatcctctccagcatctgttgtttcctgactttataatgatcaccattctaactggcatgaggtggtatctcattgtggttttggtttgcatttctctaatgaccagtgataatgagcttttctttttattttttattttttatttattattattatactttaagttttagggtacatgtgcacaatgtgcaggttagttacatgtgtatacatgtgccatgctggtgcgctgcacgcactaactcgtcatctagcattaggtatatctcccagtgctatccctcccccctccccccaccccacaacagtccccagagtgtgatgttccctttcctgtgtccatgtgttctcattgttcaattcccacctgtgagtgagaatatgcggtgtttggttttttgttcttgcgatagtttactgagaatgatgatttccaatttcatccatgtccctacaaaggacatgaactcgatgatgagcttttcttcatatgtttgttgttctcataaatgtcttcttttgagaagtgtctgttcatattctttgcccactttttgatggagttgtttattttttcttgtaaatttgtttttgttccttatagattctggatattagccctttgtcagatggattgattgcagaattttctcccattctgtaggttgcctgttccctctgataggtttttttttttgtttttttttttttttttttttgctgtgtagaagctctttagtttaattagatcctatttgtcaattttggcttttattgccattgcttttggtgttttagcctaaagccataaaaaccctagaagaaaacttaggcaataccatttggaactaatatcccttaagcctcctctaggtgacagttactatgccagtagtatgaatataaagtattcaaatgataggaaatcaagattcagaaagggtcggtaatgtcagaagttacgtagctggaggcagaggttggatctgaatctagccataccagtctagcaactataaacctactgctgtttctacaaacttctctcaggcccgtgaacaaaccaagatttttcttcacatgcttatccccctttctttttcctcatatgatctcctttaggaagccagttcttttatctctcagcttatattcccaccactggaaattgttccctgaccctcaagcaacagaagcgtatgtccttttttgttcctatagcagcctgtgctgttaccaagtaccattttagtggtatttctcatactgtattgtggttgtttacttctttgccttcctcttactaattgtgagctccttaaaagtccctagcatacggtgtagtgtatgaacacatagtagatgttcagtaaatatttactggataaaaaaataagtgcatgttctttctaactcaaagcttattttttttttcattcttagtatttatttatcacccctccccccttcctttcatggctattgcagttcccccttggctttgggaattctcttgtcttcagtgttttcatttttcttgcttgacttatatcttttgttaaatcttctggattagatactaatgcataatattccaaaacattagctacttgccaagtgccagtaaactgacaatgaaaagaaggcagagtttggtctacctatgtgtgttattactaacacaggtgtcctttattattattttacagacactattatgtgattcatcagatgaatttctttaccagtcaacttggaagtacagtatatgcatgacagggctttttgacaggaggtggaaaggaatttaattaatggtgtaaatgaaagtcaccattaatatagctttttattttcaacaatagaaaatcccagtccatacacataaaatacattctacctacaaatgaagccctagcttcattgtcagaaaattactttctaaagataagtcagtcagaaagtacttaatgaacattctctgctattgtacttgtccccactgggattagtgttgaggtggtgacagaaacaaagaaacatagattgtgggtcatacctgaggagtttacagtattcttttaggaatataattagcaaatgtgaaacaattatgaggttgaggaggcgtatcatttagcactagcttatgagccaatacaataaatatttttttaagtcgaagaggttgaaatttatttatttgttcattcaacaaatgtttgttgatttctggttatacgtaaaacattgtgctagatcctggggatgccaagattaatataatcagtttctgctgctgaagggctaccagcctgttaagattacaatgcatggctgttgtaacaataatgtgagggacagtgtacaaggaagcatacagaaggctttgttcaagaagtcagagaggctgcgtagaggaggtgacttttaacttaagtcttgaattttgaagggcagtttgcactttctaagaggaaagtgaaacagttgattttttttaaacttgcctctacttctctttgagtgtgctgattcatgactgttattatcagcagtggatgttaaattatatggtgctgaggaaaatgaagagatcagaggtattttgctacaagtgtcacagtttatagaagaactttgtagaatggaaagataaaaggaaaaagaggaaaatagtggctttatattacttctgcatattctgctatgtttactacttgttatttccacaaattcattattatctagcattctttcctttgatcttctaacattacttgtattttagtatgttggttataacatattttgactttttcaatataagtttagatatatataaaatatatacaacccaataggaggatatatatatatgtatatatgtatgtatatatacatatatatgtatatgtatacatatatatgtatatatacatatatatgtatgcatatatatgtgtatatatacatatatgtttataaaatctacatatatacctatatatgtagatatacatatataggtatatatgtttatgaaatgtacatatatacatatataaaacatgtatatatatgtatatatacacatatcctcctattggtttgtatttctttaagagcaacaaattacattttatactttttcaggggaagaagtagaagtgaagaaacatttatttattacctactaggttgcaagaattatgctaggtgcttcgtatctggcactttagtccctgcaggagtcctatgaagtaggttgtattaactcatttcgtagacgtgtaaactaaggtataaaaagatgaagcgtataaaaagttataaaaagattaagcatcttgaccaaagttatatagctaaacaataagtgcctgaaatgtgatttagaccttggttatctgcttcctctcctctttctactatttcccatgatgttagttttaaaatgtgtatatttttattaaaaagagaactaattgtttctttttgtttgagtacttgtcaaacaaacaagtacaaactatttcccatgatgttagttttaaagtgtgtatatttttattaaaaagacaactaattgtttctttttgtttgagtacttgtctcatgtaattcttgagacttgtttgagtacttgtctcaagtaattgagtacttgtctaattcacaaaaacatgtctcatgtgttaattaattcacaaaaatatcctgccatgtgccaggagtttgggattctaaagaggaaagacagtagagattaccagtaagtagaaataagatatgagacaattgggaagtttcttaattcatctctatcagtaagaagagagctctggtaaggtcctcaatgctttattttaaccaaatctttgacaaatgcacaatttcagagccattgtttgaaagaaaatctcactctaccatcttcccagatttccactctttcaagcaacaggtactcctatcagaagttgcactttgtgtaacttaatttttttttttaaaatcagacttgcacttttctacttgttaatagtaggaatgacttttctgggcaactataaacctactgctgtttctaaacttggcccttaaggatatgcaaataaaaaaaaagaaaacatttttaggttagctgggcatggtggctcacgcctgtaatcccagcactttaggaggctgaggcaggcagatcacttgagctcaagagttcatgaccagcctgggcagcatggagaaaccttatctctacaaaaaatacaaaaattagccagctgtgatggcatgtacctgtggtcccagctattcaagaggctaaaaaaggtggatagcttgagtctggaaagtccaggctacagtgagcattgactgaatcactgcactccagcctgcatgacacacagtgagaccttgtctcaaagaaaaaaaaaaaaagttagtggctacaaatattgggtgaataacagcatattttattggtaacaactttagaattgaaataacaagatgtcaagctacagatccaaacaacaggccaaagatcttggttcctcctttaagacaagatgtgaaagtacagaatccaacttagactgtaatttatcaatgttgagatgagtataattctggattagatggggagacatagcaaagtgggaataatttttaaaatagggactaaataaagtatgaagaatatgttaaatgcataccaatttagtgttaaaagtacacttactaaaaatatttaaaacatttgcttatgtttcacagaaaacttatttaaatccattgtatattacatacttaaaaatgaaataagaattccttctcttttccatagactgattcctcctgtgcctttgaaacatactagtttccagctcattaaaaaaaaatcaatactacttcttcatatattcaaattactcactgaggactcactgtgctagctattttgcataatcatgtgttgccttgatcttaccttctcatctcttctggaaccttgtttaatcagttaactcctttattgtttctttaacctcttcaatcctgataggacctgcccatttaaaaaagaaacaaacagattttcttttcgactttgcttctccttctagatacttcctacttttcttactctgctttctcccctctatatttgcttcacttcattgtaacctgtctgtatctctaactgtttttgcccagaaaagttggtatttttatttggcatctttgaagccattggtaattttaccaatggcttcaaagatgccaaacttcttcttactttgaccttcttgcagcctttgaatttgttgacactcctctcctatagaaatgatctcttcccttggcttgtgacaaaacatacttttggttcttttacttcctcaataacttcttcatattacttgtttatattactttttcagcctcctcagatttattttctttactcttttcttatttaacaagaaccgcagcaaggctagtatagagaagaggcagaaagaggctgagagaaggcagacactaggagaggcagagccttgaaagttatgttagggactttcgtctcagtctttagaggagcaggaaacctttgaagggtttgaagcaggagtgggatatgatctgattttcaatttagaatacagactgacaagcatggaagtgaggtgactagccatgagaaaattaaaatgagtttagataaagaaggataatagcttagactagtataaatagtgataaagatggaaataagtgaatatattcaaggtatatttaggacaggtaatggattatatgtgaagggtaacacagtggtagtttatagcttgaacacctggtaaatggcagagtcatcttcagagagaggagaaagtttagggtacaacacaaggaaggaagccagtgaagctggtggctgaagggaacctgcatgatatctccttctcttccatgctaatgggacccaactgtccttatttcccaatagctttcccaatggagaagtgccatgactttttgcagccctcagtctccttatcattgatgaacgtactttcacaggatgaaatatgtgacatccctttaaatattgaaaagactgttttttcgaagaaggattagaatgactttgtgtggccctagagaggacaatgaggacctatgggaaggcagattttagttaagcataaatgactttgtaatgagtaatgaaaaggaatgcatcaggagatgttagtaaggcccttgcaattggaattttttatgcaaccctctgtgaccatttcaggggaattattttagagaggatttacacatcagatggaagaggatctgggaagggggtgacctgatagatgatcgctagcctctgttccaactctgagattctgtggttctatgaaatttccacgtttcttttcttcccattatgacaaataaaggaagttctgaataactatgacctgaagaatctctcctggatgctgactgctaattcattcagaattttgtcatttctttgagtgcatgcatgaaaggaaaatttattcagaacagtcactcagcagtaagacaccaagaatgtattaatgaagctacagtaattgaggattttacccaagtgtaactcctagccctaactcatgcataattcttctgcagtatgaactctgcctttcttagctagcaaggagtgaccaccttggaagagctgcatgttttaataatgagagaagatgtttcttgtttttatgacccaaacaagggaattgtttgcttctagaaatatgggagagttttgagtgccagagagataaggggaaaataatgttctcttcagatattttactctctagctacattgtctcatgcctgtctgctgtttaagtaagaaacaaggcatttcattttttagctgttgttcacattaaaatagcaattctgtcaataaatatagtaaggagctgcattcattattcccggttatcactttgataccaaaaccttgctcatgaagcaaaatgggagtcacatttatgagcagaaacaggtactagcttgtataatacttgatgttaaatccaagtgtgagattcaaattccataaccaaattatctgtttatgccagtagcagttaacatggggcagaaacatgattggccagttgaagctcaggcctcatgaataagcctctctagtagttttaaagccttaatcctctgagcccgtcatctgacacaaccatggaactacaaggcttcctgtcctccatttgaatctgtcaaccaactattatttcctgagcaccttctagatatgaattgtgctaggtagatacttagagaggtttaaaaataaagtagacagtttagcaactgccctcacagagctaagtcttctcaatgagagaagatttttgcaccaatatataatagaaatatgtgatgagtgtcacagtaagtggcatttcacaataaaagaatcactatggggtacagagagcagtccacaattcatgggtgggtaggatttatagtaggctttaatacacggtttgaacttgcctcgataatgaggaatgaagaaggcattttgggcagggacagacatggaaacaggaatgtataaatcatgcagatgcccataagtgactgaatttcaaaatggctctcactggaattccccgtgagtacaaataatacaacttctgaacaaagatttgggttaactgggaaatagttggcttcatgaaaatagaagacaggggttttcagtggatgtttttgcctttggtaaacttaatgctgaacagtgagtctagctgttaccaaaagtagtatgattggtagtggtggtagcatcatctgctacttcacaggttttgtatgtgttaacttatttaatcatccaggaatgtctagaggcaaatactaataccattccagtcttgcaaatgaggaaactgatgctcagaggggtttaaaaaaaaaagaaaaacttttccatggtcacagatacacttttgttctacttgttaggcaggtttatattgggcaataacaagagattgtaagagggccagtgatttgatgctgaaagttagtctaagaagtttggattttattccattgtttgtggatggttgttgaagacatttctgtccttaatgccttgtgggaactaggctggaacccaattcacctcatcctgtcaacatataagcaatggcttagttaatccccagtattatgagtctgtagcaaactaggtcaatgggatttccccatcctccatggctgttagggacaattgcaggcctccagagctcacataccacatttcaattgttctcttactgattccttaagacatcttaaaatgagaaagatcatctaactcccactcggatcaaattctttattggtattcagtcagcttgctttacttccctgtctgataaaaatcctcagataaccaaatttcagagggcttatattggaatttcccttgagtacaaatgattcaatttctgaacaaagacttgggctaattgtggaatggtttgctgtgagaagaaggaagactaggggttttcaatggtcttgtttgccctcagtaaagttaaggattgttgctaatgtcatgtggcagaggaaagcattatcttgctggactgattttctccaattcctaagacctagcacagtgctcgatgcagggtaggcactaaataaatgtttctttaatacatgagagaacagataaactgaaattggaatggaaattatgatatttatcttattttaagatatatgatttgagagaagtttggtaagtatttggataatgtttgaacaagacaaataagaaattgtccagatgcctctcttacaagtctgactgtcctcaggaagaattgggcagtccaccagttccccagtgagtaatattattgaaaaagaaactttcccttttcacgttatattatctctttagtataaaagaccctgatgttcactgggtcacgtttgcctttcaaaatggcaatagtgtctttctgtagcctccagacaaataatgtagtctatcaaagaagcaaatagggttattcagagtcttttaaaaacacagactcaggaaaccttgctcctccaattttagtgtagttcaaagcaaataaccactctgaacctcaagtttttcatcaataaaactgaagttaatacttccttctttactggattctcatgataattactgaggaaactgtgtgaagcacctggaacatagtaggtgcaaaataaatccaattttgcttttcttcctttttcaattgaatattttatacaattaaaaagtaagtttagctttgctaaatttggtctgtgtggaggttctagcactagttactatggcaacttttttattttatttttttctggaaagacattttctctagtgttgttaattttgaagattaaactgttctccttaaaagctaccagatatctgccaaatcccttttttattccatccttattaacccatttgtcttctagtattttcattttattttactcttgaagttgatttgtcccaataaacatatgtttggtacaatgaaccaggttatatttcatttattttgtagttaccttaagtatatactgtcttatacttcagcattctagtgaagaactttttttctggtatctgagatcatcaaagatcaggactatttattactctctaaatcaaagatggcaaacgcataccacaaattctgacacttcccacacccatgccggtgacattctttcctaatattgcaggttttccttcagaatccttctgaacacaacactacagaggcaagtatcaataggctggtgttagcatgtgagtttacacctatttgcccttcatggattaaaccataagtaaggttcagacttgcatcacgttttcttgatgttgtgcctgaaattatatcatctggtgcactttccttggattgtcttatcatgtcttagatccaaggatctttttgaaaatgtttttactccatggaattattaacacaatgaccctatgtaatcagttgcagctcattagctctgattgctatggaggagattagagcaagggatgatgtataaaaagaagcagctatagctgcagatttcctgcaggtaggctcacccattgatccaaaaggtaaatatagatctggaatttgtattctaaataaataaatgaaagctgagctgtcaaatcggttcattaaaagtatcccaagcttaaatcatttacttaccaccttaatgatttttgacatgttcatttaccatctgaaatattatttaattaatatttttattgtgacccaattttacttcatgtttacttaaatacaaaattgtatataactatcataataaaaatctatatcatttaacatatatagaatataatttaaataaaaatactttgaaaacgatattattaaattatagctagaaaccttgtctgttaatgactctaagaaacatattatctctgtatttaaaaaatatatatgtgtgtgtatagttgagatttactcacaccaaatgagactttctttatgataaaatcagaaagactacaccctccatcaactccccaaaaagttggttttatgagtttacatcttactgctctaaacccatggtcataggtggtacaaagataatagcattgcattgctcatgtaagactgataatcatctttcttcagggcagaaatggaatagaaacatacagctaacagtgggggctgaagccacaaaactcctgggctccaatttgggcaggaattcaattccagtgagttaataggaactgagagaaccatatgtcaagggaccagagccaggctcactgtattacaggtcatatactcatatagtggaatactatatagcaataaaaataaactgccagaaaatatgtgcaacaatatgcatgaaactctcaaatataataacatgtgaaggaagacagacattaaagagtacacacaacatgattctattctgtcaagtacaaaagcagctaaaattaatccatcctgtcacattgctgtataatggctactcttggaaagaagtgactggatggcagcatatggaggtattctgggatgcaagtaatgttctggatgctgattacatgatatgttctgtttttgaatattcattcacttattcctattaatttgagtcatatcaatttctgggggaataaaagtaactgggattttgaaaaagattgcatgaaatttgtagattagtttgaagagcactgttatcttaacagtattaagccttgcagcccataaacatgacctgtctttttagttggtcagaacttttattttttcaatgatattttgtaattttggtatacaagtcttttacttattttgctaaatttattcctaaatattttattctttctatgtaattaaaaataaaattgttttcttaatttcatttttggattattcattgttagtgtataaaaatataactgatttttgtatgttcatcttgcatcctgcaaccttgctgaatctgtttattctattagctttttgtggattctttaagatactctgtataaattatgtcatctgcaaatagagttaagtttacttcatccttttcaatccagatgctttttattttatattcttgactaattgccctggctagatattccagtacattgttggatacaagtggtaagagcaaacacccttgtcttattcctcaccctagtggaaacgcatccattctttcagcattaggtgtgatgttagctgtgagtatcccataaaagtttatttattgctcagatcacagtcctgtatgttttgctaaagtcgaagtgggtggtaaggtccgctacagctagtcatttagcaattcagactcttcctcctctaagtcttcagacttctctctgttcaactgccatttggggaaataataagatgttgcatagcaaatttttaagggctaggtctggaaaagaggtacatgatttcttttctcataccattggtcagaattcagtaacagggcaacatatatcttcaagcagcattagtgtgtggcagatagaatgaccaaccatcctagttgcccaagaccaaggggcattaattagtcagaaataacatggttttttaccatcaaggaatttttaatcagtcaaagtaaggcaaaattgaataaataattagaaatggaatattttgtaaaagaaaatcgttttctggaggcagttagatatcataataaatattttataaataatacccatttcttcactttaattaaatcattctctcaatagcaatatgttactgccaactacatgccaaaacctgtctaggtgtagaagtggggacacacagcagtgaaaaagatagataatgtcataggtcttttgatgttcaagctttctaagatggaaacagcaccaaagtacacaaatacttgcaacagtgtcgttgtaagtgctataaaagaaatgccttagaaaatgtgacatatcgtaactgaagaaaacataggtaagaaagacctgtctgaggaagtgacatttgaactaacatctagagggtaagaaggaaccagttgtgctaagagatgatgagaaataattcaagaatgaagcaaccacaagtgcaaagactatggcagaacaacagcaacaacaacaccttgttagggtctaggaaaaaaaaaggagataatatggctagattatagcatggagaggaatatggcaaaagatgaggttgtatatgtaggaaaggacaagtattatggaggaacttaaatgtaatgggaaggattttagattttggatggtattctatctgttaatgagaagtcattgatgttaggtgaatgagcgacatgcttgacatgctgtttcacgttttattgttgtatatagcaaactactctaaaatataattgcttaaaacaaccaccattttattatctctcagtgttctatgagttgacttgtttcagctatgtagttctttagtctaattttgagtctcttacgctgtttgactgttggttcagaagctggacaatttggcctctctccatctctatgaggttcctctcataacctcatctttccacttgtttctccatgtgaccttgccaggtaggctctccagctaagtaactaggcatcttaaatggtgacttcaggcctccctaaaacacaaaattagaagttgtcaggccttcttaaggcataggcctagagctggcactgtattacctctgttatgtatattgattaatataagtcccagaccagtcctgagtcagtgtggaaaaagggaccgcataagggtatggataccagaagttaggcttaattaagtaccatcattaagactagctaacacagttggacttctggccccaagtgacccatgtcccttccacatgcaaaatatcctttccttctaccccaaagccttaagtctcatccattaaagcagcaggcatagatttaaagtccaagatcttatcagctaaattatgtattggtacagatggatctatagaactatgaaccagggacacaagttatctttctcccacatacccatcgtaaaatggtgagacagggataggtgtacgctaatatacacttccatgtaaaaagctggagttggggagtaaacatagcattctctggcttttattttattttttatttttctgagatggagtctcactctgtcgaacatgctggagtgcagtggtgcaatctcggctcactgcaacctccgcctcttgggttcaagtgattctcctgcctcagcctcccgagtagctgggattacaggcatgcaccaccatgcctggctaatttttgtatttttagtagagatgggtcttcactatgttgtccaggctagtcttgaactcctggcctcaagtgatgcacccacctcagcctcccaaagtgctgggattacaagcgtgagccaccacaccaggccgtcactggcttttaataattctgaaatctaggttggcacatgttaccaactcactgttctgggggcaaggaatgcatgttgattagagaatagttgtgctctccgggaatagttctcttcagttcttttcgctgttctctgggcttctggctccatcctctgactcattttcacttttccataaaaaatgaccaatgtttacagttgagtagcttcctcatcttctttctgtctctagggagttggagacccaaatgtcccttttctttgatggcctctgtccctcccagtctaagcttatataattcttttgaaaactttgtcagcttcctgtatattaagatcttaatgtactttatgagacagaaggcacacccatacatttttgaaataggcccccttctaccttgggattagaatctgaggtctgtggggcaatatcattgagaatcttacaagctatttttcccagtcaaaagagtgtatcaggcatggcctcaaatttttctgagacttaatcaaatatttatccttaggccatgctttattggcagcaccttggaattgtttcttgagctaaagccgtttcttactttgagaatcttctgctggtctggcaaagctatgaagaagaaatggttttcttctccaacctagcaagtcctagattggtcatatttttctagattgtgcttgaaaactggacagttccttcattagctcatagctattggtatttattgtacatcactaaaaaacccataaaactcccaaactccaaaacaaactggacaatttcagtattcttcctggaaatcttcttaactaaatagacaagttcattggctatattttctacttttcatgttaatgcaagagataatgtcatactttacactgtcatgcaaacaaccttttctctagcctctgatagcagtgctcccccacttttcttccagtcatcattaaccatctcctgtaggcccttcttggcttctgcatgctatccggttccaaagccaatgctatatattttatatttttgtttcggtagggctctctttcaaatatcaatttctgttttgattattcattgctatgtggatataatgacttataacaactatttattattctctctcatgtttctgtgagttaagtaggctcagccaagaaattcttctgagggtctctaaattgacagtattcaaatagcagctgggactgcactcatatggaagcctgactgtgatgctgagatggctgagtctctttttctctatatgtagtctcagggcttgccttctcacatataaaaaaatctcacatatatagatatgcatatgatatttatacatggatatttttaaatagtggcataattcttacatggacactcatgactctccaaatcagaagttgacaagctttcttaaggcttaggctcaaaactggcataaagtaacttctgatacattacattagttaaaataagccacagaccagtcaaagttccttgtgggaagggactacatagggttctaataagaagcaacaggattgattgggggcaatatttggaaaccagctaccacacgttataacttcagtttcctaaacattactgtgattgctagggagagaatggattggagggtgacatttttgatgtatcacaggtgagagtagttgtagtttattacagagcagaaacaatggagatagagagcagtaaactattcaagaaataattggagatagatttggaaggacctgttgatgtattggttgtgaaggatgagtaatagggaagactaggagtgattcttagtttacaggcgtatgtaacagaatgaaagatggttccatttacctctacatggggtagaaaagaggtttgaggcattggtaacctatagttctgttttggacttgttaagtttaagagatatgttagacacataagtgaagatttcaagtcaaaaagtagatatatatagaaacctgcaggacagaaaaggaggtcagggatagagatatatatttcatcctcataagaatatgtatgatatttaagaggataagattctagatgagatcaccttgaaaggagttacagataagagaacctaggactgaacctagaaaactccaacttttaaaggtcaggaagaggaaaaaaagacagcaaagaagacgagaagaccttgaggtacaatgataatcaaaagagtaaatatcaggcctggtgcagtagctcacacctgtaatctcagcactttgggaggctgaggcaggtggatcaggagttcgagaccagcctggccaacgtggtgaaaccctatctctactaaaaatacaaaaattagctgggtgtgttggtgtgcatctctagtcccagctactcaagaggctgaggcagggatatcacctgaacccaagaggtgaaggttgcagtgagctgagattggccactgcactccagactgggtgacagagtgagatcctgtgtcaaaaaaaaaaaaaaaagagtgacgatcacagaattcaaatgaaggaagtgtttcaatagggaaggatgggttatctgattaaaattctgccaatagatctataagataaagacaaacagatgtccattagatttcatcaatgatctataagataaggacatagacatgttcactggatgttagtagtgatgatctcatttcatcctgaaaagttgttcagtgatatatattatttccatatattcattatatcattatttgtttattgtctttgtcctctgttagaatctaagtgccaggagagcagagaattttgtttgttttgtgtatcgttgtaccccaacacctaaaattgtacctggcccataatatgtaccattcattcatttattcataatcctaggaagtaactataattattctcattatactgaaaaggacacttgatcagaaatgttagattcacatgggagataaattggataaccaaatttcaaatttagttgtctgaatcacaagtttcctgttctttttactaaaccaacccttgtctcctgagatattctgtcacacagttgtaggttaactgagaatattctagtggttaacccttaggcatatttttaaaaagcaatgtaatagtcattgctgtttgattaactctatgattggaataataaaatttgtatttgcttctgtggaagttctatcttaaaatgcaagtgttcttcaaaacaatgttaatatgcatattcactggatttgcttatcatttgcatatcaatccattcattttgcacttcaagtaacagggaagatgttcacataagtaatacattaaatgatataaccaaaacagtcttttaaacatatgcaatgcaaaacaacaaataatttaacctgttatatgtatcttttaaatgcacaattttatgtcatacacgtaacatgcaagagatttaacttaaaatgagcatacacactgcttaatttacttggttgcttctacttccaaatttaatttatactgtctagagacctagatataagacaactggtatgggaagaagttacctagagtctgaaaggagaaataaaaatagagcaagaaagagaaaaagtgtgaggtagcagacaggtgagaaggatggggataaacaaggaagccatttgagaaaagtgaggaagaggtagagatagaaatgatccagagagaatacaggtacttgaagatgggtagtccctggagggatgaagagaaattgtggaatgtggggaggggaccgtcctctcatctacctgagattaccaatactaatcataacagatatacccattttgtatgtattctgtgctaggcattgtgcctagccactttacacatgtaatctttatgtatcaagatccctgcaaaaaaaagtaatgtgtgtgtgtatatattccctagtatgtacaaagcacattaaatacattttgggcactaccaccatcatcatcatcatattcatttgtataatggggagatacatatatatatatatatatatatatatatatatatatacacacacacacacacacacacacacacacaaacatatatatatatatatacacacacacacacacacacaaacatatatatatatgtacacacagacgtacatatacataaaaatatgtatgggaacataatatatatatcacctttatatatgtatctattacatataatggggatatatgtatataaataggacatataatgggaacatatatatacacacatacaaatattatagagataaataaagaaataagtatatacacacacagtcagctttctgtattctttggttccacatccatggattcaacctgctgtgaatcaaaaatatttggggaaaaaggatggttgtgtccgtattgaacatgtatagactttttttcttgtcatcattccctaaacaatgcagtataacaactatttccatagcattaccatcgtattaggtattataagtaacctagagatgatttaaagtatatgagaggatgtgtataggttatatgcaaatactataccattttatataaaggacttgagcatctgtgaatgttggtgtctgggagggttcctggaaccaactccccaaggacactttttatatctctccctattatacaaaggaataatgatgatgatgatggaggtggctaaaatgtacttaacgtgcttagtacattctggggaatatgtttatcatattccagtaatattcatattattatacacatagatgaagaagctcactcaagtaactatcaacagtcatatagtgagtaagtggtggaataagaatttaagacagatccagtaccgaatcccttgctctgttttttttttttaacagtactattaaggtgtaattgatatacaaacaatggcatgtatttgatgtatacaatttaagggtttgaatctatgcatacacctgtgaaaccatcaccataatcaagctaatcaacatatccattacttccaaaagttttgcactgctatccctcttttaaagatgtatcttctttacacatttttcagtgcacaatactatatggttaactataggcactatgttgtacagcagatatctagaatatattcacatttcataacttaaactttatacccattgaacagtattctttgttcttactatgaagtcaagataactggtaggaatatatctatgttttccagagcccttgccacttacataactcggccaatttttgctgtgtgtgttggggtttgggatagaaatggtggtggtaaaatataccaagaaagagtctgtatacacacatatatgtgtgcatccacacatgcatgcacacacacacaaatatctgtccagatattcattataccctctcctttaatgatcctaaaacttctggtatactagatatttctcttccattgcaaaatctcgggaaccatttatttagatcctcctactactacgcacaacctttctgtggaaatggcacttgagctggtaggtaggtaaaactggagcaaatttctctaactattgaagtgctctggacggggcatttgtgtatggccctatgaagtaaagtgcgtttgagagcaaaggatgaactattgattttttctaccctgcttgtggtagttaggaacttctagaacttatttctttgacatcaccctgctcagtagtgaatgtgttttggaatcatacctcaaactttattcatttaggaggtaagttaaataatggacatacgggggacattgaatcctgcacatcatgcattaattggtggccctggataaattacttgaatctcagttttaacatctgtaaagtggcgataagaatgcctaccaagcaagattgttatgagaagcagagataattcaggtaaagtattttgaataatgtctggtttatagtagaaacctggttagtgtctttattattggaaggttagatttcctcatctctatagtccctcttgatctcatgattctgagactgggaatctagcaagattgataggtaaaggaagggatgatgtgttatatgatattggtggcagtataaatacatataaccatttcagaatatagtaagtaaaaatagccataaaggtgttcaaggcccatagatctaggaatctcaattttgggagtttatcattaggaaataatatatcataagaagaaagatacaagcacaaagctgtccatatagcaatgtttactgcaacattatctgtaataataaaaatttagaaacctgtagaggaatggttaaaaaaattatgatgcatcaaatgagcatattcttaggaagacctaagactaaaacagggaattgtatttatgctatagtgtgaagtgaaaaataataaaaatgatatatgcactttgattatactgtaacataatgtgcacattggaaaagaccataaaggaatgtggaaaaatggaactgttcagtggtgtgtttttcagaaaattttaatctgttcaaaaatgagattcatttgttcatagaataaatatttatggatgcctaccatctaccaggtactgttctagctacaaggaataactaaaaataggtaaacaaaacagatgaaaaacttagaaatttatactgatgttatcagagtaatgtttaatttttcagataattgttatgtctaaattagcatttgatttttcaattaagaatttttaaattatccaatattgcaagcatatatagaaacatggaaaacaacaaaattctcatgcatatacttcaaacacagagctaacagatgttattattttttatttctttcacaacccaactttcgggaaacaaaataggcacagcaaaactgggatctcctcatccccttctcctttcttatataaaagtaatcctgctcttggtacagctatgtatcatactcatccaggttttaatttttcttatataacggaacatatatggtgttattttacggattttaaagctttacataaatggtgtcatgtgatgttcattcttatgtgatcatttttactgcactctttttattgctgcatagtgtggcaataaatgaagagtttatcccccctacttactgtttccatttttttttttactatttttttttttttactattatactttaagttcaaaggtacatgagcacaacacgtaggtttgttacatatttatacatgtgccatgttggtgtgctgtacccattaactcgtcatttacactaggtattctgctaatgctatccctccccctgccccctaccccaggacaggctctggtgtgtgatgtccccgacctgtgtccaagtgttctcattgttcaattcccagctatgagtgagaacatgtagtgtttgcttttctgtccttgtgatagtttgctcagaatgatggtttccagcttcatccatgtccctacaaaggacataaactcatcctttttaatggctgcatagtattccatggtgtatatgtgccacattttcttaatccagtctattattgattgacatttgggttggttccaagtctttgctattgtgaatagtgccacaataaacatatgtgtgcatgtgtatttatagtagcatgatttataatcctttgggtatatacccagtaatgggatcactgagtcaaatggtatttctatttctagatccttgaggaattagtcacactgtcttccacaatggtggaactagtttacactaccatcaacagtgtaaaagcattcctatatctccacatcctctccagcacctgttgtttcctgactttttaatgattgccattctaactggtgtgaagtggtatctcactgtggttttgatttgcatttctctgatggccagtaatgatgagcattttttcatgtgtctgttggctgcataaacgtcttcttttgagaagcacctgttcatatcctttcccccctttttgatgaggttgtttgattttttcttgtaaatttgtttaagttctttgtggattctggatattagccctttgtcagatgggtagattgcaaaaattttctcccattctgtaggttgcctgttcactcgatggtagtttcttttgatgtacagaagctctctagtttaattggatctcatctgtcaattttggcttttgttgccattgcttttggtgttttagtcatgaagcccttgcccatgcctatgtcctgaatggtattgcctaggttttcttctagggtttttatggttataggcctaacatttaagtatttaatctatctcgaattaatttttgtataaggtgtaaggaagggatccagtttcagctttctacatatgggtagccagttttcccagcatcatttattaaatagggaatcctttccccatttcgtgtttttgtgaggtttgtcaaagatcagatgtagatgtgtggtgttatttctgaggcctctgttctgttctattggtctagataactgttttggtactagtaccatgctatgttggttactgtagccttgtaatatagtttgaagtcaggttgcatgatgcctccagctttgttctttttgcttaggattgtcttggcaatgcgggctcttttttggttccatatgaactttaaagtagttttttccgattctgtgaagaaagtcattggtagcttgatggggatggcattgaatctataaattaccttgggaagtatggccattttcatgatattgattcttcctatccatgagcatggaatgttcttccatttgtttgtgtcctcttttatttcattgagcagtggtttgtagttctccttgaagaggtccttcgcatcttttgtaagttggattcttaggtattttattctctttgcagcaattgtgaatgggaattcactcatgattcagctctctgtttgtcttttattgttgtataggaatgcttgcgatttttgcacattgattttgtatcctgagactttgctgaagttgtttatcagcttaaggagattttgggctgagacgatggggttttctaaatatccactcatgtcatctgcaaacagggacaatttgacttcctcttttcctaattgaataccctgtatttctttctcttgccttactgccctggccagaacatccaacattacactgaatagcagtggtgagagagggcatccctgtcttgtaccagttttcaaagggaatgcttccagtttttgcccattcagtatgatattggctttgggtttgtcatacatagctcttaatattttgatatatgtcccatcaatacctaatttattgagagtttttagcatgaagcgttgttgaattttgtcaaaggccttttctgcatctattgagataatcatgtgatttttgtctttggttccgtttatgtgatggattacgtttgttgatttgcatatgttgaaccagccttgattttatacttttataaacaattctgcagtgaacattcttatatacatttccttgtgcagttgtgccagagtttctagggattatgaataaaaatgaaacactaggtatgtgcacctttaacttcacgcatattgccaaatttctttgtcaagtggttgtagcagttgacaatgtcaacagcaatgtatatgtttcccttcatcctcaccaatacttcagtgatttttgtctatttgatagatgcaacatggcatcctccttttttttttcagtcattcaatctgtcttgtgcttcggctaaaacacataaagacaggatccactagcttaagcccagtatcaattgttggtgaagaaacattttctgaggcagacataagacctcctcttggaactcctagtaaatagctggagaacactttgaaggaggcttgttagtgagagcaaactcagtggaggttcatgtcatggtaatttgaggtatataaatattctaatatgtacataattaggttatagaaattaaatatcagatgtctgatttgtaataggagcttagttaatattgctttgttttatttccctattttaagaagtactcaacataatcactaagtacacttttctttgtttatgtgtgtaaatattcttagatcagtgatatcaagctttgacatgcatcatgatcccttgtagcatttgttaaggcacaagctctgactgagtttctgattcggtgagtctggtgtggggcctgggagtttgcatttcttacaagctcccaggttatttgctcttgatgctggtctggcaaaccacactttgagaacctaatccatatgcatcagcaagagtggtgtgtcactggagattgcggaatgagtgttttcagaattacattattattccacttatcaaggcactgatattgctctctatgtaatattggggctcccttgaatgcccttatgctttatttgggtgaaaattcctatagcaatgggataatgttctaccttccttctttactcagcatatttccctgatgattcataaaatcataaaatcacacaatggttgaatttcattgcctctttttgtgtgtctgactctgattacaaatgagctaaaataagcaggttgagatttagggcagtttttactaatagggagctacttcgtactaggagccatctaggagaatgggcaggggttgccaggtattcttattttgattttaggttatccaccttgccctcctttccagcaccttgccttctcatcagtgtcttcaaactgagatattcagtgatcttccttatttaaacaatggtgtttacataatatttacagttattcttcacttaaatttgagaatttcaatactataccaaagagaagcaaggtgaaattctgggaacctacctacttcaacaggtacacattttagaccatttcttcctatgccttccatttgaaaaaagtttttatttgtaaaactgttttgattgaaatgtatatagctaatacagtcatggtcataggcttgctaagaagtatatgttatatgttctcactcataggtgggaattgaacaatgagaacacatggacacaggaaggggaacatcacacactggggcctgttgtggggtggggagaggcgggagggatagcattaggagatatacctaatgttaaatgacgagttaatgggtgcagcacaccaacatggcacatgtatacatctgtaacaaacctgcacgttgtgcacatgtaccctaaaactgaaagtgtaataaaaaaaagtatatgctttatggacactgggtataaattaatcatttgagagccctgtttatggtacactgtaaataaaatattactgatttttaacaacaaaaataaaatcaatgttatggcataacattataggttgttagaaatagaacatataaaagatttcttatattgcaatcagcactgtataaaggtgaggcaggtttctgtatactttgcctgtaagatccttgagggcaaaagctgtcttccttatttttgaataacccttgttaaagataatcccttacatagagaaagtgttaaaggaatgaatagaaaataatgataaggaatgttagagtagtccaataaaaagacaagggctttgatgtccatgggacattttaaatcctggttttattgtatgagtgtccttggatgactttatcaatttttctgaacccagttttctggtttataaaatgagcactggatactattccttgtctaagatcattgtggtggaatttaaatgaagtaagtgacgggtacattggcactcaaaaaatattatttttcccactcctgcgccaccaattccttctaatatgaaccattcagtgttataacaaaaatacagtatttaagttacttgtaaatttctgactaagtattaaatattttataccagcttgtattttcagaccctattgtacaattaattaccaattctcttactggaatcttgtaaaaatcatccatattttacagagataatgagagagctgagcttaaagacactgagtaactgcctcagggtaagtcagtgaagcaaacactgagaggtggaattttgagttcagagttcctgctctcctgttttctttcttctcaggctgtgcagccatactgtaattcttcagtttattttagtaaaaaagatgatttgcaggcctaaagaaatttaaggttatttgagtttctgttattaaattctacatttttccagcttaaataagaggcaactagacatcaatttagatcactgtttaccatgatttacataatctccttattattacatctatattcattgattaaatagcattaaaatatatttaatataatagcctttgaaataaataaatgactatgatgtatatagatagctaccatttgaaaaagttttcattcgtaaaaatatattaatcaaaatgtatatagccagtacagccagctgtatgatgaaggctgagaaggagaatttgtgggcatttgtacatgttgttcaataggcaagatttagtgcggaaagtcatatgtactaagacaaatcactgcataacaacaataatggtgatagaatttattgcacaattcctggcttctggttattatgctaaccttttcatatgcactatataaattgatctccaatttttctatagccctatgaagaaaatattattaactccattttgtagataagaaatcatagccatagagagtctaaatgagttacccaaatttgcatctatcataaagcaaacacaggaagattaaaatgtaggtctgtctacctccagaactaaagttctatatactactcctataaatgtttattgcatgttatctatatattagttcctgagattaaaaaaattttcaaaacaaaagtatccctgccctcttggatttgaaatctggctctaaatacagcacaaatagcccagagtaaatataaaacagaatttcctaaataatattaccaagggtatcttcagtgtttctgtttttgcttttaaatgaaaaagtaatccaaactctaataactttaggacactctgcatgctgtatcactgtcttagaggtaggtgcacatcacacattagcttactaaagtcaatgagaagtcttattattaggaagtattagcattttccaaacttaattgatgtcagattttttcccaaaaatttttttttttcattaacaccctgaaagacaccagtattccatgaaacataggttaggaaatgttgccctggagaaattctttgatatttaatccttttgttgatttttttttttttctgagaaaagactaaaattcttggcatttgtgttttcctagtactccaaatctcatacagtgtatcttacagcagctctcctatgaagttatggtaatgacttattcctccaaaatgtttgccctgcacctcatgataaaaaagactccatattcagtcctaaccccctgcttctcttcctttcattgctatttttctttagagttgtgctttccccattacttcaccattcatttttatttttttcacaatatgttcttttctgcctgcctaataggttcagttgtgtggtgaaggctgaggaggagcaatttggagggatttgcagaggttgttcaataggcaaataaaatttcaaggaatttttaacattagggaagaggatagaaaagagatgagctgtttacctttaaagttgtctgtgaacaagtagaaccaaaaataaaagtttacctcagctggaaaagatcattcccaggtgatggagattgagaagtgaggtattgtgggtagtttatttttttctttgcttagctttattgagttttcagaatagatttggggtctaaacttttagtttgtaaataactaagggaaatgatttattttccttatcacattcaaagtaaaaactgctatttgaaatggttatttaattaatattagaaattatttctactgtcctctctaaagggttttcctaaaattatagtttttagaaatatctaacacagtttctatccagagaagtgtatttattattttatgaaggaaatgcccttaaacttgtgcctactctattttgtaaggagtgtaaattgccaagttagcatatggtaggcgttgtaacaaatatttgccccattcccttgacatccaattttacaagtatgtacataactctatgcaagttgccgttgagaagttcacagctatttggaagtccagaaatgccacttgacttcaggaaaaatctgaagtctgttctgtgcaaaaaacaatagtttttattgcctttaaaatggaccttaatgcatgagctaacaggtgtttgtggcttctggatttaaaccaactttccattatcttagtttggtttcataacaacccactaaggtaagaataattgcccacccccccacaactgccaccactccctgctcttttttttttcatcaccctgttgttatggtgctgatagttcctttttaaatgtgataaaagtggggctcagagaagctaaattacatactaaggagttgatgatgtcaatgtgaaaacccagtgtggtctaagtcacagttctataggatgtgtgtaaaatacttagagcattgtctaagtattgtaggggtgagataaatgtattgtaggggtgagacacattttaggggtgagataaaaaccagttttcattccattctattccctttcttgtgctaggagcagtaaataagcatcctgctgaagtgaagctctgagagacgttgaactggtattggctttcagctacctctgcctgctgatgtgaatttattagctcagtaagctcagtagtttcaggttgttgggaaagtgaagggttgggggcagagggcactctgtggcatggaggaaaatcaatgataatttctttttttctttttaaatttagatttcactaaatagagaaggctttcaattaccttctttgggagtgaggattcaattagagcaaatttataaaatttttctatagttcattttgaaaagtttgactttgcttattaaaaatcatagtccaacataccaaataagcaaaatatatgctttaaactcacatacaactctcgttcttcatctttaggtgatataccctggcacagataagactttgggatatagacagtaaaagctggtggaagttgctgagcaaaattgctattagcagtttaatcacttgtgttaaatgccacggatataatccaaactgggggcggaggggggaattgctttctggagtgctgaacttcagcagttttgtaagcttaagaaatttctatcagcagaatatttggctttcaatcttaggtcggtaaataacataaataagtaatacagtcaagtactgtgattcataaatagaatcagagtgtatgtcactgatcccataatgtatgattacttatttatgttgcttttcaggcctaagaattattacagttatcccatggttgaataaaaaaaagtacttaatggttgttgtcctgccttcctttgctgaaatcatgggcaccttcctctgcacttttccgtgctttgtctctggagttgtctctgttttatgttgtagttaagttactaaccttttggaagtcaagaaaggccactcctaagatttctagaagcaccaggcttttgtttgtcctacttcaaaagcatttctttttattacctgtaaaatgtactttaacccaaaagaccaaaagggtttgttgcttctgaacctaaatcagtcttacaaaacctgagtgtttcagctagtatttgatattagattagtgctgaccaaagatttaagtttctggtgcaaatttatttcatttgatttcttcctctgagttgtctttggaattcttgtttttaataaagtttctaactgtgagcttaaagcagtaaaaaacagaaaggaagaaaagaagaatccagaattcctcttcatgtatgggttaggatagggctggcaaatatatatcatgtgttgaagttgcttttcctgtgcctatggcagatactgcttagccacaatactttttatttcctgcagttcttaggaacttgaacagtacctgccatttaagaggctgttaactaattgttcaattaatgagcttgtgctctgtttcctgaagtgagttgcaagccctctgagagcaggtcgtcactgtatctgctctattaaatgcagttcatcccacgaaactgcacttctaaatagttcaaacattattttaaaatagttaaactttttttctgtgaggggaaacagttgaatatgagtatttgccttccatttaaatattgaaggggcgtggcttattaaatgaggtggtaaaggcagccagaaatgcagagtgtagatgtttattaggcagtgttgaattagtagaacagtaaaccatcagaaacctaattcaggggtagggagaaagttatcttttgccttctttttattcctttaattttttcctgtaaagtgaagagaacataagttttgaagtcagtttatattcgtgacttcattttattttacttacttgctgtgtgatcttgaatgagatttggaattgttatactctcctttacccagttcacaaagatttaaagtagatatgatagttatctcagtttatttttgagaaaatctaatgatataacataggtaacacatttctgttttttactgttcacattggaggagggggtgagtagataagtagcagctattcgtaagagatgacatagaaacaacgtaaaatagaaatacacccatgccccaaacgtgtctaatctctcacttgccctttttaaatgacctaaactgtctttctctaaattgcctttctgcttctttgttctgtcagccactatagagttgaaagcaaatatggacatctgtgttactttgatattcagaattctatatctgtgcaactcctagaaatgcatgttctcaaagagagaacagttttttttaggagatctgttgcccctttttggttctttaaaatgtattgtattatgaagtgcttcttttttcaatatggggggaaaagaaatagagacagagctggggggggtggggggaggagagagagagactgcttcctttgcttaatgttataagttttatacacaactgtactgttatttcttgcaagtattcttgtatttcattaagagaggtaatttttaaagtgaggccaggctaaatattatcttattatcttatacattgaaaagtaaagatattctaagattaaatttggttggttttctctaggaatctacatatgtactaattaataccttgcttgcttattaccaagttcctctcattttacatttatgcaggcttcagtcagagcatcctgcatttaaatcttggatacaagcttcttcctcctgacccagtttaatgctacaagtatgaagggtgaaggagagtactttgcatattggagtcacttgggacttgtgtgggaaggcttttgttttgcctaatttcacaaggtgacaagagttcactcctcagctggaagataaacttagataaattaactgaaaaccatttttcactctttctcacttcacctccaacacactttccttttagaatggcttctgcctgttcctttaagttcctccacttgccaaaaaaaaaaaaacgtagatgacgcctgctgtcaaaatttcatttagacagagagctatactgtttaaaaggtagagaccccctacatttttattctgtgaaggtcatatgatctatggcacagaatagttaagcctcattcatacttgcctcctcataccaggacagggaatgttctctatctgtttctctctctgagcaccagtgcccttaattctaaaatgaaggggtaaggaaaaaatgtaagagtaaatatcactaagcataatatgtaacatgtaaaagctctgaatacatggtagtaattaatgtttgatatttgtatattatatataatgatagatgtttttcactgatgtttcctgtgcagttagcggttacccaactttgttgtaagtttttctaatgaagcattgatgacttaaactctctgcctcaaatcctatctttggacttatgttgtaaattaaaggattgtacattcttaatgtagacctgagttaggatattctattctattctatttatttttaaatgtatgtcccaaattttactgcagaaaatgtgatcactttttccataaataataaaaacagaaaatgtctcaagtatcttttgatttaactagcacttattgaaggctttatctgtactaagtacactacatgagacacctcattatcttcgacccttctgaaagaaataattattattaactttgggattggaaaggaatctagagttcagagaggttaattaatgaccaaagtcacctaggcttaaggagctaaagcaggattaaaatatagacctgtttaactgttaagcccgtggtctttccactttactacgctgcctttccatatctaagaataatgtaaaattacctttataattcatgatcatttttgtcagcacagtttatccagagttgtaatgccttataaccacaaaagtatacatctcacctatgtaatatgttcattatgaatcattattctggtatccaggctaaagaaacagcccctatggtggctgtgaaagtcttcaggcagagaaaaatagcaagaatgcaactgtatgatgagtcttaaagcttcttgtcagaagtggcatatgtcacttctgctcacattccattaatcaaaacaaatcacatggtcaagtcctatgtgagtggggcagggaggtatattcctcacacaggaagaaggacagtgattatttgggaattacaataatctaccataagattatatatcattatttttcttgtctaattatgttttactcaggcttatataaaaatgtctttgtgtaacctgaaatatccactactgagtgtggtaggggacagagagcctgaggcgggttctgttgaaaagagactcagccagagactcaccattgatttggtctgtctaatggactacagtattattgggaagtgatactatggaaattgcattggcagcattagtacatagggactgtcctgccatttcctgagttcatttctttcagtgctctaagccatttttgagcataccaacacatagccgtacaataaatgattattctgcatttttacagcattcagtagagcttaaattgtgtttctgagattatgtactgggctagaattgtattttcaattcaaaccaagctgatggtattaaggtgattctattgtgccttagctttggcacctccatgtctttatttttcctcactactctcaccaaaggagaattcttttggcttcactggcagattaaatatgagaagatcaatgacaggagatgagtataggtggtaacaagagagtaaagtcagaggaaaatctttcatgtgattcttctgtaagtgctcttttcttttatttttacttactgctatttatccctttaaaatggaattctcatttcatttctttctactgtctcatcagctattcttattctggtcttcaacactttagtccttgaataaagtgaaagtctcctagcttgtcttcctgtcttgagtatcttcctccatccttattcatgaaagataacagaaatggctggagaattgttttggctttaagaaccaaagttacaaaattcctcactgaacatatagatgtaaaatgttagcagctccaatgaaagccagcctatcccaccctgtctgttttacctaatgacacttccctgctttctttctctcctgcccctgcctatccagtccttttggagcccaccattattctcagttttccatcttggcatggctattggacattcaattttacaaacgtttccaccgccatgtcaaaagttgtctatcaacctttattattttattttaaatgtctgacgtatttaaggcatgtatataagagcatacacatggcatatatctacattatgaagcataatagtaaaataaaaacctatgcacctttctactccctatgtccatgagttcaattgttttgatttttagatcccactaataagtgagaacatgcaatatttgtctttctgggcctgacttgtttcatataatataatgatctccagtttcatccatgtcgttggaaatgatggaatttttttttatgaccaccagtgaatagaaaaaaatggctcttggtctttgtttcaaagtctctaagtttgtatttctgacctgggcttttttttttttttttttttttgactgtatgtactcagttccagccttattatcatgttcccagtgcttccatcaacttccaccgttcccaaagctttaccctctggctgccatcctgccatgctcttctgcctaactcttggaatggggatttcatctcctatacccagtctactcttccaaaaattctactttgatcaatcaatattatcctcctaagttcaaaaatctaaattgcttctgtgcttcctattgactaaagaatgaacactgtctggattttaaacaccccatgaaatcacatcagaattgcatcagacataaattttttttttttagtttttctagctggtttctgagctgtcttctagtcattgtaaattcccattcctgtctctgtgtaatcactgtcctatctagcccattttattaccatgatgccccctcgaacacggtgtagtgagagactttaacataaggaaagtttgaatgttgaccccatcacttactatctgtgtgactttggtcaatttatatggtcactccttacttgtatgatcatttccattttcctcaactatatattgagttactgtgctctgcggtattattagtgatgaagcaggtggtttctttagaggccgtaccacaccacagtgccagctatattgaagatagtaaaaaaattgagttttgttaatactcttcaatccagtctctcccctgtcacacagaaaaaccttgttagaaagtctatctccattctttactgaacatccaggcttagactttaccatatagacaaggagaaatattgaaagattttgaagaagtaattagaaaaataaataagatttcctgttgagaaggttagtctggttattgtgtggaggaaggaccaaagaaaattgagagtagaggcaaggcagcagcagaggttgtcctggttagaaaacatggcacctcacaccatggcagtgccagtgtgccctctatgcaatcaagttctctaccatgtgaggcacaaatgaatagagcactgtctctagactctaccagggccccaaaataggcctggactaagtagcttgggcataaatgttcaagttaataaaggtaaatagagcatagcttgctgagaaataatatttctgatactgaggaattaaagaacaattccagaaggaaattgcagttgtttgtttggcaatgggagcacagaactacaagctatgtgattggaacgagtttgtatttttgcctccgaggctctcctagaccatctcttacactttagcaaggctgttgatgtggaatggattctggaagtcaaagatttaagcaagttagtggaagttaaaagggggaaggctaataggtacaaaaaaatagttagaaagaataaataaggcctactatttgctagcacaaaagaatgactatagtaaattctaatttaattgtacattttaaaataactgaaagagtgtaattggattgtttgaaacacaaaggataaatgcttgaggtgatgggtaccgtatttaacctaatatgattattacatgttgcatgcctgtgtcaaaatatttcatgtaacccataaatatatatacctactatctacccagaaaaattaaaaattaagaaaagatagaatgcatggtgaggagcaaaaaacaacaacaaaccccccaaaaataaacactgagggtgtatgttatatatcaaaccattaaatgtttttctggtttggaggagtgggactggagatgctgagataagggaaaggatggattagatcctgtatgagaaagggtaacaaaacagcatttacagggtaataaaagaagagaaagaaaacattctgtgactgactgatgaagaaggtgaacaagtgaggcaagggatatgtctatggaataacagtaattgaaatgctatatgaaccaatataatttttgcatcctgctggtttataatgtaatttgaaacaacaatgatgctgaagaggagttgctggaatcacctgctaatccaaacagactacacagtgaggatatctctggatgagatggttgccctcagtaattataggagtctgaaatgtgtctgacaggcagaagagaaatagcaatataaacaccagcgggagtcaagaaatacaactttatcacagcttacggcattcctgaacttaattgcttttggattttttaaatagttcatttctcagagatggtgtctctttaagaagaaacagggtcattaaaaggatcttattaagtcaagaacccatggaaaatttccaaggtcctcatgacttgcagaagcctctgttgagtgtgtgtagtttgtcagctcgggccttaggaatgtgaaaggacagtaaattctgtctaccttcacttcctcattgtaccaatacaaatacagtaagatgatctgatcacaagacttcagcatgtgagcattaagctgacattcaaactcaggtctcctaacacctgggcctgaagtccagtccagggtgtgctatatcacactgtgcccagagcttgagcagatgattccccaccaaacattgtttcttcccggagactgtctctcagaagagtaaaccataataaataggtgatgaagtgagttaatggtaataagtaggattttcaatagtgtttctcacacccacagtgatttttccttacagttctaaagattccaaatgtcaagagcccacaatcaaggtcagtttggataggagcaatgtgtctcgtggagaacaaatgcttaattccctataatatgggagatgtggctgagggggaggccacctgctaaaaagagagccctggtatgttgccacacatgcactgtgggcgtctggtaattgttagctctgagtgttgcgacacttaagcctgagccacacattttgcctatgaccatacacagcctatgtggtcttcacaacatggccagtggcatcaagcaactctgaagagcctctgacaagatgcaaaacctttctgagcctcagtttttccatacaaatgggaacaatatgaccaagtttgctgagctgtcataaagatcctgtgaaaacaggtgaaggtacccagcaggatgacttatcagttggtagctttcttctgattttcatgaataaaaagcaaccttctcaagaatagagcatacaacacctccaacatcacttactaaatttctgcccataaatcatcccaaataaagaaatttatctttgtaaaccccatagtatttactgtttaaaatcaaacatttcacagttactgaaaatctctttttttgttagctatgtgtttctaattttaacattgttctcttctcttagagatcagtagctgtgcctcaaatcctctgaatcctccatagcacctagtatagaatgaggacctcattaaatgtttatcagctgcctgaatttgtaaagatgtgagcagaagataaggacacagcttgaagttagtgtttctcttgctaggctgcagttctgcctgcaaagtgtttggttgctaggattgctaggattttagatttgctattggtgagagggacatacaacaagagttgagttttggacaagaaggaaagaatgctgttgaaacccccaatgccagtttgttagttccaacctctatacagagattgttttactcctattagtaactcactcaagtgcttctcacaatgcctagaacatagtaatcactcaatcaatattttttgcagtaatggacagagccgtgccacctttttatatttttatatcttatatagtcatgctaccaattttatattaaaattgtatctttgtgtggtttattcattcagcaaatatcattgagtatctactatgagctagacactattcaaatgacttatgttctaaagcagtgaacgaaacaaacaaaaatcccagatgatggaagttacattccaaataaaaagaaatatggaacttttttttatgttgagtgatgatatatgtgctatggagaaaataactgggctcggcaggggaatatgaagtgtgtgtgtgtgtgtgtgtgtgtgtgtgtgtgtgtgtgtgtgtgtggatatacaaccatcccattctaacaggatggttcaggaaggccactctaagaagataagatttgagtaaagatctgcaggaagtgagaggtcaagccacatattacctaggagaaagtagagggaatagcaagtaaaaaggttagaggctggagtatgtttggcattttcaaggagcaaacaggccaggctggtgtggctggaggagaggggtaagtatgaacacagtaagagacaaactcctattatattcctattcttattatatatagaaatgtatgtattcctttaatatattcaattctataatactagtaggtcattttaaggacttgatggcattctttagtagatttctaaaagtcaggtgaaaatttgcatatcagatgcacaatgttattcattcattaatttgtttattccttcctcttcatcaatttactatttgatgagtgtttattgaacacctttaattagaacttatatttattgaacactcactatatgctaaaaagatgttttacatacatgcatttttaaattacccttatataacctaataaagtaactacttttatatgtgctgctattttcagatgaggaaactgatatatcaaaactacttttaaatatattatctgtcttcaaaggcttcattattttacaagggaattgagataattatacacgtagtgtacaaaacagtttataaatactgtggctcaattaagttaggagaatttagacagaggatcaaataacagtaccttttacccatttaatcccttgaaaatataattctggtgaaagtattttttatatcctcattgtatttctgaaaagtgtagacatgtgtcaaggtttccaaagaccagtccttctctctccataagaaaatacaatgtagtttataaatactaccatcttaacatcttaagagagaaacatagttctttgaaagctagttcctgtgaccctgccatttaagcttgacagtttctttaaacttcacagatctcagcttctgaaatgaagtctagattaagatgattcctaatgtttcataaacaacttttgaggcgagtttaaatttttggaaaataactaaatggactttaataattgagtttagtgctttatcacatttaaaccactttcacaatccttatctaattaattattcatactcttttcctattaatctgttttaaaaaataagcttacccctccttccaattatcatttgccagtcatttcagttaccttaaataggtaataaatgtcttgattttaccatttataaaatgctgtatcaatgcaactgggagtaggaggaggagttaattagtttaattaactaataaataattgaaaacactttgccacataaagtgttttggacattcaaagagactagatgtggctcttgtgcagaggtaaactactgtgacagagttgccacttatgggccgtatcttttggagggcaaaggatattatttaccaaaatggctttctctcataattttgctgaatagtaaaatattgcttctgtttaccagtatgtagcacatctaatcaaaaataacaatagcatttggcagtgaattttttataggatattttgaatttttcatcaaatagtcatctaatcaacctagactgatcatctgcttgtttcttgtttgatatgattaaaaaaagttagcattgttttccatcctgtaatctccatataccaagccagacaagccctatctatattcagtaagacaaatcatttatcttgctttttcttttatgtttctaactctttgtaatacacaatgggttatcagttccagtggcaaagaatcttctacattggaaaggaactcaacaacaacaaaaaatgactagaagtttaaccaaagttgtttttttgttttttttgttgttgttgttttttttttttttacattgtatgaaccataggtgagcaaactatacataggagctaaatctggcccaccacctgtttttgtacactctgtaggctagacatgtctttacacttctaaattgttgaaaaacaatctaaaataatattttgtgaaacatgaatgtgacataacattcaagtttcagtgcccataaataaagttttattggaatatggtcacgtttattcatttatatatggcttcttctactctataatgacaaggtagaacagttacgatggagacatagggcccagaaagcctaaactgttttctatctgcgtttcataaagttttttggcccctagtacagatcatgatcagagttctttatattcatgaatcataagattgtagtaagtgaaagtggtctgtctttgggaagacacagttgttcgtctgttgtctcttttactttggaggagaactattgtttagcactcaaatgaaattgctttggaaaaatgattatcattaagtaaaaatttaaaacatactaatttatacggtacattcttgtgtcacatttgatttttttctgcatttccttatattttatttgttcattcattcattctattataatctactgcatttacagtctatctactccatgccaagtttctagggtggtagaacacttgatcttagccaaaaggctgagaaacaattcagggtaacacaaagtagaatgagaaagaactcagcccttgctaaattcacagactatggaagaagagactcattggaacaagtaattacaatgtactgtgagaagtgtttctcttattctatgtgaaaatcccataggatcataaggaaaagaataattccttacagaagagtggggctcggcttctcaaaaaaaaaaaggtatttcactttatctgaaggataaatactgattctgcatgcttgaaagtagaaaatatcattttaggaacagaaaccaaggtgcactggacagagacataaaagaatatgggtgtccagggaatgtcaaggaagactatatggctggagtacaaatttcatcaagggaaaaatttgaggataagtttggaatttggaggaaaagattgtgtaaagcattgtctgtgagtccaggggatttttcctgtatcctttgggcaatagagagccaacagagatcctaagaggggcaaagcgtgattacctgtacacttttcaaaagcactccagcagcaatgtagaagataaagtggaacagaaagaaactggaaagggatactggttatgaggctgtaactatagttcaattgagagttaagggtcattgtgaagtaaggccatcacaaggaggttattgaaaagtaatagattgtattgctccatgcctttatattaaaatcagcttgagccctgataatggttctgaatatcctagattttaatcttgggaggtagaagaagggagtcctgctggtatttccagtatttggtataatggccttaattgcagttgtatttaatttacagttgtacattgtcttgtggatctctgtgcttttaaatccacaatgagaagaggccctacatctagtatgaggggctgctctggcctggaaaccctggttctgaaaagtagaatttttcctggaaatcctacctctttgtagcagattcataaatctccaggtaagactatgtggacacttacccagacaggtctccagatgtgctggggagctttcactcctacagtaatgatgctgcagctctgttcaggtttctcctcatggctgtatggtacaccccatgtgatcacttgtcaagctgtggaattcagctgctgccactttcattcctgagcttcaaagccatttggctaaatctgggcatgtgctgtcagtgtttctaacatccccagtgaggcggtaactcagctatctgaggtttcctgttaaattcttctccttggcaggtcaatgggtaatttagttgatgcttcattttatctggatttgaagagtgaatctgggtattacagcaggctcggattgtagagtgattttttttttatcaggttatctccattgtctaagagatcatgacaatgccaggcatataggcatgaaaagggctcattttcagccgatggagtgttagagagtgatgttagaatctcaaatattcacctgtgacatttgaatctgaagaggactggtgaaggcttttctcttctcagtgtcactgaagaaaaaccactgctgacatgcactggaagtcctggcaggcttccaagacttaagagagttggctttttctgtgaggtgactagtttgcccagttttgacacaggaagaagcagtagctttatataacagaaacatcatagacttcagagtcaggtagatataggtttaaataccacatactttctattgtgagacttacagcaagttgatcttttagaggctttcttctgttctctgtgtacctttactagattgttgtaagcatcaaacgaaattgtgtgtgtgtgtgtgtgtgtgtgtgtgtgtatttgtgagtgagggagtgtgggccagtgtatgtatgtgtaaaaaggccctggtggagtgcctggtgagtcgtgggctctcattaaatgtattagcttctgcccacctgtgaaacagatggctgatctcagcaatgatgataatggactgcctggaaattatgaacatgacagtctcatccatatccgagaagaaggcattgtggctcaatcaaaaagttctgaatttagaggctgaagatcttagcttgattcattagtctgccactcaagatgagtatttgggcaagtcatatacctctgtaattctcaagccctgtgtctataacatatgtaccttataggattaaaatacacagtgaagtttctctagagatagacctaatttttgtgtgcctgagctttctataacttggcatagaaaactttaagaaaaagagcacaaattgtaattacaaaattagatacagggctttgtaaggggttcatgcaagtaagagaccttctttagcttcatggtaaatgtctctgaacttctggcttgttaagtatatttatataatatatttaatgtaagaaatatttattggagatgttaatggaaaataaatataaatttattaatataacaagcctaaggcttataaataataaatgggaaagttatgggaagaagagagaaagaactctattgagggtttttatttcttaaaaaatctaaaccaaaaaagtttcctatagctttatgcagggcacttccatttcgaaacatacatttactgactatgtaagtgctcggcactgtgctaggcataggaagaatagaatatttcttggatgagtaataaatagagacagaatttcctaagggcagaatgcctgccagtcattgtcctctacgtggaagtgtttgaattctgcagtgtgccttgaagtcattctcctctgatagagaagtattatgaaatagtatagaaatatttcagagctcaagagttgtgaggcatcagttaagattgttaggaagatgtatttattttttcatatattcatcatctgtttggcatatgctagtactcaggattgaggggagcactaggaatctgttattagtaatattaatatataattgttatgattattttagagaagaaaatattctcagaagaagacctcttcctattgtccactgaattatgtgatcacagatttacttgtattagcacccaaccctttctctttccctctggtttcagaaatgtcttgttgaagggaaattcctcccatctaagcaggagatgattttttgatgacattcaaggtgaggacatcttcctgccaaagtaatcgtcttcacccattactagttgaaaccattgttataccttcactagcaaattactgtagagaatacataatatgcattaacctaaaagtagaataatatgatcattctctcccagactcataagctgcaggtggctggagtaatcttctttgtcaactagtattcagaatctactggctagaatccaagagagttttatagatgttctctctaaaacaaccccctaaatctgagatgtaagcttaagaatgtgtatcacttgttttctttcatgctgggcacatctagagctcttcctggattgaaaaacaacaacataatatgagtccttactctaagcctaaaggggctgcttttttcaggacctaggtaggtccttggtgtacagacagctttgactccgcatcaccttcaggagggcccttttgctttgcatgatcttttactggcacttatattgaaatggaagctgcctagaaaaagtaacttgctttgagccactcaaacagttcaactgaaatggttcctgcacaatgtaagcatcaaattaggcaccaatcagagagagtgcttgtcctcttttaaaagattgctctgagtgcctaatttatgattccatacttcattaagcgaaactcatgtttgcatggtgctttacagtttacaaattactttcacatccattatctaatgtgctcttaggactagttcttctgtagtataatgtaataggaagtaggtaataaaatgggtaatgggatacctattttacagatgcagaaactgactctcaggaaggttagatgacttggcaaagaccatatggtaacagaatggcagtaaatgttgtatataagctattgaagtccaaaataattctcatttcattatacatagttttgcttttggtttacagtttacacagagatttcatgtatattattatttctgaggcaatttgactgtaatggttggggatatgagttagatctttattttagttccagcatcattatttactagcaatgtgatcttgagcaagatacctcacttcactgaactctgtttccttcttagtgaagtgagggtaataacagctttcttgcagggctgttatatgaattagagattctgtatataaggtacatagtacagattcttgcacccagtaaatgctcaaaaatagtagctgccatttttgttattaaccattctatgaatcaaaaaatgttagaccactttgaaaattagaacaccgagaccatgtggaaaagaagaagaaaattcattagatttcaaacggccttaagataaaacagtctctgtgtatgttaccaagattcttggctctatttgatctgagatgaaggtatttaacaaattgtactccaaggttttccagtggccagtttagttttcagatgaatggagacaggaataataaaatggtaccagttgtttcttttctctgctcctctggaggcagcccctactctgtctacaactttaataaatcaaactcatcctactattgaatcaagttccttttgcttcaggtggcagaaaacgtatggagcaactcaaaaaggtgttgcatttgtaatctaaaatgagccagcaaccccctggtgccactctatgatgcagagcttttgagacagtataactgttgagatgtgttacttccactcatttgtccttacccccaaacacaggcatcctggcaggacaaatgaaagttgtttgcagcaaactgaaagagtaacagccaatatcagcgtcatccctattgggcaattgctacattggagcctgatacatgaaaaatgcaatggatgcactttaggctcaagatgagagaaggaaatggcttgagaccccactatgaggtggcacactatgtttaacagctccagaccctctcatcataacccattttatgcattcctcccagttaatagatgtgagcactggggcagataatccaagattcatttatatatggctttgaaaatcattaaatgcatttttcggcaaattgaccttcttaatttagttttccttagactcttaattttcaagtaattttcttcttaatgaaggatatctctagctgtctctaggatccaggaaacaattctcaagatgtcattcttttaaatttactttaaactagcgattcatatagcatatgaataatattgatttacctactgcttatggaacatctacaatataccaggtgctaggatagcttcggtgatgcagcaggtaaagattccccaggttggtgatggaagcagaaacgtttcatgtaattatgtaagccagatattactgacaccttctgccccttggagatgtcatcaaattttgactaaaccaggattccatgtcctgggacagtcaaaaactctcctcacaatttcttctagtttctctaagttactttctattcctttattcctctagtgttttctgtatccatatggctgttttcctctctcctagtgagtgcagatataaagcaaagcctctttcttagtttattccttaaattgtatttcctacaaacagtttgagagttgagtgactttgtgaactaaatagtcacagtgaggaggaggtcaaatttgagatcatgagactttcctactgtcttgctctccacctttgcctctggtgctggttccctaatgctcctcttcctcttccaaagccttctcttacttctctttcagcatatactccccttctctacatgtctcccagaaagcagccccatcaggcaaagcatctatatgttaaataggctcatcaaagcatgtcttcaaaaaataaagcagaccttttactatgagagattttcctgagcaaataacctctttccatattgttattattataatacgacagtgtgagtgtaatgaatagcaatgtaagagtatagcaaagcacagagaaggcatatttaactcagggtgaccctaatgaatgagtgaagttggctagacaaatgcaggaggtgggggtgaagtggggaagtagatccttctaagcagaggaacaaacatgaacaaacataaacatctattcagagatgagaagcatgatgcatggagagaactgcacgtaatttaaggtgtttcagagtatgaaggctgtggagggagggagtggtaacagtgggggctggaaggcaaaaagggctgggtcagggaaggcctagactctcatgttagaaaggcagtggggagccatgccctatgggcttgcgtattggagagacatggtgagatttctgttttggattgatcactctggtagctatgggtgtctgaaatccagtgatctagagcagaaaaagcctagattactgtctagttcataaccagtttacttttaaaaggaaagatttgaggtcccgatagcgactttctccattgcataccagttacactagtatgctcatccactgctcaacgtgctgggtgtaggctcagagactccttggcacagtctctaactaattcacatgaatgatcacagctcagcaatccactgcaaactttctttgaggggagtcttggaaaatgagaaacaaatgtaaaaaatctacaagcgcatttcgctaaagccacagcagtgtaattttaagaggttactttttcataataatgttttaggaatcaaatagactatttctcctaaggggttactctgcaggaatatagtgtagaaacaagaaaaatgtattttcttttcctttctgttacagcttctggctctgaaatgagcaccatcctatttccaaatgatagaagagcaagaaaagttagtctctttccagtgagaggtgtagagggaggggggaaattaacactggggtactgagaagctgagtaatagaaaaagtgttctattaggtttgtaatcaccattagagaagctatgtgtcttcacatcgtttaaatacgtaatgtgtaaagaatccaggagaaccatggatggagccagtgcttaatgaggacaacatccccaaaagacccattctatgtcattctgagacctgcctggggttgtctcaatatctgttattccacctgcattctctgtcagcgattccccatcaatctggacatatctttgagtcccacaccagcctttttcttctcagtcttagctcttttctcttttttattttcctatacattgcaaagaatagtggaatgagtttgggtcttagagtagaaaaacatgactttcaatgttagtgctattattttctaatcaggtatctttgtggttgggagggtgttaatcatcttctctgtacctcagttatctcctccgggaagttcagagttgctgccatttctcaaggggttgctatgaaggttcattataatggatctagaaggctaggatagtgcctggcacattagtgctcaatggcaacctctcatagtgttacccacaggtaaatttagctcaacaccaggaccactcctcaggcctacatttgtgtgtgtgtgtatgtgtgtgtgtgtgtgtatgtatttaattttgtaaaaagattaaacctacaataaatgaatggagtttctggaatcctgtttctcatctatatattcactcttatatatgccagtggatctagaagcctttttaaggataaacagccttcctattaaacatcaagaatgagattgatgtaactgggtggataaccgctctcaaaagaccaacaagacaagggaaaatttcagctccgtttggttccagccttgtagtatgaggcaggaattgtggccacacagtgagccaatgaaaacgacaattgcatcacatcacaccaccatatggaacttcaatttgcagattgcagataccactgctcagtcttcttaacccaatcataaatgttgtgtgttctcaaagagtttcacatttccaacaggagagaggtgctgatataggctaaaagagaaccacccagaggctgtgacatttaaaagtcaatgttgttttaaagaagcattcaggggatgttgccaacatttatatttcatattgctgtggaattgctttcatttctgtctcacttaggtctctgtatggtaaagattcctacgttgctatggaaaatatgcacttaagctgactgctatggtaactagtcacatatggtggagaggcatcacatgacacaggatttgcataactaatttgagcattttagtgaacagtgcaatctgtgcataggaggctaagcaatctgaggctttaaaaaaattttattgtgcacacaaaagtatcagatactattctgtgcttttacattgtaagttagttgttgactcatctctgaccaggcatcaatccacacagtatgtgcctataaaggtgcaagtatgtttgtgagtttataaagttcaattattccagtattttacagtaacattttatttatctggagttcaaagtcttaagcctcttcttctcaacatgagaaagatttaagtacatttctattagttttccacaaatttaattcaacttaatttaataaatatttgaggtgctgctggataatgctggatcatatttgtctggatcatgctgtttctatcttcagtgtctgaaacgcttttatctatatcttaacctagaataatgacttacacatggtagacagagaataactgtggaattataaataagctcagttctggggccatgttctctgggagcattccacgacacccttgtgcctggctgggttaggttccccactcactgtatcttcctgtgatactctgttcatagctcctgaataaagcagaacaattctacattgttctaaaattgacagttttgaagaatctgcctctctaatagattctgagctactttatagaaagaatatgtgtctttttcacatttgaatatctatggcctagcatagtttctatcacagagtaggcatgcagtacatattttttaaataaataaatggatatataaataagtgaatgaatggtaagcctatcagtcatatagctacatataatcatgtgggggagaaatgttattcaggatctcctattttctcttttttaaaatagcctacatctcccttataagatgatgagactaggggaatggcctaattgtctttgttgttagtatcctcatcctaatgttattttccatgtacaaaacaaaaaaaagtaagactgactgaataaaatgacactgctttccctccttggcactctcatatccaaaggtttatgttactataatgaaggcagaatgcacctaaactcacttgaggtccttattgcactttctcctactcccctactgtgtgtgcacagcagggctagcattggaagagccatcctcttgctcccctctttttcactctgtcacagaaacatactcatgcatatgcacacatgcataccttatataccagctggtggttgaatcagctacaagaagtacaggaggtgaggtggaagttggggaatgacagggaaggaaattttatttaagtcatcactttagtaaattaagtttattttgagatacctatacattcacatgcagttgtcagaaataatacagagcgttagatcccctatacccttaaccctgtttcccccaatggtaatgtctacagcacaatattacaatcaaaatatttacacagtcaagatgaagataactttctttatcacaaggaccccacatgttgtcctttcattgccacacccccttctctacttttagtctcttcttaatctctgggaaccactgatctgttctccatttctataatatcgtcactttaaataatgttatacaaatgaaatcatcatacatttgagattttttttaactcagcataatattttggaatttcatttaagatatgtgtatcagtagtctgttactttttattgctgaacagtattccatggtactgacacactgcagcttgtttaattattctctctgaggttgtctgagttatttcaggcttttggctattgtgaataaaactatttgaacataagtttttatttctctaggttaactactaggttatttgttaatagttgcatgttttgttttcaaagaaacctccacactgttttcaagagtggttgtaccattttatattcccaccaggaatgtgagcgatccagtttctccatgtcctaaatagcaattgctgtcatatgtttttactttaaccattttgtatgtagtgatgtctcactgtgattttaatttgcatgtccttagtgtctaattactgtggctgttatgtgtcttgaaatcaggtagaagatattgaacatcttttcacatgcttatgttgcaatctgtatttcctctggtgaaatatctcttcctatcttcacctaatttccaattggattattttactttgttgagttttgacagttctttatatattctcaacaccaaatcttttttggatatgtgctttacaaatattttctcctatgctgtagtttgtatttccatcttcttaatatgatttttccagtgcagtgttttcaattttgattaaatccagtttatcagttttttctttttatgaaatcaatgatccattttaagttaaattttatatcataagatttaggttgagattttattttatttctatttttgcttattggtgtttattgctccagcattatttgttgaaaagattatttctctttcagtgacttttatacccttgtcaaaagccaattgggcatgtcttttctgttccactgatctatgtgtccattttgccttggaccccacatagttttaattactgtagctctgtaagtgttgaaatcaggtggaatgatttctctcacttcattcttaaattgttttaagtgttctagttcttttgtattttcatatacacttcagaataaaattgtttggtttattttatcattattttatagtttttgatatacagtatttatttagaataagtatttttgagcaattgtaaaaggtattatatttttaatttgggtgtccacatgttgattgataatatgtagaaacacaactgattatgtatgcttttatagtgttaccctactgaacttatttattggttctagaagatttttttctttgtaggttcattaggatttcttttctttttttgtagatgatcatgtcatatgcaaataggaacagtcttatttctttctttcttatgacttttattttttttttctttatggcaagaatttaaagcattatggtaaataagagtggtgggaaagatatccttgtcttgctcctaatcatagtacaaaataattcatcttacacccttaaatctaatgttaggtacagattttttatagatgcactttattgagttgagaaagtttccttctattcccagtttttaagactttttatcaatgtgtgttgaaatttattaactgtattttctgcatagattgaaatgaatatgtggttgctcttctttagcctgtttatattgttgagtacacggattgattttcaaatactgaagcagtcttgcatgcttggatgacctccacttgatcatggtatccactattttatatattgtcgaaatttatttgctaattttaagggatttgtgggtccatattcatgagggatattgacctgtagttttcttcttttgtcttttgtctgaagtattttaataatattagaaaggaataggaatgtgttctctcctcttctgttttctgtaaaagattgtatcaaattgatcttaattatttttaaatgtttgtagagttctccagtaaaatcatctgagcctaaagatttctttttttgtttgggaatttttaaaataataaagtcaagtcttttaaaggtaatggagctatttatattatctatcacatattgggttgcttgtggtagtttgtgttttttgggtaattggtacattttatctaagttgtcaaatttatgtgtatagaactgtttgtagtactcacttcttgtcctctggatgtctccagggtctttagtaattatttcatttctgatatttgtaatttatactatttcttttctttatcagtcttgctagaggtttgttaattttattgatcttattaaacaacaaattctttgtttcattgattttatctcttgattatctgatttaaattacatttgtttctgctctttgttatttctttccttctgttcgcgttggttttattttactatttcctaggtgggagcttagactaattatttgagacttttatcttttcgaatatatacatttaatgccttcaatttcactttagggtgactttaactgtgtcccataaatgttgatatattgtattctgattttcagtcactgaaatgtgtattttttaatttgccttgagactttctcttgacacatgtattatttagtagtatggtttttagtttccaagcacttggagatttttctttgtgttatctttaattttgcttttttctggtcagataacacactctctatgatttaagttattttaaatttattgagatttgcattgtggctctggatacaatgcattgtaaatgttctatgggcacttgagaaaaaatatgtattcttctagttttttatggagaattctataaatgtcaattggattctgatggctgatggtgttattattctatatgcattctgatttttggcgtaggtattttgtgaattgtcaataaaggagtgttgaagtctccaattataattatgtgtttgtctatttgtccttttagttctattgcttttgcttcatatattttacaactcttatttgtacatacatgtaaaggactgctgtcttctttgtggattgattctattatttttaaataatgtctctttctgatctggtaactttctttgctctgaagtatactttatctggtattacaatagataattctactttaaaaatattgatatttacctgatacacctttcctatttttcactttcaacctgcctcgattacatttgaaagtgaatttcttctaggcagcatagagttggcttattttttttaacccattctgataatccgtgactgtgaattgataaagttagatcatttacatttaaggtaattattaatatgttaaggcttaaatcttttgttttattctttttttgcttttttgttttttgtttttttgagatggagtttcactcttgtcgcccaggctggagtgcaatggcacaatctcggctcactgcaacatctgcctcccgggttcaagcgattctcctgcctcagtctcctgagtagctgggattacaggcacccaccaccatgcctgactaatttttgtatttttggtagagacgaggtttcaccacgttagccaggctggtctcaaagtcctgacctcaggtgatctgcctgccttggtctcccaaagtgctgggattacagatgtgagccaccacacctggccttctgttttatttctaattttctatttgttctctctgttttttatttctctgcttttttattttgccttccagtgggttacttgaacaatttttgcaatcccgttttattttcctagagtatgtttgggtccacctttttgtttaattcctcctcttaggtgttgggctaagtattaatatcacattatatatgacagtgtactgtgttgtctttctaccagtttgagtgaagcatagaaaccttattttcatttatattcccttagtcttccctatatattttttaaaaaatatttcatctacattagactgttgctatttaagtttctaccatcaaatataatgtaggaaatccaagagaagaaggaaaatctactgtatttgcccagaaggtttactatggctttttcttatcattattttttgatgttcgaagcattcttctttccttattttcttgctgtttagaaatctttctctagaagccattttatcataggtcctctggtgacaaattctcttagttttcctttatctgagaatgtcttaaattccttttaattcctgaagaatattttcactgagtatagtattcttggttgacagttcttttctttcagcagtcgaaaatattgtatcacttccatataacctctaaaatgttttctgatgagaaatctgctgtcattcaaagtgatttttccctataggtaaaatgtcatttctctcttgctgctttcatgaattttttatctttagttttcataaaattgactataatgtatcattgcctgcacagatttctttccatttatcctatttgggttttgctcagcttcttgaatctgtttgttatgatttgtttggttatttcaaagcattttcagccatgttttctttgagtgcttttttcattctccactctttctcctttcattctggaaccctgatgacacaaatactagattttttaaataatgctacagatccctgaggctcttgtgattttttaggtcaatatattgttttaattcatattgctttatcttccagttcactgattgtttcttttgtctcttttattcatttacagaacccatccatggagttttgtatggtatttcatttatcgtgtttttcatttctaaaattccagtttggtttttgcataccttttatttttattgaaactttctttctttgcagagactttctatgtttccatttgtttcaagtatgttcaaaattgctctttgaagcatttttatgacattaactttcaccttggtattggcatttgtattagttcattctcacactgctgtaaagaaatacctgagacttggtaatttatttaaaaaaaaatgtttgaatgtctcatggttctgcaggctgtatatgaagcatgatgctagcatctgcttggcttctgaggaggcctcaatcatgatgaaaggcaaagttggagccagtaattacaatcactgtgacaggcaaaggaggagccagttaattcatattgctggagcaggaggaagacagagatggggggaggctacacactttaaaacaaccaacccgatctcttgaggaatttatcatgagaacagcaccaaagagatggtgctaagtcattcataagaaaccactcccatgatccactcacctcccaccaggcccctccttcaacactggagattacagttgaacatgagatttgggtggagacgcagatctaaacgatatcagcatttattgattctctatttttttttctctactttaggtctttttggttcttggtaatatgactgattttctatgtaattctgtacattttggggcaggagaaagggaggagtggatactgccttatcactgtcaaatggggataaaattcccagtttcccatgctgtctctgttgacactcaagggggcatggctcctcaatactgctgagtggaagtgggagttcccgtttcccactaagcctccattgttagctctgtggctggaaggggtagtaatacacttttactgctactgtgcatgtggcctctactgacacaatgaggggcaaaggtgggaaggtgcaatacttttactcttgggcaggtatgaaagttctgactctccagaaggcctcttctgataccaccctagccaggaaagggatggatattgttgccatcaggtgggagtggagatctaagctccctaatttttctccacggttacaatgttggagggatggctttactactgcctagtgtctatgaaagtttcagctccctactaggctccttctgatactgtctgagcaagggggatggggaacctccttacaggctgacaagggtacaactccaggctctcatttggtctttttgggtggggttagggtcacagattgttgtgcagtgtttttctggaggaggacagttataatgtaaaaatgttctttctgccttttcctggacctttggctaaagaagacaggctttagttagggctgttcttgtgtgcctctgttgatgtttctgagttttgggcttgttcagcttcaaccctggaatatttgaagcaaaagaaaacctagagaagttactgctatgttgttccttgggtcccagggtcactagttgttttaactgcttccttccaacttttagagtattctcatgcttgttttatatataatgcccaggggttttatttgtacatagtaggaagaattgagaaaatctcttctacttcatgttcttggaagtggaagtacgtgggttttccttttgccttttctgatttgtttagcacttggcatttagcacttggcattttgttctggaatctgagacattattgcctctaatatttgagagatatcattccaagctacaaattctggctggcaaagtcactgtaaacataaagttggcagtagtcacagtctgaatgcaaaggctgccagtcttgtcctaagtgcaggcatgtatggcaaagactagtcaatttgaaaaataataatatttgtcatcaccaaaatatttactgtgtgtgaaccactgtatccatcattcttaatagtagcaataataatgcaaacaacaataataattgctaccatagtaaaatgcatttttaaaagtagtttgagtatatcatgtcatttaattctcacatctaccacttttatatgcatgcttttctgtacctgtgtgatcatttagttatctatcaggctctgttctaggaaatactagacataaagcagaacaggatagcctaggtctctgttctcatgaagaagtcagaaagcaacatttcagatagagaaacatgccttaaggacaataaaaacttaagatgtggcagagaatgcttgaggtagtaaggactcctttatgggctagtcgaggcagacctgtgcaacatagtcatttgtcaaacatcaatgcttttgatgattactcgtaactttaaatgtaaaacctaaaggcacatttatatcctcaaaaaggcaagcttttgctttctattggaatcatagtttcatttcagatatttcatagggtagtcatgtagtgtaaggtgtaaaatgttagaaccctgagtctaaatcactgcctgcccatgtgctctttgtggaggattgtgcttatcagaaatatataacttactgcgttttcagggccctcatatcaaagtccaagtaaacatataattgacagtattagagaattaatttttctagtgtttaatctctctattcatagtctcctatttttgtaaagaagaaaacaaaacagctttcattaaagaagacacagaatagctccctaagtgataaattgattggatggttgttgggttttaatagagaatatacattcaacttcacaattattggttactgttaaaaataagatcagcactagctatttattgagcatctacaatatattctacactgcattatattctttatgtatatttcattttatctttacaattttgttggacaagagttgattcatatctccacttagaaacaaggaaaaagggccgggcgctgtggcttatgccagtaaacacagaactttgggaggccgaggcgggcagatcacgagggtcaggagattgaggcaatcctggctaacactgtgaaacccgtctctaccaaaaatacaaaaaattagccaggtgtggtggtacgtgcctgttgtcccagctacttaggtggctgagggaggagaatcgcttgaacccgggaggtggaggttgcagtgagccgagatcgcgcctctgtactccagcctggtgacacagctaggctctgcctcataaaagaaagaaagaaaagaaaagatgaggaaaaagaaacaaagagcgtaaattgcttttttctactttcatcccccctaacacagaacaattcctctgctcatctctggccttttttcagtgcctagagggcttaccactattgactgcaccacccagagtttttttttttttttttgctgacttgtttctggttgtctaattgggtttggccaaagggtgattcctgcaagagatcagaagagaagagaagaaaaataccagggtatttattttctgccatagtagtgactggggttggtcactccataaccgtagctcctgtcagtcaacacttcttccaaggctcctcttctcatcagactgtaactccctatttcttctctcttgccctaatccttagggatagtaaaggtttcttgctgctgctgctgctgctgctgctgctgctgggttccggagtgcttcattattccttgttaattcccctaacctatcatacctccctttattacattatctttggaattccatctttcctattattcctatttcctatccataatttcctattattttctttgaggaccctatggacacagagagattatgcagttaaattgcacaattagtacatgagaaacctagaattctagcctagaatccccaggctgcctgattccaaagctcatgcttttttttttttgctttttttttttaactaaaagtaagctgtgcttcccaatccctaaaacattaaatgatcacctaaattatggaaagagttaatgacttacctaaaatgagcattataaacttaaaaagtaatttttaaactggtcagttttttagaaatgtgccctgtacagatgcagaagcagaaaaccagcacaaacagatgtaacaaagaacgtgggaaattcttttgatgtgttctcaataccaaatttgtccccaattagaaacctttctaatcattatggatgttcaatgtagtagttttgttttaattaaactttattggatctgtaatcattataatgtagtttaaaggctttggccatttaagactttaagtattttatggttatgtcttatgatgatcacaacacctcttttcactgcagacattaatatgattgaccctggctcccatgatttgctttcatctgggggacacagctcccatcacggtcaattatctcacagtaattccagcgacaaaagcaactttttctcaattaagcaattattttttagacggagtctcactctgtctcccagggtggagtgcagtggtgcatctccgctcactgcaagcgcccttcacgccattctcctgcctcagcctcctgcgtagctgggactacaggcgcccgccaccacacccggctagtttttcgtatttttttagtagagacggggtttcacagtgttagccaggatggtcttgatctcctgacctcgtgatccgcccgcctcggcctcaaagtgctaggaatacaggcgtgagtcatggcgcctggcctcaattaaacaattttctaataaccttcttggactggagaatatagcatggcacatactaatatggctgcttttgttgaaattgctgctgtatgtgggtaactcatacatactgtgaagtttttcctgagattgaacaatttaaacaaattaatatcacaaagccaattttatatttgagacacttggaggatgaattaagatcgactcctattcctggcctcatgcttggtgcagataagacaaacttgcacataaaatccagttctccctgctgctccccaggcttgctcagctgagatgctcagaattcctgcaaagtacatattaagaacactacacccccatgtggtggcaaaaatattcctgggaaatcatggattttataaatcatgttatttgtaaattttctagtccctctgaacatgtcattaaacttgtaaaactgtagactcgtaaaaataactttaaaaaatattctgtgcataaaattgttaaaatccgtttgtcaaatctaacttttttcttggcttaatatagtcatatcaactagagaaaagagaaggaaaccataaattagacaaacagcaggtgtccaaagtctttttatttactcatcaaaataatattttatgccttatcaaaggtgatagaaaaatatgatcaactgtgaatcagaagacatggtttctagatgccttggccttcttcttgtcagttatttggccttggacattgtttttagcttcagcatccttatctgcaaaacaagggcatgatttctattttaatttgtcattttaaaaaatgtcaagtatagagtaatattttgttaaattatgctttaaatcctcttaattataccatgcaatttccagctagaaaatgttaaactgtacaaccagctaattaaaaatttcagaggctctgtatgctgcattttgaaacactatctttaaaattatttttacatgcatgctgtgtattttaaaactaaaatgatatacaaacacctataaatttatatttataggaaatatatgtaaagaatggagagaaagggagagcaatgcctgagtcagctgtgttctcttctaaaatttctctagctcttttatgttgctgtgtattgggtcttactctcttgttcaattttgtacatacagatttttaaaattttagtctccactcaacttagggtaaaacctgatcctttgatatccataatgcattcaccccatcagactagatggtttggtattacttggctcttttattgatgccccatttattctatagaggtattttgagaatcagacaagatgtgagaaagagcttctcataaagcatatgcaaatggaaagtattattattaatattcagctagacactggttccaggacattatttattactgttactgctttaaaatagaaaaacaaatgaaaacacttagagaccaaagttagaaagcaggagggtgggaatagaacagagaaggctactcaggaaataactacctcttgaatatttcctggacgcctttggatttaacactttacagtgccgtttgacaagtaaaattgagaagtttaaaaaaaaattatgaagaagaagagagtctcaaaattatctttcctctagacgtaagaaattgatagaggattacaaataaagccttgagtgtggagaaagacagcagaaaagaagcctccactgattgtcctcgtaagaggaacaccaaattttaacagctgtctacatacaaaaatgcaccttcataagaataaaaaatcaggtgagcaatcacaatacctggttttaattttatattactgaaagaggcactgaagaggctgggaaagacacccctcttccacccctcttccaacctccggcagcagctgcatggtgccaagagagaatctgtgcacttgggggaggaagagcacagcagctggagggatttgcattgaactcagtgctgcccagtcccacagagaaagcatctggaccagaacagcaagagaggaagagcccttcccagcatttagaatttgaatttcttagcaaggctcgccaccatgagataaagtgctctgggatcataaatgaacttgaaaggcagtctgggacacaaggactgtaattcttaggcaagccttgaggccgttgtgggcctagagccagtggactggggcaatgtgtgacctagtgagacaccagatgggatggctcagggagtacttgtgccatcctcgcctccaggcagtgcagcttctagcaatgaaagtgactcctttcctctgcttgagaagaggagaagagtaaagaggacgttgtcttgcatcttggataccagcttaggcacactaggatggggtgacaggcagctagcccccataccaggcccgagctcccagacaacatttctagacacattctgggccagaagggaacccacctgccttgaagggaaggatgtagtcctggcagtatatgtcacctgatggctaaagtgcccttgggccctgaataaccaacagtaatagccaggtagtatgctttgggccttaggttggactgagatgtgctggcctcagggaccagcttggctacagtaggatagaacaccaagcaggctattggggttcctgagtccaggccaaggctcttggacagcatttctggacattccctgggccagaggagagccttctgtcctgaagggtgagtctcagatctgacagcatcctccacaagctgactgaagagcccctgagtctaagaaaatgttggcagtggcctgccagaatgccccatgggccagtggtggtggtgatgatcatggagagagcctcctttgcctgtggaaaagagaggaaagagggggaaggactttgtgttgtttgagggccagcttagtgacagtagaatagaataccaggaaaattttgatggttttttttacttcagtccctggctttcagatagcatcactgaaacttcttgagcctagagcaacttgtcacactgaagggaagaacacaaacctgaatggctttgccatctgctgattctagagccttaggacctcatatgaacacaggtggtagccaagcagtggttacagtggtcttggacaaggtacagtgctctattctcttcagatctgacccagggcagttccagtcgtcatggctatagtggtgcttgtgttaccctacccccagctccaggtggctcagcgcaaagagagagactctgtttgggagaaaatgaagagagcaagagagcaagagtatctgcctggtaatccagagaattcttctgaattttatccaagaccaccatagtggtacctctgtgagtctccaggaagcacagcattactgagattggggcccaagtctctttgaatacttggaaagacttcccaagaaagacaggtacaaacaagcataaaattgtgaagaatacaagaaatcccgagctcttcaatgcccagacaatgacaaacatccataaacatcaaaacctccaggaaaacatgacttgaacaaaacaccagtgactaaacccagagtgacaaaaatatgtaacctttcagacaatccaaaatagcttctttgaggaagctcaatctaattcaagaaaatacggagaaggaattcacaatcctattagacaaacttaacagagactgaataattaaaaagaagcaagcagaaattctggagctgaaaaattcaactgacatactaaagaatgcatcacagcatctcaacagcagaattgatcaaaaagaagaaagaaatcgtgagcttgaagacaggctatttgaaaattcacagtcagaggaaacaaacatacaaaaaagaatgaagcatgcctaagatgtagaaataccctcataagggtaaatctaagtattattagccttaaattggaggaagatagagagtttggggtagaaagtgtattcaaagagatagtaacagagaacttcccaaatctagagaaagatataaacattcaagtcctagaaggttacagaataccaagcagatttaacccaaagaagactacctcaagacatttaaaaattaaactaccaaaagtcaaggataaataaaaaatcataggccgggcatggtggctcacgcctgtaatcccagcactttaggaggctgaggcaggcggatcacctgaggtcaggagtgctagaccagcctgaccaacatggagaaaccccgtctctactaaaaatagaaaaaattagccaggtgtggtgatgcatcctgtaatcccagctactcaggaggctgaggtaggagaatcgcttgaacccaggaggcagaggttgcagtgagccgaaattgcaccattgcactccagcctgggcaacaagagctaaactctgtctctaaataaataaataaataaataaaatataataaaaaataaaaaatcataaaaacaacaaaagaaaagacacaaataacatacaaaggagctccaatatgtctggtaacatacttttcaatgggaaccttataggccgggagagagtggcatgacatatttaaagtgctgcagggggaaaaaaattaccctagaatagtttatccgcaaaaatatctttcaagcatgaaggagaaataaagaccttcccagacaaacaaaagctgagggatttcattaacaccagatctgtcttacaagaaatgctaaagggagttcttcaacctgaaggaaacggatgttaatgagcagtaagaaatcttccaaaagtacaaaactcactggtaatagtaagcacacagaaaaacacagaatattataacactgcaactgtggcatgcaaactactaatatcttaagtagaaagatgaaacaatgaactaataaaaaataatagctgcaacttttcaagacatagacaatacagtaagacataaacagaaacagcaaaaagataaaaagcagggagacaaagttaaaatgatccattttttattagtttttaaatttatttttaatttttgttggtacatagtagtgtatatatttatggaattcaagagatgttttgatacaggcatacaatgaataatagtcacatcttggagaatagggtatccatctgtcacgagatacttggggtatcgtttttccagctggaaacctctttgactagtggtacctttgcccaagttttgcttgggcccactgggtttgttctgcccatctggcctggcaggctgcacttgagccaggttgagccaggcacagaatggcaaggggtgtgtgagcaagtgagcatggggtccaggcactgcgcaaagctaggcacaccagctgtggtggggagggcagctccaggtgtcagcgtgcgtgctggcttcctgcgagcctgtggttgaaccaggtgtaccacaagtggctttcacggtgggcaccggggaacatggtggcacttggaagcttggagatgccagaaaccatagagcctcaaagagggtttggcagccctggctccggaagcgtctacatccaggctccccaaagggctggagctcttctctccttctctcttctcttcttctcattgtccacaacatggcaggcaaaggatgtgtttcagccctgtttgtgttacagctctttcagctccacaatttggtgggtcctgagttcttgtcccctgtctaggtacacagacaagcggaggatgatcaaggtgaagaggtgctttactgagtgacagaacagctcagaggagacctgcagtgggtagctcctctctgcaggcaggtcatcctgatgagtgtccagctctcagcagggaggaaacccacagtgggtagctcccctccacagacaaggtgtcgtgtcaagtgttcagctttcagcagagattggacccacagtgggtagctcctgtccgcaggtaggttgtcctggcatctgttcagctcccagcagagaagagactcaccttgggaagctcctctctgcaggcagagtgtcctgagtgttcagctctaagcaaagaggagacccacagtggggagctcctctccacaggcaggtcatcctgacatctgcccaagtccggcgaagtctggggtttttatgggctaaagagtggaggaagtgcatgctgattggtccacaggcagtgatgggtggggtgggaaaaagcaccatgtgttttcactcttgtccatggaactggtagcctggtccccaggcttcaggctgtcccaggcctgatggtagggcttcactagggacctgctcctttctgcccaggagcttatctgcctcctgctgccatcaacctgctgtctatcgatggtgcccacggcacacaggctgttcatgccaagcggtgcctgcaggctcttgccgagctgccctcagccccacctcggcatcctttctgtgctggtcagcagccaaagtccagagggggctgagtcagcaggggctggcatgtcagtgctgccctgagcatgtgcacacccagttgggttgtgacagcacctgggcttggcctcaattttcctctgaaatcaaagtgggtgccaggagtggggagagaccagggagcgggagcaggcacttcggagcctgcaagggcagaggggcttcctggacacccaacagtgcagagatacctgggcccataaccacccctgggtggctgcagctgcatcctgggaggtgaggcttctgcctgctccctgcccccaagagcacagggatgcccaggtgttgaaccattgctgggtggctgcagctgcacccagggagcatgaggctcctactctgccaactcggaaggagttgggtcttctgcctgttcccagctcccactggctccatggagtacacagccccagctgtacctcccctattgcagttggcgttatggcagtagctgctccagccaggccaccactgccatcagattctctcaaacatttatcctttgtgttacaatcccgttacactcttttaatcattttaaaatgtgcaatgaagttattcttgactatattcaccttgctgggctatcaatagtaggtcttattctttctaaatagttttctttttccttattagtttgtttatgtaatcagtgataaattatcatacgaatgggttataagatagtacttgcaagcctcatggtaacttcacatcaaaaaacatacaacagatacataaacacacaaattagaaattaaatcataccaccagagaaaatcactttcactacaaggaaggcagaaatgaaggaaagaaagaagagaagaacacaaaacaacccaaaaacaaataacaaaatagcaggagtaagatcttgctcatcagtaataacatcaaagataaatgaactaagctttccaatgaaaagacatagaatggctgaatgcataaaaagcaagactcatttatctgttccctataagaaacacacttcctttctaaagaaacacatagaataaaaatagaaaaagatattccatgctaatggaaaccaaaaaaagagcagtagtagctatactaatatcagacaaaatagacttcaagacaaaaactgtaaggagaaacaaggaaggtaattatataatgataaaggggtccgtacagcaagaggatatgacaattgtgaatatatatgcagccaatgcttgagcacccagatatgtaaagcaaatattcatcagagctaaataaagagatagacctcagtacaataatagctggagacttcaacactccactgtcaacattggacagatctcccagaaagaaaatcaacaaagagacatcagacttaacctgcactttaggacaaatggacctaatagatatttacaaaacatttcatccagtggccaaaaatacacattattttcctcagcgcacagataattctcaaagaccatatgttaggtcacaaaacaagccttaaaacatttaaaaaattgaaataatagtattcatcttctctgattacaatgaaaacaaactagaaatcaaaggacgaattttgaaacattacaacacatggaaattaaacaatgtgcttctgaatgatcagtgtatgaatgaagacatttagaaggaaaccgaaaatttttttgaaagaaatgataatggaaacacaacataccaaaacctatgggatacagtgaaagcagtactaagtgggaaatttatagctataagtgcctacctcaaaaaaagagaaaaacttcaaattatttaatgatacaccttcaagaactagaatagcaagagcagaccaaacccaaaattagtaaaagaaaagtaataataaagatacaagcacaaataaatgaaattgaaacaaagaaaacaatgcaaaagataaatgaaattaaagatgtttttgaaaagataaatgcaattaacaaacctttatccagactaagagcaaaagagagaagacccaaataaataaaatcagagatgaaaagaaaacattaaaactgatattgccaaaattcaaaagatcattagtggctaccatgagcaactatatgtcaataaactggtaaatctagaggcaatgtatacattcctagacacatagaacctaccaatattgaactattaagaaatccaaaacctgaacagagcaatgacaagtaacaagataaaattcataattaaaagtctcccataaagaaaaacctggtacccaatggtttcactacttaattctaccaagatttaaagaagtaataccaattctactcaaagtattccaaaaaaaaagaagagaaaggaatacttccaatttcattctatacggccagtattaacctcatacaaaaatcagacagacacatcaataaaactgtacactaatattcctgatgaatattgatgcaaaaatactcagcaaaatactagcaaaccaaattaagcaatatgttaagaatatcattcatgatgaccaagtgggatttatcccagtgacacaaggacgtttcaacatatacaaatcaatcattgtgatacaccatataaacagaatgaaggacaaaaaccacatgatcttttcaattgatgctaaaaagcatttgataaaattcaacatctcttcatgataaaaaccctcaaaaaactgggtatagaaggaacatactacaacataataaaagtcatatatgtcagacacaaagctagtatcataatgaatggggaaaaactgaaagcctttcctctaagatctgcaacatgataaggatgctcactttcatcactgttattcagcatagtactggaactccttagctacagcaatcagacaatagaaagatataaaaggcattcaagttggaaaagcagataccaaattatccttgtttgtagatgatataatcttacatggggaaaaaccaaatgactccaccgaaagagctatcggaactgataaattcaataaaattgaagaatacaaaatcaacatacaaaaatcggtagcatttctatatggcaacactgaacaatcagaaaaagatatttaaaagtaatcccatttgtagtagccataaataaaattaaatatctaggaattagtcaaagaagcaaaagatctccacaatgaaaagtataaaacactgatgaaagaaatttaagagaacacaaaaacataaaaagatattccatgttcatggattggaagaatcaatgttgttaaaatgtccataccagccaaagcaatctacagattcaatgcaatccctatcaaaatagcaatgatattcttcacataaatagaaaaaaatcctaaaatttatatgaaatcacaaaagacctgaatagccaaaactattctgagcaaaagaacaaaactggaggaatcacattacctgacttcaaattgtactacagagttatagtaaccacaatagcacggtactgccataaaagcagatgcatagactgatactgtttggctctgggtcctcagccaaatcttatctcaaattgtaatcttcagctggtgttgagggagggaactgggtgacaggtgattggtttatgggggcagttttccccatgctgttatccggatagtgagtgagttctcatgagacctgatggttttgtaagtgtttgacagttcctccttcacatactcgatctcacctgccaccacataagacatgcctgcttccccttccaccatgactgtaagtttcctgaggcctccccagtcatgcggaactgtgagtcacttataagttacccagtctcaggcagttctttatagcagtgtaagaacagactaatacatagaccaatagaacagaatagagaacaaagaaataaatccatacacctacagtgaagtcattttcaacaaaggtgccaagaacatacactgggggaaggacagtcttttcaatgaatggtgccaggaaaactggatatccatatgcaaaagaataaaactagactactgtctctcatcgtatacaaaaatcaaatcaaaatggattagaggcttaaatctaagacctcagtctttgcaactactacaaggaaacataagggaaaccctccaggacattgatctgtgcaaagatgtcttgactaatatcttacaagcacaggcaaccaaagcaaaaatggacaaatgcaatcacatcaagttaaaaagcttctcaacagcaaaggaagcaatcaacaaagtgaagagaaaacccacagaatgggagaaaatatttgcaaactacacatctaacaagatattaataacctgaatatataaggagctcaaacaactctatagaaaacattcaataatttgattaaaaatgggcaaaagatttgaatagacatttcttaaaagaaaacatacaaatggtaaagaggtatatgaaaaggtgctcaacatcattgatcatcagagaaatgcaaatcaaaactacaatgagatatcatctcaccccagttaaaatggcttttatccaaaaggcaggcaataacaaatgctggagaggatcagtggaaaagagaactctcctacattgttagtgggaatgtaaattagtacaacctctttggagaacattttagagttcctaaaaaaaactaaatatagagctaccatataatccagcaatcgtactgctcgctatatactgaaaagaaaggaaacaggaatatcgaaaagatatctgcacttccatgtttactgcagcactcttcacaatagccaaggtttgggagtagcctaagtgttcatgaacagatcaattgataaagaaaatgtggtacatatacacaatggagtactgttcaactataaaaaggaatgagatcctgacacttcaaataacatggatagaattggaggtcattatattaagtgaaataggccaggcacagaaagaaaaccttagcatggtctcacttttttgtgggagctaaaaattaaaacaattgaacttactgtttaaattcaattgagattagaaggatagttaccagagactgggaagggtagtgagggttaatggggggatgtagagatggttaatggttaaaaaaatagaaaaaatagaaaagttagaaagaatgaataaaagatggtatttgatagcacagcaaggtgactgtagtcaataataatttaattgcacatttaaaaataactaaaaagtataattcgattgtttgtaacacaagggataaaggcttgaggggatagatacttcatttaccgtgatgtgattataaagtattgcataactacattaaagtatctcatgtaccccataaatatatgtgcctactatatacccacaaaaaataaaaattaggaaaaaaaataaagctttgtcctaaaatgtttactcaatcattgtcttaatgctatttaacaaagtttgataaacagtaagtgagtcttaaggaaggtttttgagtgctgtacataactttagggaaggatcactgcagccattatgagaaagactgcagattgggtgaaactggaggataaatagtagcagtcctgttagaaactccaggaaaggcagtgagtggcagaacatgctatccaatcatcatgaaaacactgcagtttctaagcctccaccttacaggaaagttcagaaacaagggcatagaaaattgatttgcaaggtgctgtgccaagattatttcttttgcatgtctctctttgtttcacttccttgcattattttctgagtgattctgtagacaaggcatagggatgaattcattctggatttaaaaactctatttgatagcaccatcttctgttctggtcttagtgaggaaaacagagcttccctgagtcgccatgatatcatttagtgatgaggctggaaaaggaccataatatgaggaaaccctggaggatcaaatctgctaactttgatacatttgtttattgagtcaacatacattattatgtgatgctactgtttctaggtttctgctaggtgattgaagagcaaaatgtttggacgaaataatgacaatcttccctttctcatggaggtcccactgtagtaggagagataagtaatcaaataattttaactgtattatttagtatatgacatacacctataaatctatatttataataaatatacacaagtagtagagggaaacattgtatatacgttataaaatgtattataactacattatacattggaatactaagaaaagtaatataaatgaaagagaaaatgcactcaaaggtatgaatgtatgtggagaatgactcaggaccacaggcatgcattttattaccctgattgatattattaggtcgcagtgacagagacatttctgaaagtagcgcatacctactttatttattcagtaagtagtttttgaacacctgttgtgttccaagtaatgtgcctcatgttgaatataggtcgtagtacttacataggaggctcttgctttctgaccctctctcagcagagaaagtgagaagtgtaatggggaaagacccccattatttgtgactgattttgttttactatttttgtttttacctgctggctactttgtcctttatctggatgtgtcttgtggagattgatgtggtttcttcttcttctttttttttttttttttttttttttgagacatattcacactctgtcacccaggctggaatgcagtggctcagtctcagctcattcaacctctacctccctggttcaactgattcttatgcctcagtctcccaagtaactgggactacaggcatgcaccatcacacccagctaatttttttttttttgtaagtagagacagggtttcaccatattggccaggctggtcttgaactcctagcctcaagtgatccacctgtctcggcctcccaaagtgctgggattacaggcatgagccactgtgccaggtcagtttctcccttcttcacattcccacataattttgtatgaaccactagtttaatggatgttctgcaatttatcttccagtggtgagggccttcaagtatttgtgaatgtactatgatgtgcaggaactcagatagaaattggacacagaaaaataaattaggcatatattctttagacacaaggctcagaatattatagaggaaatacacatataggtgcataattgccatactaagtgaggtggtagagatatatattgggtaaagaggtggaacagagggaataagcatttatttcttcctcatagtagagatggagtagagagagggatttcagaaaaactttgtagtggagctatgagagtttagaaagaataaattaattatttagagaaggaaaggccttctgtgcatagggaacagcatttgcaaaggcacagaggcacaggacaagtaattggatttggctagagtaggacatgagttaaaaagacagaattcaaaccataggaatctggagcacgccaggtcagacactaagcagaagaaaagagaacaatggagtcttatggagaagcaatagaaagtacagaagccccctaatggaaaacttaccagagacacttgccaagagtcaatctagaaaaaggacatggctctactcctggggtactggggcatgagtgaatgtgggtcacatttaaggcagcctgataatgcctgctgcaaaaaagtcattgtttctcctgtgttggttctttgagtctcattagtgaacatctcagtgcacagacactctaattagattggtttgggttcctagattagatctgaatttttacaaatgtttcttcccaccaaagccattactcttcaaaagccggagcagtgcacagacttacttcagagaattttcctggcccccgggaccctaattaaaggaaggtctagacaaagaggagagctttgcctatctttctgaacatagggtggtggtgtcacagagcgatttttactgccagttaactttgtgtctatggtagttcttttgaggattttctgcaactgtctgccctattgctgctgcaatggaaatattcaattgaggcagctcttatcaatgggtggaatgcttcagaagagattggttatggctcattggagctttattcagatcttacaggaagaaggcctaacaatggaattgatgttttttgggggaagccagtgtttacatgagtggacggaaggcggaacagagaaatagggagctcagtgctctatcttagaagcttgttataaaagtgatcagtcatcctgtagtttctagtagttctttctagctgtatttagctattaacttctggaatgtcctagcttggaattgataattttgtggctttcagaatttctacgttttcttataataaaaccaaatggttagttctatatatctgtggtttatgatacttcattattttccatatggtcaggatagaccaactatcttcttatgagtgttcaagtgagtagttggttttattattctaatttttcaggtacaaaattgagggcttagggtagttacagtttatatcacttgttctataggcaactgggggagctgggataaaaaccaaacttcttctatgactaatgttaagtaaaatttgaataagttcagaatgaatcatgatgatgatatattttatctttaagaatatttcctagttttgtccacttaaaagagctagaagtaatgatagcatagtagatatgaacatctgtagtgtttccagtgtggtttccaaataccatttcctaataaaaggtaacagatcttcttgggaaaaaaaatgattttcaagaaaaagacttattctaggtcttaggtaggaaaatgacaagatggaactgaaatattttgttatgtcagaaagcaattaacctatccaccaagatatggagtgtcatcataaaaggactcgaaagcctaccagcttccactggtcaaaataaggcaatctgagcatcaataaagataataattataatgggttaaaacataataaaaatgtttagatccatgatttcataaagatattatttaaaaatcacctgattactagatttggaaatactagggaacctattttttgttttgaaaacgaatcaataggaagaataaaacatttaccttgttggttctatacaatttcaaattcaaggttaccaaataagtgaaatgaaatttctctttatagtggtcttgtacctaatcaattatgaaggaataatagaatatcaccattttaaattactagatctgcaaaatatttgtccatggttacaacatcataaaaagacaattagacatcatgtgacttctaatggaagtatacctaacaactcatgaggagtcttgcgtaaaatattgctcctcagtttgatcaaatctagatttaacttccaattcatgggagatatagggaaccataacataagataatatgatcagaaaaaaattatactgtcagaagcactacaggagaatttttttttatttaaaaaaagcatatttttaaacaaatacattgcaagaggagagtgatagaatgaggagatcctgtagattaaaagaaacgtaagagacatgcaaaccatatatagccttgttttgcagcctgatctgaacaaactttttttctcatcatacatttatttatttatttttaaattgacacaaaattgtatgtatttatgtgaaccatgcgatgttttaaagtatacatacatcgtagaatgattaaatctagctaattaacatatgcattacctcacatagttatcatttctgtgatgagaatactttacaccaactctcttggcttttttcaaaaatacaatgtattattaactatagtcaacatgttgtacaagagatctgttgaaatttactcctcctatctgaaattttttatactttgaccaacatctccccaacggccaccacatcaccccagtctctagtaaccaccagtctactctctatttatataagatcatttttttgagcaagctttttttttaaattggaaaaccaagaaatgttgaatcttcattaactatttcatgattttaaagaatttttgttggtactagagttatttttaaaagcaagagtctttatatgtagatcttcttaaaatatttacagatgaagtgaaatgatgtctgattttgcttcaaaataatctgagggagtggttaggagtatagatgacataaagttggttgcaagttgatcattattgaagatgaatgaggaggtacacagtcttattttaatgtatttgaaattttccttaatacaaagaatgagagaggacccagatatttctgactccacggacaatgttcttattttatgttctatactcttgtttaatttatttatttatttatttatttatttatttatttatttatttattttgaggtggagtttcgctcttgttgcccaggctgaaatgcaatggtgcaatctcggctcactgaaacctccaccacccgggatcaagcaattatgcctcagcctcctgagtagctgggattacaggtgcctgccaccatgctcagctaagcttttttttttttttttttttttttttttgcatttttagtagagatggggtttcactatattggccaggctggtcttgaactcctgacctcaggcgatccacccgcctcagcctcccaaagtgctgggattataggtgtgagccactgtgcccagcctatacccttatttttaataagctcattgttaagggttaccagacaaaataagaattacaagcacccatgctagaaaactccatttgcttcccaactcccttagccatagcttatacctaagcagattttatatgatgggagcttaacatatatgtttactgagctaaataatagctatataggtgaaacatacagataccaataattatttgacatgttgaacatgtatggaggaaaaactctgaaacaggaatcaaaaacctttaattctgactctagatcagttgcattagagttgagacattttaggcttctctgagtttgagtaggaatagtaattacctttatagatcttttgagaggctccagtgaaatattgtatgtaaacatctctactaaagctatagtgttatatcagtgtaagatactcttattgattagtacaaaatttagatgccatgagaccgcagagaaggaaatgattctcacaaactttggagctctgaagatttcatggatgagcaagtacataagttgaaccttggagaacagaaaatgcttagtctggcagaaaggatgctacagaaagagaacacagaaagatcaaggattcagagtaggaatgaatttagcatttaaggggcacagggtgatggagtcagacagtgtcagaactgaaagggatcttagaaattgtccagaacaaatactttatttaagtgttgagaaaactaaggccgtgataggataagtgttttacccaggatgaaaatagctagtaagtgactgagccaacgacttcaaatcacatcatttttcctcctatgaaagcttcctcttagtagtaaaatttagactactagagctgaggatgtaagattgattaagcagggtgagatcaattgattttttttaagtctttgactgttagattttagatattatctcttatgtaattgagagtcttggtagattttaagcaagagagttataggaagaagcagtgggttgagaataatgtgcttcatacataggaaggactaaaggttgaaacagcaagatgctacacgatgctactgcagtttctcatatgtgaggatgaggactgccagaaaggtacgctgatgctggtgggatagagaaaaagagtgacactcttaagaggaaaattaaaagtgatcaatgacagatccaaaataactatataggaccatgtaggactgtaagtgtattcatatattataaaattttgcaaagaagagtgtaaagaagatatgttttttatgatagagccatccctatcccactcctccatgtaatagatatttcacaaacagtgagaaacctgagattcagagagaagagttgatttattcaagttctcataggtggcaaatgattgagtcaaaactcaagtctagtgccatttccacaacctaggatttcttaacccgggattcatagatcttccaggagttaatgactaagcttcagttattcactaagccctatagagatatacgcaaatattttgaattactcattttaatgtgtgtgtgtgtgtgtgtgtgtgtgtggtaggggtagttagtgggaaagagaatgtgtgtatgtaggtgggtgggtaggaagccagtgggaaagaatgttcataacttttactaaatcctcaaagttatctttgattccccaaaacttaaaaacttaaaggtacctagtgatatatttaaagcaatattattttggataaatatttaatcaagttatatttctctcctctcaaaagtttgtctttcccatctaatccaccccggatagtatcttggagtgtggggaagtttacatgtctttataatgggagtaaacacctgggctacatgtgtgtgtctgttacccgtggggttttgcaggtatccatggaagtgtttcttgtcttgatttccaagaatcatactgatattgtcaagtgaagattgtggctgctaatggtattccaagcatcttcttttggcatggctagagatcgatgacttggctctatcttgattcctatttgggcttcaattctgcttcttgcatcctaggtctgtcctccatccagcctctgtcttagaccctgccctctgccatctctgttgtatatcactatagaagctgcatgggtaggcttggaatctctcgactactaaaagttgttcagcactgaggacatggaaatatcttgtttccttccatactacatggctgcaaagagtaattttggggtgacatctctggtccactctaaacatgaatattctttaaaatcatttttgtctcaactataactactgcggttgtcagagggtctcagtcttcaatttgtgtctcctaaagaggagcaataacatttcataagattgtggtaataagaagtagtatgtttataaatgtcttagaatactttctggcacttaaaggacaatttctattattattattatattattattttattatcatgtattaggtcgttttcctcttagtattcttgatgctaccacaaagcttgaaacagaatagaaacttagtaaatatttgattaatgaatgaaatcaactcagggaggaggtcctatgtggtgctaaaataacagcaaaaagcaatcagaaaacccttaactaacttctcagtttacctacaggtattccagaaaatatatgtttggtatgtcaaaactactaaaatatctgtgtttcaaattatattctccagaagtatatactgtctgaagaaactagatagtttctgaatgttttctacaaactatttgtttactttgtgacactaacttacattcaaaagataccttgttttgtatttttatattctgtgctccatccacatttggtagttccaaacttagattgaaattacttagaaagtatacacacacacacacacacacacacacacacattaagttatgatgaacttttggcagacaatgaagtcttgtcgctttttttttttttttttgtacaatcctggagtaaagcacttcacaattcatagcttgactctatcctttatgttccttgcttttagctactcagccgttctaaacaactgagcagttgccatctagtgggaaaaaactataatggcataaaggaagctgaattcaaaacaatcattaagatgaatatacctggaagaaggaagttaaatccatccacaaattttgcgataatagtatcatttgttactaaatgtgtatattggagctatagggaaatatctgaattttaaaaatgttttcaattcaatgtaagagaaaattataaccacaataagatgtcaccacatacctattagaatgatacaacaacaacaataacaaatgacagtaccaaatgtggataaggatgttaggcaatcagaattcacacacactgctgatgagaatgaaaaaatgttacagccactcaggaaaacagtttggcagtttcttataaagttaaacataaacttaccataaatccagcaatctgagaaatatatctttgttccagttcttacaggaaatgttttcaactttttcctattcagtgtgatgtttcctgtgtgtatattatatatggcctatatttttttgaggtatgttgcttctatgtatagttttttaatttttttatcatgaagtcatgctgaattttattaaatgctttttctttgtctattgagatgatcatatcgtttttgtcttaattttatgtgatgtatcatatttattaatttgagaatattgagccatctttgcatccctagcataaaaaccatttgatcatggtgtataatctttttgatgtgatgttggattgggtttgctagtaatgaacaaagatttttgcatctttgttcattaggaaaattggtttataattttctatttttgttgtgtccttgcctcgttttggtatcaggatgatactggcatggtagaatgtattaggaagaattttctcttctttgatttgaacgattttaggaggattggtattagttcttctttgtatatctggtagaatttggttgtgaatatcacaatctggtcctggtcctggtcctgggcttttttttttgttgagagattgttttgttattgatcctatcttattattgatctgttcagattttctatttcttcctggctcaatacggggaggttgtacatttccagaaatttatccatttcctctaagttttctattttatgagcatgtagttgttcataatagtctctgatgaactttcatgtttctgtggcattaattttaatgtctcctttttcatttctgattttgtttatttggttattctctcctcttggttagtctagctagaagtttatcagttttgcctctctcctatttaacatagcactggaagtcctagccagaacgatcaggcaagagaaagaaagaaaaggcatccaaattggaaaggaggaagtcaagttattcctgtttgctgatgatatgatcttgtatttagaaaaaactaatgactccacaaaaaaactcctagatttgataagtgaatttagtaaagttgtaggatataaaatcaatgtataaaaataagtagcatttgtagaaaccaaaagatctagcagataaagaaataaagaaagcagtattatttacaatagcaacaaaaaaagagtacctgagaataaatttcacaaaaaaagttatattagggttctccagagggaccgaactaataggatatgtgtgtgtgtatatatacatatatatgtgtgtgtgtgtgtgtgtgcgcacatatatatatatgagaaagggaatttattaaggagaattactcacacaatcacaacgtgaagtcccacagtaggccatctgcaagttgaggggcaaggaagccagtagtggctcagtctgagtcccaaaacctcaaaagtagggaagccgacagtgcaggctttcatcagtggctgaaggcctgagagcccctggcaaaccactggcgtaggttcaagagtccaaaaaccaaagaacttggagtctgatgttcaagagcaggaagcatccctcacaggagaaatagaaaggcgggaagactcagcaagtcagcttctttcaccttcttctgcctgctttctctagccatgctgatagttgattggatggtgctcacacataatgggagtgggtcttcttgagggtgagtcttcctctctcagttcactgactcaaatgttaatctcttctggcaacacccagatacatccaaaaacaataatttccctccttcaatccaatcagcttgacacaatattaaccatcacagaaggtgaaagatgtctacaaggaaaactacaaaacaatgatgaaataaattgtagataacacaaataaaaaatctcattctcacggactggaagaattaatattgttaacatgactatactgctcaaagcaatctacagattcaatgcattttttatcaaaataccaacaattttgcacagaattagaaaaagcaatttaaaaattttatggaatcaaaaatgaaccagaagactcaaaacgtcttaagcaagaagaacaaaactgagagaatcacattacctgattttatattccaaggctataataatcaaaccagcatgatactggtataaaaataaaaagacacatggatcaatagaacagaatagagaatccagaaatgaagccacataactacaaccaactgatctttgatagacctgacaagaacatacattgggaaaaggatactcttttcaataaatggtactgggaaaatcggattaccatatgcagatgaatgaaattggatccatatctctggccgtataccaaaatcaactcaagatggattaaagacgtaaacataagacctgaaactataaaaatgctagaagaatacctagggaaaactcttctggatatcggtctaggcaaagaatttatgactaactcctgaaaagcacaggcaacaaaaccaaaaatagacaaatggggcttaattaaactaaaaatcttctgcacagcaaaggaaataattgacagagtgaacagacagcctgcaaaatgggagcaaatatttataaactattcatccaacagggaactaatattcagaatttacaaggaactcaaacaactgaacaaaatcaacaaataatcccattaaaaagtgggcaaaggacatgaatagacatttttcaaaagaagacatacaactggtatatgaaataatgctcaacgtcacttatcaagaaaagcaaattaaaaccacagtgagatatcttaccccagtcagaatggctgtttttaaagaaacaaaataaataaataaataaataaaataacaaatgttggtgaggatgcaaataaaagggaactcttatacactgttagtgggagcgtaaattagtccaacctctatggaaaacagtatggagttttctcaaaaaaatctaaaaaacagctactattagatacagcaatcccactctaagctatctgctcagaggagaagaaatcaatatatcaaaaagatacctacactgttacgtttatcacagcactattcacaatagcaaagatacagaataaacataagcatccatcagtggatgactgggtaaagaaaacgtatatatatatatatatatatatatatatatatatatatatatacacacacacatatacatacacacacaatggatactatttagacagcaaaaagaatgaaattacatcttttgcagcaacatggatggaactggaggtcattaagtgaaacacagaaagtcaaacacagaaagtcaaatattgcatgttctcactcataaatgggtgcttaaaaaagtgtacatacggacatacagagtgaaatgacagacacccaagactcgcaaaggtgaggaagtgagagagctggatgataagaaattacttaatgggtacaatgtatgttatttgagtgatggataccctaaaagccctgacttgagcactataacaatctatgcttataacaaaattacacttctacccagtaatttatacaaataaaaaagaaaaatatatctttgcacaatatattttaataatacttatagcagatttatccctaatcttctatagctggaaagataccaaatgtccatcaggtaattaatggataaagtgtggtatatccatataatggaatacccctctgcaatataagcaaatgaaatattggtatacatgacaacatggatgactctcaaatggattatgttaactcaaaccagactcaaaatactatatattatatcgttttcactaatatgccattatggaaattagaaaactttttggacagaaatcagatcagtggttgccaggacatatggattgggagaggctatgaattataaacatacataaaagaacttttgggatgaggtaaatgttctatctcgattgcctgtagcagtgattacatgagtagaaatgttaatcaaacatcacaggccaggcaaagtggcttatgcctgtaatcccattattttagaggccaaggctgggggattgctagagcccaggagttcaagaccagcctgggcaacataaggagaccctgtcagtacaaaaaaatgttttaaaaaattagccaggcatggtcgtgtgtgcctgtggccccagctacttaggattaggtggaaggattaattaagcccagaagatcaagactgcagtgagctgtgatcacacaactgcactccagcctaggaaacagaccaataacttgcctcaaacaacaacaacaaaaagtgatagaattgtacatgcctaaaaaggtgtacctcaataaacaaaaaggaggggataaaatacttaataggttaaataatcaggcatatttgatcaccaatatttgaaaaacataagaaatatcagttatcagaaattacagtattataagcccagcaataagatattgaaacaaacaaaagagctcttcgcacatacatccaacagaagttttaaatggactcactcctttcctaattcctttttaaaataattttaacttttattttagattctgcgggtacatgggcaagcttgttacatgagtatactgtgtgaggtttatggtacaattaattatgttacccaaagagcaagcatagtacccaatagttagtttttcaaccttgccccttgctgtaccatccccctccagtagtacccagtgtctattgttgccatgtataactcccacttagaagtgagaacatgtggtatttagctttcattttctgttaatttgtctaaaattatgaccttcagctgcatccatgttgctgcaaagaacatgatttcactttttttatggctgcctggtatttcatggtgtatatgtaccccattttctttatccagtccggcattgatggacacttaagtttattccatgtttttgctattgtgaatagtgctgcaatgaacacacatgtgtctttttggtaggatgatttattttctcttggatatatacccactaatgcgactgctgggttgaatagtagttctgtattaagttctttcagacatctcctaactgctttccacagtggctggactaatttacattcccaccaaaggtgtacaagcattcccttttctccacaagctcatcaacatctgttgatttttactttttaataatagccattctgatgggtatgagatggtatctcattgtggttttgatgtgcattttcgtggtgattagtgatgagcattttttcatgtttgttggctgcttgtatgtattcttttgagaagtgtctattcatgtccttttctcattttttaatgaggttattagcttttcgttggttgaattaagtttcttatagattctggatattagacctttgttagatgcatagtttgtgaatattttctacaatatgtaggttgcctctttactctgttggtagtttcttttgctgtgcaaaagatctttagtttaattggatcccatttgtcaatttttctttttattgcggttgcttttgaggatgtagtcataaattctttcccaagggtgatttccaaaatggtgcttcctatgttttatttaggattcttagagtttaaggtcttacatttaaatcaatcttgagttaatttttgtacatgatgaaaagtaggggtccaggtttattcttctgcatatggatagcaagtatctcagcaccatttattgactagaaagtcctctctccattgcttatttttgttgactttgtcaagagcaggtggctgtagttgtgcagctttatttctgcgttctcggccccattggtctatgtttctgtttttgtaccagtgccatactgttttggttaatgtagccttacagtatagtttgaagtcaggtgatgcaatgctttaagctttgttctttttgcttaggattattttggctatttggactttttgttgtgttgttccatatggattttagaatagtctttttttaattctgggaaaaagaatgttggtcgtttgatagaaatagcattgaatctatagaccactttaggcagtatggccattttaatgatattgattcttccaatctatgagcattgaagattattccattcgtttttgtcatctgttgtttttttatttatttttttgcagtattttgtagttcttctgtagaagtcttttacctccttgcttgaatgtattcctaggtattttatttatttttggctattgtaaataggattgcattcttgatttggttctcagcttgaactttattggtatttacaaattctactgaattttttacattgattttgtgtcctgaaagtttactgaagtcttttatcagttccaagagtcttttattgaaatctttagggtattcctgggataaaattatatcatcagcgaagagagagagtttgacttcttttcctatttggttgccttttatttctttctcttgtctgattactctggctacaacttacaatattatctttaataggactggtgagagtgggcatccttgtcttgttccccttctcaaggggaatgcttctagcttatgcccacttagtatgatgttggctgtgggtttgtcatagaaggcttttattattttgaggtatgttcctttaataactagtttgttgagggtcattattatgaagggatgttgaaatttactgaaatctttttccacctgtattgagatgatatggtttttgtttttaattctgtttatgtgaatcacatttattgattttcgtattatttgcatgggtttgcatatgtggaaccaactttgcatcccaggaataaaacctacttgatcgtggtggtttagctttttgctgtgctgctggattcagtttgctagcatttggtggagaatttttgcatctgtgttcatcagggatattggcctgaagtttactttcttcattgtgtctctgccaggttttggtagcaggatgatgctggcctcatagaatgagttagggaggagtctcttcttgaaatcttggaataattccagtagaattgtgctagttgtgttttatatgtctggtagaattcagctgtgaattcttctccagggctatttctggttggtaggattgtattactgattcagttctgaaactcattattggtctgttcaggatttcattttattcctggttcactcttgggaggttgtatgtttccaagaatttatccatttcctttagattttctagtttttgttcatggaggtgttcataatggtttctggagagcttttgcatttctgtgggatatgttgtaatagcacttttttagtttcttatttggatcttcactctttttcttttttattctagctagtggtttattgatcttatttatcccttcaaataaccaagttttggttttgttgattctttgtgtggattttgggttatcaatgtcattcacttctgatctttagttatttttttcttcttttagctttggggatagtttattctcatttttctagtttttcttggtgtgatattaggtcattaactttagatctttataatatttgatgtaggactttagtactgtaaactttcctcttaccgctgcttttgcagcatcccagagattttggtatgttgtgtctcagcttttatttatttcaaagaatttttttatttctgccttaatttcattattcaaccaaaagtcattcaggagtgacttgtttaatttccatgtaattgtgtggtcttgagagttcgtcttggtattggtttctttttttatctcactgtggtccaagagtatagttagtatgattttgatttttaaaaatgtatttagacttgttttgtggccaagtgtgtggccaatcttggagtatgttccatgtgcagatgagaagaatgtatattctgtggttgatgagtggattattctgtagatgtctattagatccagcttgtcaagtgtcaaatttatgtccagaatttacttgatactattctgcctcaatgatctatctaatgctgtcagtggtgtgttgaaatcctacctattattctgcagatgtctaagtattttcacaggtctagaagtgcatgttttatgaatctgggtgctccaatgctgagtgcatatatatttaggatagttagcatatatattgaggatagttaagtcttctggttgaattgaacctttatcattacgtaatgcccttcttttttttttggtttttgttgtcgtttttattgttgttggtttaaagtctgttttatctgatataagaatagcaattccttttcctttttgttttccatttgcatgacagatctttctccaactctttgattgagcctatgggggtcattacatgtgaaagatgcccttcaagactgcagatggtatattatttttgggtgtagctattgtcaatgggattgtgtttttgatttggctcttagcttcaatgttatttgtgtttagaaatgctactgctttttgtacattgattttttatcctgatgggtctttttttttaacccaacttggaattctgtgcattttacgtgaggcatttagagcatttacatttatggttgatatagatacatgaggttttgatcctgtcataaagttgttagctggttattttctagtttccatgtgtggttgttgtatagggtctgtgtgccatatattttggtgtgtctttgtgatagcaggtatagttctctcatttctgtttataaaactcccttaggatttttattaggccattattgtgttgccacaaaggaatacctgaggctgggtaatttataaagaaaacaggtttactacagaatgggaaaaaatatttgcaaactgtgcatctgacaaaggtctaatatccagcatctggaaggaacttaaacaaattcacaagaaaaaaacaaccccattaaaagtgagcaaaagatatgaacagacgcttttcaaaagaagacgtgtggccaaaaagcatatgaaaaaaagctcagtatcattgatcattacagaaattcaaatcaaaaccacaatgagataccatctcacaccaattagaatggctattattaaaaagtcaacaaataacagatgctggcaaggttgtagagaaaagggaacacttgtacactgttggtgggactgtaaattagttcaaccattgtggaagacagtgtggcaattcctcaaagtcctaaagacagaaatgccatttgacccagcaatcccacgactgagtgtatacccaaaggaatataaattattctgttataaagacacataccacacgtttactgcagcactattcacatagaaaagacagaatcaacccaggtgcccataaatagttgtctggataaagaaaatggcgtacgtatacaccatggaatactaggcagccataaaaagaatgaaatcggctgagcgcagtggctcatgcctgtaatcccagcactatgggaggccaaggtgggcaggcagatcacgagggtcaggagattgagaccaccctggctaacacggtgaaaccctgtccttacttaaaaaaaaaaaaaaattagccaggcgtggtagctggcacctgtagtcccagctactagggaggctgaggcaggagaatggcgtgaacccgtgaggcagagcttgcagggagccgagatcgtgccactgcaccgcactccagcctgagcgacagagcaagactccgtctcaaaaaaaaaaaaaaagaatgaaatcatatcctttacagcaacgtggatgcagttggaggccattatccttcacaaattgatgcaggaatagaaaaccaaatactgcatgctctcacttaaaagtgggagcttaatgaggagaacttatgaacataaagaggcaacaacagactgggacctgctcgagggcggaggatgggaggagggagaggagcagaaaaaatatccattggatactaggcctggtaccttggtgatgaaataacctgtacaacaaacccatatgacatgagtttacctatataacaaacctgcacatgtacccctgaatctaaaatgaaagttttaaaagaaggatttttaatgggattattattctgcaggatgtataggaagcatgacaccagcatctgctcagcttctgaggaggcctcagggaacttttactcatgggagaaggtgaagtgggaataggaatgtcacacagccagagtaggagccagagacagaagggaggtgctacacacttttaagcaaccagatcttgcaagaactcacttgctactgcaagaacagccccaagccatggggaatctacctccataacccacacatctcccaccaggccccatctccaacattggtgactatattttaacatgagatttgcagaaacaaatatctgaactataccgagatctcttataatgttactcttatggtaacaaattcacttagcacttgcttgtctggcaaatactttacttctctgttgcttttgaagcttggttgggcaggatattaaattcttggttggaatttattttctttaggaataggcacccagtctctcctggcttataaggtttctggtgagaaatccaccattagcctgattaagtttcctttgtacgtaatgtggcctttttctctagctgcctaaagatttttttctttagcattgaccataaacagtctgatgactgtatgccttggtgatgtttgttttgtatagtatcttacaggtgttctctaggtttcttgtatctaaatgtcgtctacctctctagcaagatcagtgaaattttcttgaattatttcctgaaatatgttttccacgttgcttacttcttctctttctcagcaataccaataatttatatatttggtcactttaaataatcccatatttctctgagactttgttcattaaaaatatgtatattttattctgactgggttaatttgaaaagccagtcttcgtgccctgaaattctttcttctgattgttttagtctgttgataaagctttcaattgtattttaaaattccttaagtgagttttttaattccagaagaactgaatgattcttttaaagatatttatcttctttttaattttccagattgctttagaagtttctttgtgtagatttttaactttgtcttgtacctcagttagcttccttgaaatacatgcttcgaattctttatctgtcatttctgaatttccattttggttagggatcattgctggagggctaataggagcgtttggtggtgtcactacattcagatttttcatagtgtcagaaaatttgcactgattcctactcatctgaagacactggcacttctaattattttaaattatttttatgaaagtaagatgttttctttttctgtatttccctacaatgttattaatatatttttttctcttctctttcttattggaacatcattaaatgatagaaccagctttagagagaaatcttggagaggggaggagctggcctagagagagatttctgggaaaggagagattcttggagagggtaggagctgggctagagagattcctgggagcatttggtctcccaggaatctggtgagagggagtagaatccaccaatttctaataatcatctacattttttttcagaaatttcagtcgtttataatttgtcctagggtttatagatatgcctactttttatctccaggctcctttactttgacttcctctataacaatgaatccacctagcactgcatgtaggggtagacatataccaatgaatatatttcagtcacattttttattttatgaagtatttgtactattatatattgcacactcctgtaggcaagtcaggcagttattactatttcaaatattctgtactatcaaataggctattttaaaattccatttcttaatttctgaagtgacactctgaagtaacaagttctacacatttatgaaaaaacaatactaattcttttacatttaatggtgaatatggcattaaatggcttcataatagggttggctgttttaaaaatgactcaaaataagcataaacacaacaaacaagtcataagctatagaataacgagatggctcagactaaaatagccataatgagcaatagtgacatcttggggtaggataagaatcgtctatttgtgtgtactttttctttgtgcataactttatttataaatatacgttgaaagttgttaagcttagaaacattggcattctcatttaacagatgaaataaagtaggatttaaaagaagggtcatttgcccagcataacattgctgagatgtggaaagacttgagactcagattgagtcctcctctttattgttctccttccataacttcagtatcattttcttaatgcaggcacaggtctgccttgcactagatttctcctgataatacatgtatccagagttttaagagaaggccaaagggagagaaactcaaggtcaataatatctactatatctcaactagggaaagaatttcttcaggtcttggagtcctgttatctaggaatataagctacctactctggggaccaaggtacagctattatgcagataatactctgcttctccaaacatctcttttcacattcagccttctgcataggggacctcttgtgagtgttttatccactacaagttttccaatggaatcaatcatcctatcacatagcttaataaaaaaaaaaatcttgacaggaaacatgttccaggttaggaacaatcttaattttagttttaaaatagaaagtgaggactttattatctctgctcaggacctttaaggctcctcatattttaaattgcattttgaagcagttaatgtatcatgagcaccttctttcttttaaatccccatagcaatcctatatagttgtaaaaatgaagaaattagaggttcaaatatgttaggtaatatgcttcaagccataaacgtggtagtttatggaataactgtttgtttctgcgtctgtctgatcctcaagcctttgcccaatctaatatgaaattttagaagctgataattttattttctttaaaacaatatagttttatgaccaccataataccagtattctaatataagatacagttaacttgcatatataaaatgattaatatctaatgagcatctactgtattattacactttgtgctaaatatgttaaaatatggttatacttaaaatacactcaaactctgagaggtgggtactattacccctcttttaaagataagaaaactgagactgaaaatggtttaatgactttcccaatgttatccaacataccaggtaatgctgaagctgagattcaaatccgggtgtgtaaattccaaagccaatgttttacatagtgagatgcacatggtctttggaatccaacagatctatttttgaatctcaagtgtccccaaaagtaagccattgatacttttcatttctactttgtttatgattatttatgaaaatattttatttcccatactataagcatcttgactataagcaagactataacgactataaacatcttaaagcatgggctatttctatttaaccatctttcctcccctactaattaccctaaacaataaacgtagtgtctactttgtagggattttaaaaagtgaatgattaaatacaatgaaagcactgaagtaatgaatgatttgaaactgaatgtgagacaggtctgatccagtaagtcggttaatttcttcatccacgtatttgtttaacaattatttactgatgagctgttatgttctccacattatgccagttgctgaactgatattctgtttgtacataacaaagtggtgttctaagcagcatccattctaattgatttgtcactgtgctaggccagttgctaacaattttgaatattatccctgagcgatgataagaaaaaagaagacatggtcactgtactcatgaaaatttcaaatagatgtaaaattactcatactataataggaagaaaggtacacagtgttatgacacctcatctactccacatagaaatgcaccttggatggaaagggaagagaaaatttcaatcagttcctatatcatagaaattatctttgcacttgtgaaggctaaaatgacactacaatttgatagggatcagtggtctcctgtaaataccattcaactgttcatctccacaatgttccttccccctctggtggatgtgtcagtaataagttaggtgatgcaaaggccgctacggaaggagtattgcacttcattaaatgtctgtttaagcgaactgaaggtattatgggaatgtaagtgaactgaaggtattgtgggaatacttgtttgtgtgctttcagagagtgtacagattactttatgaatgaataccgtcttgtgggttaaagtttgggaaaacagcatcaagaaaaggtgatgctgatataatagaattaaattgttttactagtgagggcaagcaggaaaaggtagaatttatccagataaataattttgattgctataaaaaaaacttacaccaaaatgaagtgacctagaatgctgaacaccttatttatgtaaattacttttatgttttttaacttcatttatttttcagtagtaggataaagaatgggttgcttaaatatttttaaattagctgagtatgacaaaataatttttatacctttctgataacagcaaggaagttgtatatctgttctggctcaagtatgtgtgatattttcctcagaaaccttaaaattactcaacagtagatcctaaaaaatgatatttttcagtagtttgtccaatttctatgtgacaggacatgatccaggattttgagaaggcagtgtttggttgaggggagaccgtattcttgtgaagaattctgggaggctgagtcagtactatcagatgtctaattatccaggagaactttcttaatctactacaaatgtagcacgttgcttatgtcattagtagtttgtccctgtgctcagcctgctaagacaaaaagggacatgagttttcagggaggaatttgatgcaggtgtagaaacagggactatataattcaacctggcatacatttactgaacacatttaagtagaaagtacagtctgttctaggcattatggaggatccaaaaacctagtggtcaagtttgttgcctattagaagcttaaaatccccttgaggtactttatatgaatccagtttaaatttatactaaaaggtaatatacaataaataatatgaaaggtacaaaatactctggaagtttaggaaagaaggcatcactttctgccattggacatgcaaatataaccatcttcttatttcctctcttaaagttcctttgttttctccagcacctattgggtcaaatctaagctgcttagcattacacacattcatcctccatgaactgaacctgcctacatttcccctttcatctttacttaccagtaacaataagctgcttgtagcaccttctctttcctttgctacccgttactcccagaatgccaaactaagcacagtgtctacaatgtagccaatgttcaaaatataatttttgaataaattaatgaatacccatactattctgcttcataacctcatgccatatatgcatatatataccatatatatgctcttctatttgtgtagaatatctttctttacctgattaaaatctatgaactcattcttcaagacttacctgctttaacttccaaactcagtttctttctctttagaatggagatactaacagtgtcttcttgataggactgttgtgaggattcaattagccattttttattataaagtgcttagaacagtgcttggcagaaaatgagcactatgtaaatgttaactatcattgttaggtgcgtcaaaatattgactagaacaactgcagaactctatagagggcagtcattgaagtctttatacaagtggaaacatctgaaatggaagaataagtacttatttgacaagtagagtcataggtaagctacagaaagagagtaactataggggaaaattagagtcaggtagggtatagcactgggacatttggccacctgcctccagctgccacacactatcaagagtcaagtgctagaacatgttttggaaagcattcttcctgcaagtgtaattcccatctcttttactgtctcacagtatctctagtgggagccaataaaatggtgagataaaaggaaattgcaggtttgtaatgttgactgaagggggcataaactgcaagctctctaggtagactctgtactaattgtaagccaggaaaattttataataaatgcatctaaataatatctatggtagaatattatggaataaagtaaaaatctcccctggcttttgctgatgtagcccctcaccccaacaaacacagtttcttaaattccttaaggaattttgaaggaggtaaattatagaggtatatatctcacacaatatatgtgaaacattttatagatcagttaatactcttacattgaattccactataaaattaatggcatttaaaaaaagttattctgaataagtggaatgactactgtatacctggcactcatctgaatgtttgtgtatcctctttcttctcctgagggaggagccaattgagaagttggggtaagtagagagcagtggcatgtcaggggacactttgtgtttatgtgaccccagatagaaaaaatgagaaactgtgtctaggagaagatgctgatggtaacgccagaattgtgttatgttcaaaccagagcatcaatcagaggggttgggcagagaatgtgatcattgaaatatggatccaaatgagggtgagagatgaaggaaacagcaataccaagactaagaagcaaatggataggtaaatggaagctgattaaactcaagagatggaatgtgagtatcagtgaggacttacgatacacttccagcctgattagcatgaagagtccggtttatgtcaaggaatagaaagaggcaggccctgttgagagtgaagaaatgaaaccatcactgcccttgagaaggctctagtcatgtaaaccaactattaataattagaatatagtgtgattacctttcaaaatgctgtcgagctcctatgttagagttggcacttgctagtgtggaaatgtggcagtgaatagacagatacggactctgtcctgaaagttgcataggagttagccaaataaattggtcaaataatggtgtgggcacaagtcataatggggagaatattctgcagagtgaatggcatgtctatgagggccttgggcaaggagaattgttataaaatatttttttttcaatttggatattaagttgaacattttctttaagaaaccttccatgcatctgtgtcttggttagatttcaccctgcctcctcccataggattatgtatttctcccaacatagcccttagtatgctttattgaaattactcacttactcttagatcctcactgtgaatgctgtgttggaaggaacaatcctcatctctgtcttgtatctcaagcacctacttctctgactggtacatggacattcaataaatattagttaaatgaatacatgaatgactaaatgaatggacacaggatctccaatgtgaaatttcttttggaaggtagtgccagggtagtggaaaagaagtagaagagagaaaaagggaaatccttgcctctctatgcttgttgtagtcaaattttgaaacaaagcaaaaaactatattaactgatatgaatagttttcttgcctttatctccctctgacctgacctaagctcctatcctttgggagctgctttaaatcctcttaggaaagaaaatacaggaaggagattataataaattaagttgtcaacaactactgtacacagattccgagcattgtattaagttaactaatagaataattttttattgaacgccaccatctaagaccttgtgcaaagtaccatgaagataaaaggaaatatatgaagacttaagatgtcaaaaattgtgtattcttaatatttgaggcattcttttggacagttggcaagtgtaataaaaatgtttaaatgaaatctttagcaattgcatttttatttcttacctaaaatatgaaggttgcatatgatgaaggccccaccttgttttcaaatatgatgtttctataaatgaaaatgagtaattaaaataatatatatttttggttcaaagtaacaaacccagctatgtttagatcaagccaaaatacattttttatataaatatacatgtgaatgatgggactcaagaataggatgggccctcagaaatgaaatgaaaccaaggaataagaaaacatttttataattttatttaagtgaccatctgtattatttagggttttctagagggacagaacggataagatagatgaatatatgaagaggagtttattataattgactcacacaatcacaaagtaaagtcccagaataggccctctgcaagctgaggagccaggaagccagtctgtgtcccaaaacctcaaaagtagggaagccaatagcagccttcagtctgtagtagaaggcctgagagcccctggcaaaccactggtgttaagttcaagagtccaaaagctgaagaacttggagtctgatgttcaaggtcaggaagcattcaacatgggagaaaaatggaggccagaagacttagttagtctagtctttccatgttcttctgcctgcttttattctggccatgctggcagctgattagattgtgcccacctagaatgagggtgggtctgcccttcccagtccactgacacgaatgttaatctcctttggcaacaccctcacagacacacccaggaacagtacttcaggtccttcaatccaataaagttgacacttgctaggctgtctgccctttcagagatccattcaaaagaaagggcaaaaagtccccataaccatttagcaaattggcttcattaccaaatgttacaggtttaccaatagtctggagtaaccattacaccatcacgggtaaaaatgcattgcttcaattctaaaatcccaagaaagagaatctgattagccagcttggtttaggtgttacttagtttggggtggatacctgcaaccccagtgttaccaagctgtttcagctttcccattttcagacaccttgtatgttaatcagctcaatggaccctctgctttttcacaagggcagagggccatgtgacagctttctgtatcctgagctcttgcccagtgtcccagaagaatcagatcacacgtgggtgcaaaggatgagtgccaggttttattgagtggtggaggtgggctctcagcgagatggatggggagcaggaagagggggatggagtgggaaggtggtcttcccctggagttgggccacgtagctgccggtctctgctcctgactgtcgccggcccagtgtccagacatccctcctctctttctctaccacatcattccacctttgctggggaactgccctcttctaatcagtattttcctgtctcctgttcatattagtatatacaggactgcagagaaaaacaagttattgtccctgtaacccaaatactcataatgtcacagaagaggtggttaaaaataatttaaatacacagttaaaagtatagtcatgaaggtgtgcacagtgttgtggggccgctgctaactcactatggagaacgctgcagaagcagcacaggtcatcacatcacaattagaagcagagattaaagagttgattgtgtctgaaacacttgtttgctaggttgtctttctctcccctaaggaaaggcaaaccccagactattggtaaacctgtaacatttggtaatgaagccaatttactaaatggttatggggactttttgccctttcttttgaatggatctctgaaagggcagacagcctagcaagtccattagaagactcagaaggctaaagccgaacctttatcaaaacagtgagtttgcttggcagccctggatagagaacatcatttactaagagatttattactagagaattaaatcctaggaacaggaatatgaaacttaatatgagcatgagtggactgtgttggctactattgatctaaatcctttgggaagagaagaaattgatgagatgcccaggtttctaaactaaagcatgttttataaaatgctgcattaggattcacaattaattttaaaagcttaccaatgacaaaagcttaccaatgacaaaaccaatgattcttccttcgtgtaaagagttcattacatcataaacgtactgcactctaggagtactttaaatagaaaattatatgcttgttacaggtgtaattccaccgataccatagttactacaagacaattttggaaagtatttattaaagataccaggatccctatgtataaattttttcaagggataattattgtcttttctgaacttataaggaaaaaaaaaagatcacttctttccagagaacccagtagcatatgaagacaagtttttgttgcaatggagaaaatgtcatccatcattatgcctaacacttttgaaaaaagggatggtgtttttattagggccacttttgctttgtgtaaacaaacttttatttcataaaaatagggtggtccatacttcccaataactacattcaaaacatttgtttttggaatcagttgactgagtttatagcattgtttgatttaaatgaaagaagatagattatcataaacgctcaagcctcacaatgaagtatagctgtgcagaaaacagatgatgctatgatattattatgataattataatagtatttatcatcactagagtggttctgattgagaggttaccataagctaacagttccagtgcaggtaggccaatctattttatgctgccttaacatcctgcatagctttacactcatcacagttattccatatctttcttcccctttagcctaatagcttctcaaaggcagaggcaatgagaattttattcacatctatatctccaggtgttagactggcatctagtgacaatggttacttactttagaattaataagttagggctgagtgcagtgtctcaagcctgtaatcccagcacttcgggaggccaaggtgggtagattgcttgaggccaggagttcaagaccagcctggacaacatggcaaagccccatctctactaaaaatacaaaaattagccaggcatggtggtgcgtgcctgtagttccagatactcaggaggctgaggcatgagaatcacttgaatccaggaggtggaggtttcagtgagctgagatcccaccactgcactccagcctgggtgacagagtgaaactctgtctcaaaataaataaataaacagaaagaattaataaattaattaattgcttgtgtattttgtagaaaagtaatctttacgagcttttcaacttagtgaatctacgttaccttctatataaagaataaagatcttcaactccttgcctatgaaatgttaatatgttcttctaggttcataggatttatgtaatattaatttgaatcagaacatgaaaacgttttgtaaactaaatagcatctttcaatattatggtcatttatggtatgatttaaaataatacaaatttgaatccctgaggtggcctaggggagaaaactatagggtaagaaacagaatgaatcagtatcagaaaacagtgttcagaagagtaaaacaatgagaaaatataaaggaatcagttcaacaaactttctaaagtacctacctggtgcttttacttgatgtaatattttatttaattatcataacatttaaatgatgccaggattattgtcctcattttacagacaacattgatgagggcaaatagtttgtctcaggtcatatctaaatgttaagagccagaattcaactcaagttctaacagctctacagctgcctgtaaaaaatccagatacatagcttgttgttacaaagtagaacaattctacatggttgttttccatggctccacacagtaaaattttgcccaaaacagtacaggtacaaagagaaagctctcagattaatttaactgaaacaatccttattagattataagaatatactgacaatgagctacctctgtgtgtagtaagttcctgtagctggaggtattcagatttacaagtgataaccagttgtaaagtatgttatggcaatgacccaaccattggaatacagattgtagattattcctcagatacttttaaatcctgaggctctatgattttagttgacttctgctggttaggctaaaggggaattcccatggtattaggataagaggcatgcctttttggctgagacttcacaggtttgccgactttaccaggtgattcccccaggctgcacgggatagacttggctaatggcaagcagtttttcttgggaaagcagtatcactggaagcaacatggcatggtgggaaacatacaggatttggaatcaaatacaactaaagccatttgtgtcttcctgggctttaattacctctttctattaaatggtgtaataacagtaagggattaaatgagataatgcatgtaaagagggaaatcatcatcatcaccatcatcatcctcatcttcattatctttgatggagaggaggtgcctctttggaggacattaggcaataaacaccttatcttcctctggagttggtcagcctcaggcaacatggacagaaaataatcttgtagaataccagggcttaagcgattatctgtccaatgctcctcaaactttttgtgataaaaggtgtgtatgtgtgtgtgtgtgtttaaatttacaatctactgcagaccaatacttttgtaaaatgcaataaaaatgaattactggagaagtgaaatggggaaataaaccaaaaacatacaagataaaatcctttttttttttaacaaaagatatacacttacttggtcaaattgttataaaagtctctaaatgcttactttcattttcaatactttgtagtagatgggaaacaaacagttttgcagactggtattcatccaaggaccacactgagtccttggatgaatatatgaggaatctagctcattcctgctaaacacaaaggaagagaattccagagtagagaaagatttgcccattgttacctaacaagcataattattcttagttcattatcatttagggcacttaaggattgaggatgttgataaaaaactaaatatgtacaccaggaattatgattctggtagttgctgtaggctgatgcctcttccacccatttatctcattgggagttgtaatgccttgtagtatttcttatccagtttaggggaaattaaccagtggtgttcaatcttttggcttctctgggcctcactggaagatgaagaaatgtcttgggccacacataaaatacactaacactaacgatagctgatgagctaaaaaacaaaaattaaaaaaaatcacaaaaaaatctcattatattttaagaaagtttatgaatttgtgttggactaggggttggacaagcttggtttactcagagacgaggaaagaaaaatagtaactgttatgtatccactttgtgtatactagaatctacacataatattacatttaattctcttaacaaccttctaaggtaagtggaattatctgtatttttctggaaattttaagcaatttacccaattgaacacacctagaaagtggtagaactagagatgcaagcccaggtctgtttgcttacagtttttctcttttctccacatcactgtataaacatagtcaatagcttgagtgtattcgtgctcttgaaggaaaatactctcctcagcagttatttctaaagggctgggattacaggtgtgagccaccatgcctggtctctcaacagttatttctatttagaatttacataacattttgtgtttgcaagagactttacaaccacttattgcttctttctcctacgctgctataacaaagccttccacagagtctagaaaacaaaggcataaaaaagtattctttaattataattattacaagttagttacaaatacatattccattgtggaaatgaatgatgttttaaattttttttatgattttttgaaatagtctcgcatatccccagctttattcaatagtccatcttagcattttataccttgaccaccatgtttcctaatgaattttataacctttttgcaaattttatatactgatgaagtacgccagtcattctattagaatcatttttacatatctagttaaaattaatttttttattccaaattatacttttgaagggaacaataaactttcactatgatatactgactaacatgcctaattctcacactaaaagtgacctttattttcaccctagcatatattgaaaattgggcaggtttcctttttgcttttggacagttttcacaatatctgttgacctaccttagatagtctgggtaaaagacacactgggccaggcgcggtagctcatgcctgtaatcccagcacttcgggaggccgaggcgggtggatcacgaggtcaggagattgagtccatcctggctaacacggtgtaaccccgtctccactaaaaatacaaagaattagccgggcgtggtggcgggtgcctgtagtcccagctacttgggaggctgaggcaggagaatgtcttgaacccgggaagcggagcttgcagtgagccgaggttgtgccactacactccagcctgggctacagagcgagactccgtctcaaaaaaaacaaaacaaaaaacaattgctgaaaatttccttgactatgagatgaagtgtccagaaccacaggcccagcccagaaatcagcaaattttatcctgtcggtaaggaaaggtttatctactcatgtaacattctacaaaaatttattggtaccttttattctacaaaaatttattggtaccaagttctgtgcagaacgtacttgggttaatatttttctctgactcaaaataaatttgtgactaactgtgaccttcaaaacattcactgtaacatctagggttcttccggtctcttcaaacttaaattttttaagtttgtgttgttttaaatctagcttgctgctttgatgttgaatatgatagtaaaagatatgttggagaagctgcaaaaatttgggatttttaatacaagtaaattattttctcataacatcctatgaattatctaagcctttaattcattcatttttggactttattttttagagcagttttaggttcacagaaaaactaagaggaagttacagaaactttgccatatactccagcccccacacatgcatagtttcctatactaacgacattccccaccagaatggtaaatttgtaacaattgagtaatctaccttgacacatcataatcacctaagtccatggttcacgctaaggtttactcttggttttgcacattctgtgggtttcaacaaacgtgtaatgacatttattcatgattaaaacattgtaaggagtattttgactgtcttaaaattcctttattctctgcttagtcaaattccagcctcccaacccctaccaaccactgatctttttgctatctccgtggttttgctattttatttattttttacaaccaggatcctcatgaacttaacttccctataaaatatatattgtataatttatttcaaagcttttctaagttccagattcccccaatgcacaatatataattgttatttatctattaaataagatcatttactcaaacatttccagattattttattctagcagatgcattgttatataaaagtaaagaaaacatccacttcaaaacatacagaataaggcgggtaagttcaatgccataaaggatactgttcaatatgcttcatttcctatctctaccgatccttcctgtcacaaaataacatattatttatatagtgctttggagttcataaagatcttctacatccactcacttgtttaatattcaaaatactgtttgctggtaaatagaatcactgtcttaatttcttttaccctttcccatattttttgtcctcctatttagcaaagctcatcaaaggagtagtctatactcaaggttatctgttttcttacctcctcttctttcctccacccactttggttaagcttttctccctgctgttccactgaagcagcttcagtctgtccctcatgatctccactttgcaaaacgcattggtcggttcttagttctcatctttctctacctctcagcaatgtccaacctagttgatcacttatcctttcctaaaactttcttcacttgtctctagtacagtgaaatctgatttagtgcctatattgctggccactctttctcaatctatttgacttttccagctctgctagtctctaagtatcactgttgaccaaggcttagccttctagtgatgctccttcactccatcaagcccattccatgactttagataatttaaataagttacacgttcttataactcccaaattccatctccagtttctacatctttcctgatctcctatgtgaatacataactattcaatagctctgccttgatatcccatagtcactttagacttatcacataaaaataaaattcttcatttccctcagctttaggatcttcccaggccaaaaacataaattaatctttgactgcttatgttcctcagagcctaccaccaacctgttagaaaatcctataagctctatattcaaagtatgaaaaatatggctacttcttactactgttaccattggtcatatgtctgtgcctgcctactaattcaaaccctccattatctctcacctacactatgggatttgtttcctaacttatctccctgtttccactcctttctttatccagtcacatctttatccaacggccagaaaggtctattttaacgggaaattggcttcaaaagctttccaacatactcagactaatctgtctctcttctctgttttcttgctgtagccacactgatcttttgctgtctcttgaataagccaagtttattcttgcccaaaaatctttgtgattactgttgactcatttgctaataacttctggtggaaaaaataaatgctgcttacttcttcctttccaggtctctgttcaaataccccttcctgaaaaagacctctttgagtagtttatcttggaaccaacccaaatgtccaacaatgatagactggattaagaaaatgtggcacatatacaccatggaatactatgcagccataaaaaatgatgagttcaggtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtagtggggtggggggaggggggagggatagcattgggagatatacctaatgctagatgacgcgttagtgggtgcagcgcaccagcatggcacatgtatacatatgtaactaacctgcacaatgtgcacatgtaccctaaaacttaaagtataataaaaaaaaaaaaaaaagaaaaagaaaaccaaagaagcagccatgttatctagttagattttggatttaaaaatacagatgtatttctaatgataaaaaaataataataaaataaaatagtccacatacatccttctactctctcttcttacactgctacagtttttttaaaaagttattttcacagcacatattgctacctaatattttatgtaagtagttacagcttcatagtttggctgtttctttcattagaatgtaagctctgtgaaagcagaactttgtcttttttaccactatattcccagcacctagaaccatgcctaggaaatagtaggtcttcaataaacatacttaagtgaatgaaggaaagtgaagtgaagaggttaagtgatccaaggctagaaagccaggcaagcaagacagaaagaacttgaatacaaaccacctgattctaaaccccatgttttctccacgacataagatggccttttcactgaactgggcagtggaagatttgagtttttgaatatttccctggactcggccatcttctaccttccagtggttcagccaagatattccctgttaccttgctactggagaagagtgtagtgtgaaatagtacaacacttgctaagaacaaagtaaatgagagctactgcatcctctatgcttgtaacctaccactcaaatcaaggaaagaaaaatcagtttatctaattttttctttgccaatccatggtttttaattttgtacctggcatcctaacctcttctaggcaactttaaaacataagattgctacacattactgccttgtgatcaattgcaatttgttgctaattaagcacttatttacttaaaaaacaaattcaagttgatttaaggatatcaggaaaataaaagttcttttacctctctatgtgctttcttgagttgtagtgttcatagaattgcatgttaaccacagccgatttttgctatgctgcagcatgtgatctgaggatgcccaggaaattgtggctgtatgtgaatgctgtgatttcttccatgtacgtcaccacacagagaaagagagtgagaactaccactccaagctacttttttttggtttgtacctggcctttgcactcctaaattatcataaataatgcctacagtttttacaataataccaatcactgtcaccttcttgctgcttgaaatcttaaaagctttgtgaaccttggtttcttcatataaaaaatgaagatagtgatatatgcacctcatatttgttcttttgaggattaagtgagataaagcacatatgcttattagaacagtatctgatccagtcacttaattaatgttagtactatctctcccatggtctctttgattcatcctttctgacttggaactttaagtctgtatattcttccctccaggatgcaattttgatataagagtcgaacatgtatttgccatcaattcctctaaaagtgcaaataattcagctacctgtcttctttttcctaaatatctactccattctttttttctaatgctgtctctgccatcagttaaatacattgccaataacaggtaaattcttgacttaataggatacctcaatgcctgatttcaatcttataagcattacatttctcaattatcccatccagaaaccactgggaagtgttaattaggtactaaaaacaaattggattacctcagggaatctttcttaacaattttgcagtcaatcaggtggtaagatcataaattacacatatcatcctagtatccattccagatgtgatttgaaatccttgactttctatggtttgtcgttcaactttgtatcaatatgaagtaattgaaaaacagcctatgttaaacaccttgatccatgtaataaaactgggaaatgatgactatgatagtttcagaaatgtatactctctcagcagagttaattatgtcatgaacataagagtataatttggtatatagtttttttcaataactattaaaaacattgagatataatttatatatgatatttatttttttaaaaataaatttggaaaatgttttaaacaaagatttttctttctaaactcagcaatagaaaaacatgtacgggcctatgccaaacctcaaatcttaacaaagttgtggtatctagagtcagactccgacttcaaacctcactttttatcttcctcattgtacatacagaaatcagtttgattaaataaatatttaataattcattcaacaaatattcaggaagaagagctcatggatgctgggcttaatacatacctgatgagatgatctgtgcagcaaatcaccatggcacacatttacctatgtaacaagcctgaatatcgtgcacatgtaccctagaacttaacataaaaattgaaggaaaaaaaaagtacagagcaaagtctaccatctttaaataaatctaatagtcttcctttactgttggaacaagtgagtggttctttgcggcaaatgaaaaaggtggcatatatttaggagccaaattgtatagaaatgtattattaaattctgaaatcattaaaaaacacaaatatttgctgagaacttactatatgctaggcactcttctaggtattttggatatagcaggtgagaaaaacaggcaataatctctgccttacagggattactgtgaaaattctgctttacattgattcaacttcaggacatgctactatagtgctaaacacgtagaggaaaccaacagcagggggaatccaaagggcctgagattaactttctccctgggaagaactaactctgaaggcttagtttccttatatatatttttttaaaatagaaattgtacaaaaacagccatgcatcacttaacgagagggataggttctgagaaatgcatcattaggcaatttcactgttgtgcaaatatcatagagtgtacttacacaagcctagatggtgtagcctgcaatatacctaggctacatggtatgacccactgctccttgactgcaaacctgtgcagcatgttactatactgcatatggtaggcagttgtaatacaatgttatttatatacctaaacatatatacatatagaaaaggtacagtaaaatatggtattataatcttatgagaccactatcttatatgcagtttgtattgaccaaaacgttgttatggcagcacatgataacatttatatcccaggggtggctatagaggttctagatgtcagttataatcaggtctgttccttgatttgattgagaagttgcaaaatgtgttttcactgtaactgtgtagaaaacttttagattgtttgtttggacatgaggaagacattgcaggtgagtgagacagtttgaagaaaagcctggagtcagggaagatcagagtttactgaaagaccaaaaaaattctagttgactgaggctagtgaacatataagggagggtgggttataaagcttgaaagatcatctcaagtatttctctaccatctctcttccatttatttgtttagttatttatttattcttaatttattttattagagattgggtgttgctgttttgtccaggctggtctcaaattttggtcccaagcagttctctctccttggccttccaaagtgctgcgattataggcgtgagccataacacccagcctctgtctttcaggctaatgggaattctaccataaatttgttctagcttccctgaaggaagataatctttgtgtaacctctcatagccttcttagtagccaagtattttaaaagagagaacaatgagttagcagaagaccctgcagccaaatataccaagatgacttaatttacagtccgcgtaacctttacttctctaccacaaaccaagaataacattgtcctcatctctcagcaataaaggaccaaaatttatttatgttttaggtcgcttttggaaggacatatacaaataaattagcaaataagcaaatgaatatctagcgtatttatttttatattccctgatagcacaaagtaggggctcagtaaaagttaatttaataaataaatccaaaaatacatgcccatatctcaagagaaaggaaatgaagtatataaaattgtacagtgctgtgcaaatgaaaatgttatcaccttaccattttcaacttctcattatgtagttattggtacacatcctgtaatgaacataaatgtgattatgagctacttgagagcagggcccaagtcttcctcatttctggttcattaatgtctgttattcagaaggtctcagtgaagaccaattggcatgttgggggcctcagcagatttttgtagagaatctagttggcaggcctcctgaatgcaccttgtctctgaaaaagagagcagatttctcacacatgatttcctgtcctggtatccaaatgggagagccctgcagctgcacagcctgagagcagatgttgccctgtcaggtgtctttgattctactcaagaaaccacaggaaactggttgcagacaaatcatcagcactgtagcaacaggggaatggcagcctatatggtgtgctcacagaggaaatatggcactcggccacagaggggaaaatgacttgtctagtctagaagtgcagataagtggggcctggctgttgtctccttctattaggcgcagaacttttctattctgttttgttgtcaagttgactattcagacatctgtgtcatgtgttcaatcaaaaaccttttgatgacaagaatcacgttctaaccatttacgatacccagcacctaaattagcacatataagaagtatgtaccataaaatatttttagattttaattatttgaactaaactgataccttggagcactagggatagaggaaaaaaaggcagctcgtgagacatgaactaataattattcagtaccttagtgcaaggacaagtattttcatattatgtcattttattttatcttatagcaattcaatatgttaactaattttattctcattttactgtgaagagggttggaatgtctctaagttgcccaagatcacatatctagtttattacaaaactagaattcaaactcatatttgtcagacaacaaagcccatgcttttttttctgcctcaaaattactaaattgtttcctttggtataatagctgaaatttagttccatcatggtaagtgtatttttactgtaatttcaatctgattatgtatacaggttgtgtgaatatgtatgaatatgtatataatttaaaagttatgccaatatttctagtaatattgttttctaataaaaaaattaaaaaagggaattgcatatacctttatagctttggggaatgctttttgttgcctattcatcattcatttgtcccctcccttcttcctcacagaacttgttgtacaagtatttattcctcaactacaaaacccatgtaccttaggagaaacattgcctactcaaactccaagcctgacttgtctaaggttaatgctatccgccttgccagtgtttggttctggactggccatgtgattcatttggagatctataaaatgcaggaagaatttccatggggttcttgggaaaagttggatttgatcttctgagagaccttctatatgccaacctccttgttgcacatggaggtgaagtctagaactgccacagttatcttactaccttcctgaggatacaccatccccatgcagaggaaggccagggcaaaagattggcagggaagtgggcccgaactctttagaataatgaccttagtgcttgtggtcaacaaatattcttattgtttaagcagtttgaattattgtcttttctgtatcttgcaaccaaaacatcaaaatagccttcattcccaggctggaaaataagtaataaaattgatccttttgcatatataacattttattattaacaactcattggactctgccttctctcattcttttcattagcctcatcttatagatatagaaactgagcctcagagttaagtgacttgtctaaggctacagccctgcaaaataactttaacttcacgtttctaactctgtaattaaaatcctgtcctttttttttttttaatcaagtctaaactaagctgaaataaagaccaagaacagagttaagttcattgctaatttcaaatgtaaaataatacagcatattaattgtcacctttattcagtagtaaagaattattttgaagcatcagtttctggaatccaagaaataaatagaatggctgatcttttcttttcttttttttttttttcttttcatatcttgttgttttccatctctttcctcacagatttccattcattctcaagtcttgactaagcactccttttctgagttcccagtgaccccttgcccacagctgtcaaaatatgttgttataattgtctgctttttgcctatctcacacacggtctaagctccctgagagtagaaacaatatatcatccatttttgtacctctcacttctggcacatagtagtcagtcagttaatgtttatagacctgaactgtggttcagcaatccacctggaatttttgaggagcaagccattccacagagctaaggtttgcagatagctaagggctaaatattgccagtacataaacttttatatttcaattcatttttgaatgggaatatttattaaatgcagttcatcatgttctgttttcttaaagcatagggattatgttttagccacttcatgtaatgatgtcctcagatattactcaaggattgataaatatttgatcttatgatggctgatctgtaataacttattttttaagtcttatcgctgctgtttatattttacttcattcttccttgctctctttataattgcttatagaggagctatcccgccttttatttttaatctaagatgggcttagaattctaatatgaactgttattaggccattctcatattgctgcaaataaatacctgagactgggtaatttataaagaaaaggggtttaattggttcacagttctgcaggctgtacaggaagtacagcagcatctgcctggcttctggagaggcctcagaaaacttacaatcatggcaggaggtgaaaggggaacagacatgtcatatggccagaccaggaagaaggatgggaacagggctatacacttttaaacaagatttcctgagaactgattcattatcacaagaacagcactaacagaatggtgctaaaccatttataagaaaccatccccatgatccagtcacctcccaccagaccccacttccaacatttgggattacaatttgacattagatttgggagcagacacagatccaaaccatatcatgaaccttacatataaattataggtaaagtaagaaaacattgtttttgagtagagggctaggagcccctctttttcatggattcaagaatagtgatctctaatatgtgaactgtcggtataactattagtattttcagggttttttttttcacctttattcctagttttcagtgcttggtgcgagaaatcttttggatatctgtttggttaaaagatgaggagggtgtgttttatggaggtgatttgtccaggtttctttttttttttttttttttttagacctttacttttaatttcaggatctggagagcagaaactttcgtagttcaaaaaaattcctcatgcttagtagcttcctttcctaaaaatgcaggtgggctttacagcttcccatcagacttatttatttgtctttcttctcaatgtgttttgtatttgtatccagctgtgggagaaagctttctgagaaactccatgtaccttttttattagttgaaaataagaatgttcaaacattacctcaggtgggaatttgactttgcttctgcatttttcattttagcttagtatttcaattttaaaatagattaaggtatgtttagtatttttatagaaaagtgctgcctaatccttttgaggacacagaacggtaaattccctaattagtgcagtcagaactgaagagttcttcctgaaaagctgtattcacacaggagtttacatttttgtcagttaaattttcagattttctttcatgcagaaatttgccacagcatgatacataagaaaaaacattcaagatgatgtcacaaggcctatattttatagccccacctgcacttcaaaggcattgtgcaagagttaaaaggtttgcccaatctaaggtatttctatgtatagaaattatgtattattagatatacagagaatgtgattcattttctcattattcaatatatttagtagctcattgaagatccctgggctatgtccttgttgttgttgttgttgttcagggctcttctatatatacaatgacaaaacaataaaacctaaactttttagcctggataaaatctacccaaccaacctgtagtttcttcacctcccagagagaaacgtgtgattcaaccatatgaaacttctgtttccggccgggcacggtggctcatgcctgtaattccagtactttgggaggccgagacaggtggatcacgaggtcaggagttcaagaccagcctggccaagatggtgaaaccccatctgtactaaaaatacaaaaaattagccaggcgcagtggcaggcgcctgtagtcccagctactcaggaggctgaggaaggagaatcatttgaacccagagagtggaggttgcagtgagccaagatcgtgccactgcactccagcctgtctcaaaaaaaaaaagaaaagaaaattctctttccttcagtatgttagactttcttggcgcatgtcattctctacttgaaactcatccagacttatccatatagcaaattatttctccttcccaagaccccaatgtatatattaactgtcaactcttttctcacatcgtcatgtaagttgccagcttacatgactctttgtcttctctagtgtgtaaattctttagagagacagagcatgttttattcatccttgtatccttagcttatagtttaatatctgaagtgtcatagaactcaatgaatgctaaatggatggatgggttgatagccaaatcagaatataagtaaataggaataattaattgcaaaaaaaaattcttactaaagatggttggtatactacatggcctcttaaagatccttcagaactataaatcaatagataacttcttgatttttagtatctttaagagttgtaacagtgttaatagatatgaattttctttcctgggagtttttaggaataacataaactgttccctctctttacaccaatgtcaatgtactggttttgatattgttctatagttatgtaaaatataactaataggggaaactgggtggatggtacagtaaacatagtacttctctgtactgtgtttacaacttcctgtgaatttataattatttcaaagtaaaacgtttaaaaagtgaataaatcttgtgaattatttaagagctcactactagggtctctatgatatgtgtcagtatatattttttgaaagaaaaaaattacaacagctttattcataataggtaaaaactggaaacaggaagccaatattaaaaggctacatattgtatgattccaattatatgagattctggaaacggtaaaaccatagagacagtaaaaagttcagtgggttgcctaggggttggagtaggtaaagggatgaataggcaaaataaagaggattttttgggcagtgaaattactctatatgatacaataattgctgatacctgtcattatgcatttatccaaacccacagaatgtacaccaccaacagtgaaccctaaggtaaactatggacttcggatgattatgatgtctcaataaaggttcatcagttgtagcaaatataacattctggtgaggatgttaataatagggaatgctatgcatttgtggggacagaggtatgtaggatatctctgtacctttctctcaatttggttgttgaatataaaattgctctaaaaaattaagtcttttgaaaaacgcctgtaaggtttctgctgagtaattcattgttaatctaatggtgatgcccttatatgtgacttgacacttttctcttgctgtttttgaaattcttcctttgtctttaaacttttgacaattagactacaatgtgacttagagagaacatatttgggtttaatatatttgggattttttgagcttcttggatctgaatgtctatgactcttccaagtcttgagaagttttcagctattattttattgaatataatgtctataccacttcccttttcttctggaatgcaaagaaggtaaatatttgtttaatagtgccccataaatcgtataggctttcttcatttttttttcttgtctgcctgtgattatttcaaaagacctatcttcaagttgagaaaatgtttcttctgcttggtctagtattttgttgaagctctcaattgtattttttatttcattgaattcttcagttatagaattcctgtttggttcttctttatggtatctatctctttgttgagtttctcattcaaatcctaaaattttctcctgatattgttgaattgtctatttgtattctcttctatctcactgagcttccttaagataattattttttattccttttctggtacttcattttatatacttccttatgagtagagtctgttactaaaggattattgtgttcctttagagataccatgtttccttactttttggtgtttgatgtggccctgcattaacttatacgtgtctggtggaacagtcacctctttcaatttatggagtgggtttcatagggaaagatattcatttagacgaggtgttggttcagtaggtgcattagctttggttctaggtgggtgccatagtttagtctttatgtggtttcttcagctgtaattcacactagtgatgtttgtgagtatctcagtggtctaggctgagagagtttgtggtggtggtggtggtggtggtgtgactttgccagagatggatttattaggttgtttcttagatcaagggtacgtgtatacacacagtaggttggcccacttggggtctgtctcagtggggttggaatcatggggctgttactcttattaagagcataggcggccgggcgcggtggctcacgcctgtaatcccagcactttgggaggccgaggcgggcggatcacgaggtcaggagatcgagaccacggtgaaaccccgtctctactaaaaatacaaaaaattagccaggcgcagtggcgggcgcctgtagtcccagctactcgggaggctgaggcaggagaatggcgtgaacccggaaggcggagcttgcagtgagcggagatcgcgccacagcactcccgcctgggcgacagaacgagactccatctcaaaaaaaaaaaaaaaaaaaaaaaaaaaagagcataggcacacagttgtttggtcagcctggggcgcatctgccatgcgtagtccatggggatgcttctcatgccctgattttgggtgtgtgggttttgtgaaggccagggccatgcccacagtggtgtggagggcaccatgaggctgtttctcagaacctgggcatggcctgatagccattttgttgacctggggatgtgtcatctactcagtggctcaagaacctctcccactcagggagggtgtgaaacagattggcgggctcagggtggctttgccctgggtaagactgccagactgttcctctggttggaagtgcaggtggcaggggttggtttccctgctgtgcaaaatgacagtcacagttgattctgggttcaggctctgcaccgctggagttgtggtgttcagccactggtgtgggattggtggaatgaagatggagcaccagtgttggagaggtgcagtagctactggcctccagaggaggatgcactccagaggcggctttgttctctatatggaactgtattgctgcagcttggcccacagtggctgggtagggcttagcacatctacacctcgtcctcctaatttgaagcaatacagctgcatgaatttccagcatctctcccagctgggctcagggcttggaagaactgtggggttcttctgtagtaaggattgtaagtatatccagtggcaatggagcctgatgggattattctgtttacctttttcactcaggaggacctccctcttgcctttgtgctgatctgcttggaaggagggagatggggctgcagaagctgggtgcctctatgctgcccccgggggcttccaattaataggtgcctttccattcccctgctgtactgcagccatttccctttggcactccagtaaaatgttaactgtttttctattactttggtcctttcttgcaaccttccttcttttatctagtggatgccatggaaactaatagcagtgataacttcccaatttctgaacgttagggtaaatacagagtagacacagtcattgtgaggctgagaatctggttaatatcccccaagacaatggactctagggcctagctggggcctgggcacaaggaccgcttcatcagatcctgtaaaatgaccccaggagactgtactaaattaaactttgggatcacagggtagttatttaacataaataaaatattattcaaataagtttcaatgcccatagaggtgagatagttttgcatactactatattgttttgatactgctttatgtaaaatggctacatccttcacctagtttgtcttcccttgatcttctggcagatgtgaggaaaaatggaaattctaatcaacagtcaaatgaaagtcccaggttccttagccaggtagttttatgtttcaatcatatacttactgccttatcaatatttctcaattttaaactctaaaactttaggctttcctcactagcagctttccatttttaaagatatatcttttcctagtgatataaaatattttttaaaactcaggtaaagtgctcataggagtgaacacagtagttgtctgagtgatcttggcaaacatagggtaaatattttctagttctagaaaactgagccccatgtggaattctatcttctaacaaagtagggagtcatcacttcatgtaataacacttgtttaggaaaaaattgatttgggagttactttgattaaaaaaataaactctatcattggtgtttaatttagtaatttacctagaaagttaatgtaattctttggtcttgagttttaaaccacctaagatatttaatctatattattgagttgaatttacatataataaaatgaatcttttttaaatatacaacttgatgtaaatttgatctgttttgatagacatgtacatctgagaaaccactgccacattagagttccagataattaccatcaccccaagattcctcatgcctctttttatcccttccctctgtctacctctaggcctaggaagcagtagatctactttatatcactatatattgatttttattttatatatttccatgtaaaatgatttatacaatatgcacagtttcatgcctttcaattggaacaatacttctgaggttttacatatatatcttgttttgtttatacattcacttgttaatgtatctgtgggttgcttccaatttggagatattatgaaaaaagctgcagactgtgtagacatatgttttcatttctcttgaatacctagaaatgcaatggctgtgttgtacaatacatttatgtttaaatttttaagaaatgccaagctgttttccaaagtggttggaccattttacattcccaccagcaatgtaggggagtttcagttcctccacatcctcatcaacacttggaattgttaaactcccaagttttagccattccaattggtgtatagtggcatccactaacattttaatatctcaaaaataataattttatagcaacatataggaggtgtatgtctattgagaaacaaaggaatgaaacagaatacctagtatattgaaatcaagaaggtagcaaattgtaagaaccatacatattgttgttatgtccttagatttcttttttctttgcaatatttattttatctcactaccttgctgcctctctggcaccaactaaggccaaatctagagggtatatacattactgaaaaagaatatattatgtcatcgttaagcagaatcaacagagtagctactaagaaaaataggttcctgatgttttttaacaagcaaaaaaaaagaaaaagaaaaaaaagaaaattgttacatactggagttctgcaaagtctgactctagataattttttcttgtgatgctcttctctcaggatggatgatacctatttctgagcctttaacacaacctattgacagacacttcataagtttatatttctaacccagtttacgctgcgctctagaggaatgtatccaagttagagttaccaaaagcactgtaaatcaaatttacaatgcaagcaaaacaaacaaataaaatccccaaacggaataatgcctcctccatcccacacgtatacacaaacactatattactttttagtatatcatatttcagtgaatgccattacaacttatccagttatgtataccagaaacctagaagtcatactgaatttcccccatatctgatctacccccaatatgtatcactttcactcactttctaagatgttccttgagttgaactatttatctttgtttccagtgctgtttctctagtctgtatcaccattatctgttgcctgcactactgagagcacctcttcagtgttctgcccactgacaatattgttccattccaatccttcaccacactacagctatacgatcttcttgaaatgcaatataatatcacatcccccactcctgcttaaatactttacataaaccttcccacacacaaaaatacatacacatcacattctctctctctctctctctctctctgtctctttctttctctctctcttgacctagatagtttggttttggtaaattcttccaaacatttaaagaagaaatagcacccattctatgcaaatcattcctaaaatatcgaagagcaggcaataccttccaactcactacatgaggcctatattgccttggtataaaaacaggcaaatatatttcaataaaaaatgttacagactaatacccctcatgaacatagatggaaaaagttctaaataaattttagcaaatggaatccagtagtacactaaaattataatatatcatgaccaaacaagctttatttcaggaatacaggattgtttaacattcaaaaatcaccatattaatcacctaaaaaaatctcaggcatagaaaaaccatgtgacaaaatcaatatctattcctaactaaaaacaaaacaaaacaaaacaaaaactcttggcaaaatataaatagaagggaatttcttcaacatgataagaaacttatgtgaaaaacctatagctaacatcatatttaatcattatttagtgaaaggctgaatgttttccccttaagatcaggaacagggatatccactttcactacttttgtgcaacattgttctggatgttttaaccagcataatcagtaaagaaaaagaagcaaaggaagatgtaaaactcatttttgtttacagatgacatgtcatatctgatagaatctatttaaaaagctaccagactaataggtgagtttagcaatgttgcagaataaaaggacaatatacaaactttgtatttgtatttctacgtactaacaacagttagaaattaaaatcaataaaggaattccatttagaataccataaaatatgaaatacttaggaataaatctgatgaaatatgtgaaaaaaatcagtacattggaaattatagaatattgctgagtaaaattaagtaaaattaaagaccttaaaagtagacagatactttgctaataggttggaagaatcagtatcattaagatgttcattctctctaaccttatctaaagattcaacacaattccacacaatcaaaattccagttgaaatttttgtaggtgtagaattaacaggttaattctaaaaattgtatgaaaatttaaagtacctaggagagtcaaaacagctctgaaaaaaaaagtgaacaaagttggagatcaaagaagaacaaagttgtttcaataattattataaagctgcagtaaccaaaatatagtattggtggaaagatggcaaaacagattaatagaatggagagtccaaaattaaaccatacatataaggacaaagacatacaattaaatggaaaaaggatagtcatttcaacaaataatacagaaacaattaaatatacatgtgcaaaaaaatgaacttggatccatacctcatatcatatataaaaatttactcaaaattgatcattgctcaaaatgtaaaactacaaaacctctagaagaaataagagaagaacatctttgtgaccttgggttaaacagatttcttagatatgaaaataaaagtatgaaccataaaggaaaaaataataaattgcattcatcaataataaaaacttctggtattcaaaagacactgataagaatgaaaagacaaaccacagactgtgaaaaactatatgcaacatatatctaatataggtttgaatctagcagtgtgtagagggaaatttatagcactaaatgcccacaagagaaagcaggaaagatctcaaattgacaccctaacatcacaactaaaagaactagagaaacaagagcaaacatattcaaaagctagcagagggcaagaaataactaagatcagagcagaactgaaggagttagagacgaaaaaaatccttcaaaaattcaatgaatccaggagctggttttttgaaaatcaacaaaattgataagaccgctagtaagactaataacgaagaaaacagagaagaatcaaatagatgcaataaaaaatgataaaagggatatcaccaccgatgccacagaaatacaaactaccatcagagaatactataaacacctctacgtaaataaactagaaaatctagaagaaatgggtaaattccttgacacatatatcctcccaagactaaaccaggaagaaattgaatctctgaatagaccaataatagaatctgaaattgaggcaataattaatagcctaccaaccaaaaaagtccaggaccagacggattcacagccaaattctaccagaggtacaaggaggagctggtaccattccttctgaaactattccaatcaatagaaaaagaaggaatcttccctaactcattttatgagcccagcatcatcttgataccaaagcatggcagagacagaatcaaaaaagagaattttagaccaatatccctgatgaacattgatgcaaaaatcctgaataaaatactggcaaactgaatccagcaacacatcaaaaagcttatccaccatgaccaagttggcttcatccctgggatgcaaggctggttcaacatacgcaaatcaataaacataatccaacatataaacagaaccaaagacaaaaaccacatgattatctcaatagaagcagaaaaggcctttgacaaaattcaacagcccttcatgctaaaaactctcaatcaattaggtattgatgggatgtatctcaaaataataagagctatttatgacaaacccacagccaatatcttgctgaatgggcaaaaactggaaacattccctttgaaaactggcacaagacagggatgccctctctcaccactcctattcaacatagtgttggaagttctggccagggcaatcaggcaggagaaaggaataaagggtattcaattgggaaaagaggaagtcaaattgtccctgtctgcagatgacatgattggatatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaattgtgagtgaactccattcacaattgcttcaaagagagtaaaatacctaggaatccaacttacaagggatgtgaaggaactcttcaaggagaactgcaaaccactgctcaacaaaataaaagaggatacaaacaaatggaagagcattccatgctcctggataggaagaatcaatatcatgaaaacggccatactgcccaaggtaatttatagattgaatgccatccccatcaagctaccaatgactttcttcacagaattggaaaaaacttctttaaagttcatatggaaccaaaaaagagcccgcattgccaaatcaatcctaagccaagagaacaaagctggaggcatcatgctacctgacttcaaactatattacaaggctacagtaaccaaaacagcatggtactggtaccaaaacagagatataggccaatggaacagaacagagccctcagaaataataccacatatctacaaccatctgatctttgacaaacctgacaaaaacaagaaatggggaaaggattctctattcaacaaatggtgctgggacaactggctagccatatgtagaaagctgaaactggatcccttccttacaccttatacaaaaattagttcaagatggattaaagacttaagtgttagacctaaaaccataaaaaccctagaagaaaacctaggcattaccattcaggacataggcatgggcaaggacttcatgtctataacaccaaaaacaatggcaacaaaagccaaaattgacaaatgggatttaattaaactaaagagcttctgcacagcaaaagaaactaccctcagagtgaacaggcaacctacagaatgggagaaaatttttgcaatctactcatctgaccagggactaatatccagaatctacaaagaaatgaaacaaatttacaagaaagaaacaaccctatcaacaagtgggcgaaggatgtgaatagacacttctcaaaagaagacatttatgcagccaacagacacagtaaaaaatgctcatcatcactggccatcagagaaatgcaaatcaaaaccacaatgagataccatctcacaccagttagaatggcgatcattaaaaagtcaggaaacaacaggtgctggagaggatgtgcagaaataggaacactcttacactgttggtgggtctgtaaactagttcaaccattgtggaagtcagtgtgtcgattcctcagggatctagaactaaaaataccatttgacccagcaatcccattactgggtatatacccaaaggattataaatcatgctgctataaagacacatgcacacatatgtttattgtggcactattcacaatagcaaagacttggaaccaacccaaatgtccaacaatgatagattggattaagaaaatgtggcacatatacaccatggaatactatgcagccataaaaagtgatgagttcatgtcctttgtagggacatggatgaagctggaaaccatcattctcagcaaactatcgcaaggacaaaaaaccaaacatcacatgttctcactcataggtgggaattgaacaatgagaacacttggacacaggaaggggaacatcacacaccggggcctgttgtggggtgggtggggggagggatagcattaggagatatacctaatgtaaatgacgagttaatgggtgcagcacaccaacatggcacatgtatacatacataacaacctgcacattgtgcacatgtaccctagaacttaaaagtataataaatatatatttatatatatacataaaactctcaaaacttaagaagaaactaacaattttaaaggtaggtaaaagatttgaattgatactttaccaaagatagcagggaaaaaaaccacatgaaaagatgttcaacacaatgagtcattaaggaaaggcaaattaaaactataatgaggtactattacacatctattagaatggctacagtgaaaatgattgacaataccaggtgatggtgaagatgtgaaggatctagaattctcatacattgctggtgggaatgtaaaatgaaacaagaactttgaaaatcaatttaacagtttcttaaaatataaacacatattcatcaggttatcaagcaaatccattccagaagaaaaggaaatatatcagttcatgcagagacttatgcacagatattcgtagcagctatataacttcaaactgaaagtgactcaagtgttcatcaacaaatatagacaaattatgtaatatatctttacaatgtaatattacttggcaataagaaaagaagtaaactattggcacatgcaaccatctagataaacctcagaatagatatgttgagtggaaaaaattcagactccaaacacatattgtatgatttcatttatataaacctcttgaaaatgcaaataaatctttagtgacagagagcagatgagtgattgctttgggatgggggattgggaaagagtatgaggggtagaggttataaaggggcacgtggaaacgtttgaaggtgatagatatgtttattatcttgattatgttgacagtttcacagatgtatacgtatgttgaaaattaccagatttaaatgtaaatatttccagtttattttatgtcagttctacgccaataaatctgctttaaaatatttcttctgtagtttcctaaggcttttagaataagaacaaacattttaaatataatctgactagtctcacctctactgtcttcttcagcctctgttcacttgatatttccccttattttctgtattacgtttatctcagtccttcccatgttcttgtttgctggtaccacatattctttgtatatcctattccctctatttgagatgcttttcccctttccgtttgtctagttaattcccacttatttttcttatctcaactcacttatcactctcctaattatgccttcctacctccatttttagatgagattcccctatatatgctcttatagagccatgtagctctcctcgaagcacttatccccatctgccttctccattggtttgtaatctccatgaggccagcactgcattgatctgtacttaaccactgtatcccgaacttggcctagtgtctagcacatagtagatacttcaaagtatgtaattagtaaccaaaagggggagataaagttaatgtgctaacgtcgtcaaccaagcaaagtttttccatgatcagatgctaactaaagcaaatacaatgcacatcttccaatgcattacatttgagattgacagtccttgtattaaaggaagaaagcaccagcattcatgtaatacaactaactcacacactgtaccaaaaggtaattttcttataacaatcttattttaaacaaactggacataagaatctaggtgggctgtacttaaaatttggtaccatcagggacttgaaccattatgcttgcagctcattaacagaaaaagtgttaattgtatcattatcttaaatctgtgatacatagctggagattgtatgagaaatctgatgtcttcacagttttaggggaggaattgtttcattgagtaatcattcaacttgctgtatgattagctgagggccccttcttgtgacataatagagtggtgttcctgggggtatgtaagacacctcatttagttcatgcagctagaagagccatctattgttcagatgaaagggagctgataaggaaaatctatttgtagtagagaaccacacagtggcaatataaagccatttaaaatgagccatgttcttgtcagtcttcccatgaattgctgctttcaaagttgaactctgatttagtatatttttttgacaatgatcaatttgcctttgtttcacagatgggcaacacaatataaaaatagaattagtgatttcacaggaattttgctgtgcttggttgacatttgttttaaataagtttcttggctagctttggtgtgtaatgaatgaatgaataaaagaatcagtgagtggacaaatggatattattaagcatttattaatagtatgtgccaagcattttgataggtacttttacatgtggcattttagttaattctcataggaaccctgtgacagaggtattattactcaacaacctcctcccctttttttgtacttaagaaaattaactttcagattaagtaactaactcagaattgcatagcaagtgtccaaactgggactggaacatagatccaacttttatcatttcaacattgacatcaaatttggtgaacaatgaggcctaagaagagttcttcttttatttgaattttgccactaagaatattctcagaggtggtgtagagggtagtgtttcggagttgctttttcaaaatggaaacaaggctgaaagtgactgtcatgagaagtctcaaaggcaaaattgtgaggggacaataattatttcaaaaaacacttggtgctaaaacaaaatgtcaaaattgattcagaacgaataggctggcatttcttcaataaagagtgtactccttctacctaggaggtggcagggaggggagctgggtcaggactcaaagatcttcacaatatttcacctagggcctaggtggaagcagtggaaagcctggccaagatcacttatttattggttctttattcatccatttattgactaatcagctaaataagaaaactatttcaagtcaaggtcatgcaaacattctaagtatgacttagataaaggccaagcagtcactacgtgtgactcgctcaaagtagtctatacttggggataggtgagtggacatagaggacttagaaattacggtgaacagaactctccactccaattcaacagaatatgcattctactcagcacctcattacacttattctaaaattaaccacataattggaagtaaaacacgcttcagcaaatgcaaaagaacggaaatcataacaaacagtctctcggaccacagtgcaatcaaattagaactcaggattaagaaactcactcaaaaccacacaactacatggaaactgaaaacctgctccttaatgactactgggtaaataacgaaggcagaaataaagatgttctttgaaaccaatgagaacaaagacacaatgtaccggaatccctgggacacatttaaagcagtgtgtagagggaaacatagcactaaatgcccacaagagaaagaaggaaggatctaaaattgacaccctaacatcacaattaaaagaactaaaaagcaacagcaaacaaattcaaaatctagcagaagacaagaaataactaagatcagagcagaactgaaggagatacagacccaaaaaaaccttcaaaaaatcaatgaatccaggagctgggtttttgaaaagatcaacaaaatagactgctagccagattaataaagaagaaaagagagaagaatcaaatagatgcaataaaaaatgatataggggctaccctcactgatcccacagaaatacaaactaccatcagagaatactataaacacctccatgcaaataaactagaaaatctagaagaaatggataaattcctggacacatgcaccctcacatgtctaaaccaggaagaagttgaatccctgaataaaccaataacaagttctgaaattgaggcagtacttaatagcctaacaaccaaaaaaagtccaagaccagacagattcacagccaaattctaccagaggtacaaagaggagctggtaccattccttctgaaactattccaaacaatagaaaaagagggaatcctccctaactcatttcatgaggccagcatcatcctgataccaacacctggcagagacataacaaaaaaagaaaatatcaggccaatattcctgatgaacatcgatgcgaaggtcctcaataaaatactggcaaaccaaatccagcagcacatcaggaagcttatccaccacgatcaagttggtttcatccctgggatgtaaggctggttcaacatatgcctttcaataaacataatccatcacacaaccagaaccaaggacaaaaaccacatgattatctcaatagatgcagaaaagacctttgacaaaattcaacaccccttcatgctaaaaactctcaataaactaggtatcaatggaacgtatctcaaaataataagaggtatttatgacaaacccacagccaatatcatactaaatgggcaaaaactggaagcattccctttgaaaattggcacaagacaaggatgccctctctcaccactcctattcaacatagtgttggaagttctggccagggcaatcaggcaagataaagaaataaagggtattcagataggaagagaggaagtcaaattgtgtctgcagattacatgattgtatatttagaaaaccccatcgtctcagtccagaatctccttaagctgataagcaacctcagcaaagtctcaggatacaaaatcaatgtgccaaaatcacaagcatttctatacaccaataacagacagagagccaaatcatgagttaactcctattcacaattgctacagagagaataaaatacctaggaatacaacttacaaggaatgtgaaggacctcttcaaggagaactacaaaccaccgctcaaggaaataagagaggacacaaacaaatgtaaaaaccttcattctcatggatagaattaatcaatattgggaaaatggccatactgcccaaagtaatttatagattcagtgctatctccatcaacctaccactgactttcttcacagaattggaaaaaaaaactactttaaagttcatatggaaccaaaaaagagcctgcaaatgccaagaaaatcctggacaagaagaagaaagctggaggcatcatgctatcttacttcacactgtactacaaggctacagtaaccaaaacagcatggtactggaagcaaaacagatatatacaccaatggaacagaacagaggcctcagacataacaccaccatataaaaccatcagatctttgacaaacctgacacaaacaagccatgggaaaaagattccctatttaataaatggcattgggaaaactggcaagccatatgcagaaaactgacactggacccgttccttacaccttatacaaaaatcaactcaagatgggtcaaagacttaaatgtaagacctgggaccgtaaaaatcctagaagaaaacctgggcaataccattcaggacataggcatgggcaaagacttcgtctaaaacaccaaaaacaatggcaacaaaagccaaaattgacaaacaggatctaattaatctaaagagcttctgcacagcaaaagaaactatcatcagagtgaacaggcaacctacagaatgggagaaaatttttgcaatctatccatctgacaaagggctaatatccagaatctacaaggaacttaaacaaatttacaaggcaacaaccctatcaaaaactgggcaaaagatataagcagacacttctcaaaagaagacatttatgcagccaacagacatatgaaaaatgctcattatcactggttattagagaaatgcaaatcaaaaccaccatctcatgccagtcagaatggcaatcattaaaaagtcaggaaacaacagatgctggagaggatgtggagaaatagggagacttttacactgttggtgggagtgtaaattagttcaactattgtggaagaccatgtggcaattcctcaaggatctagaaccagaaataccgtttgacccagcaatctcattactgggtgtatacccaaaggattataaatcattctactataaagacacatacacacgcatgtttactgcagcactattcacaagagcaaagacttggaaccaacccaaatgtccatcaaaaatagaccagataaagaaagtgtggcacatatacaccatggaatactatgcagccataaaaagggtgactttatgtcctttgcagggacatggatgaagctggaaaccacaattctcagcaaactatcacaagaacagaaaaccaagcaccgcatgttctcactcataagtgggagttgaacaatgagaacacgtggacatagggaggggaacatcacacaccagggcctgcctgggggtagggggtatgggagggatagcattaggagaaatacctaacgtaggagacgggatgatggttgcagcaaaccaccatgccacgtgtatacctatgtaacaaaactgcacattctgcacatgtacctcagaacttaaagtataataataataaataaattacagtgaacacaaagggttgacaattatgggggaacatgatgcatattagagtccatttatatggggtctgagaatgtatcattgcatttgtgtgttcttcagtaagaggagtatggaagagctgagaaagggtctaaggagagtcactgagacagtaaaacttgttaagaaaggttaaagatttagaattgttcagtataaagagattatacatattgggtgagtctaataggtttattcttttctgttaactttcattaaaaaaaaaatcagacaagtgacacaaagcctttataatttactgagtggctaatacaaaccagataaagatgacaggcattttgcaatatgttatctcattcaagccttatagcaatgctatagtattatcaccattttacggaacaagaaatggtagcttagataagttaactagattggtcaatcatttgtatggactttgagtatatttgttcgttcttaattgtatatactttgttactgttaggaagagcttcgttactctcatttcagagtaacctagtcaactggtttgtaaactcattgatggcagaaagacattcatatccctctctgccttacatgtttcaggaaactcaatgataaaaatgcaatgttccacttacatgaaaacatctctactaaagattaaatgaaataagtggacttcaatttacagtaggagaggagagggaaagggatttaaaggttgaaatcacacagctaataatgccaaaaccttatatgtttgattgtctccaaagttcatgtgttatctaaaaactatgctttccttataggggtcataaggaagaattctctcaaagagttactaaataacaaacactattatagagagtagatgaaaaattgggatgtattagctattagtgatagctgggatagtctatttgttaagaccttagatcctcaaatcaggtggcttggcttcagatctcaattctgtcactcgaataagccatagtctcttatattactgttatcaatattctctctttcctccccctgaaagaattatcattccccaacctttgtcatcaggttgaccacatgacattccttagctaataaaatgtaagctggaagatgtttttaatgtctgaacagatgttttaagatctgctgcatattcagccattgatcatttttccttccaccatgagaacattagatagtggctactcttctatctgacagaagctactgatagaccgtactcttctgccaatggacaacatgggctagaatgatagctaagctatgaaggacatctaacatgaggaagaaataaacatttgtgattgaaagtcatcaaaaatatttttgttagttggttcatttagctgattagtataccaattttgttaccttgggcattacttaatctcgccctgtcatttgctttcctttttttggtaagattgagtgattgtgatggttaaatatattaatgtagttaaagtacttagaccagtgctatactggtaaaaggttttttgcagaaaaaagtcctgaattgtagtgtttgttagtttacatggtataaatattctctcatgactgattcaaagctactagcatgatgtcactgaatgtggaattagaccgagttacacacaaccagctgtcatgagtaggattggctctagcactctgtggaattcagaacagtgtacatagcaagcatgatattagtgcctatcaaatagtaagtgttatagaagagcaaattttctgaagataggtaactgaacaaaatggtttctcaaatttactttacattcataaaaatgtatttagaagatcactcagagaacttcaacattggaagcaaacttagaaataatctagtatacctatttcatcttaataaaaaaggaaactgaagcttagagaggctgagtagcttgctcaaagtcacacagaggcagagagtaggaaacagcaccatggctcctagtagccaatctattcttttccctcgcaacatgaacaaccccttttttaaaaattgctatgaaaaggatcagcaaagaaaaaagatgcataactagctaatgcctcttactgtgtcccagtttctgattaagtataacaataataaatacaagatcaaaattaaaacctggttacatttattgataatcctgttttttgtaattatgagtccattttgaggaaagttgtcattaggagaaatgcttaatagtgtattgttgtgatgcatcattttataaaagtgataattattaggaagaactgtaaattttatcaatcattgaaaggtctaattaagagtagttattttgactataaaaatgaatgcgtcatctccttgcatttcctagtaatatctcctaaaaatattgcagtacacccccatgcagtacactctcaaattagtgcttttcaaaccagtaatgcaatgtgttggtatcttaaggtaacagtaattcatttattttaataatagtggttactggctgtaactatggaatgcattgtcatggaaaccactttccccctcatcttcccctccaatttaccccagagttattatttggagaggagaattaagggaaagcattttctctaatacatataaacggataacagataaacacatacacatgcacatacagagaaatgaactctcactgattaaagttaaacataaaaagtcaaggaaatgaaatatacattttgttttatattttgtcatttcactttatcaatctaaactagcacaaactgtaaaatggggaataacttgcacatagcagccttaatgctgccctagaataggaggtcagctttagcttgggtaattcatcagggaaagactgtgttagatattattggaacatcacaatatggagcatacaatacttttggggtgtttgaaatccaaattataggctaatgaataagggaaatgttgtacagcttttttaggatctattctcttggaaaaaccagccgtaattatagatgctctgtaggtgggagtgctcacacaatcacactttttatgctaacataaaggaataaaatggtaaaggatatacttaatctgtacatttgactttaaattttcacagaaggcctcagaccagagttttgctcctaaaatgtgacctagtacatttaagaacgtatagattagacctcctgagtccctccagctattcattagattgaatcagtactgattcctaatggagaaatctactaggcaaggacttctgcacttagtgtaagaatcccaaaaccttaggcatggctgccctctacagttagaaccaggtgtaactcaactctgagggtctttccgtgttgaattttgctcatactttgttccatattgagtttccttcagataagtcttatttcataaagaggacttgcattcctctcacaagggggctgattaaaatgtagatttattgacattctactggcctatgggatgaaaatgtagggttgggcttcataatccatatttataataagcatcatagagaattatgacataatcaggtttattttctattaacttgggagaagggacgagagtattttggatatgggtggggcaaaggcatgttataaggcactgtctttgacttaaaggtttacaagttggtatgttcttttgttctaaccaatacatttaaactttctaaggaggaagcataccatgatattgaggctcttattagtttcggatataggtggtctgacattctgatggaattgcatcaggaggatgtggttctaacagtttgccatggatacttttgactatgttgttcctgtatttcaggtgggatttctgaatttagcaccaaattgttaagtgtcttggaattaccacattcatgtaaatgtgacagtcctggtccttcccaaataaatctgaagactttggaacatgtttctggagaagtgtgttatgtctctcatgatgctgttttctaaactctcctctactacttttctttgaacctaaccttcaggtttattgattatgtgacttgagcaagtgatataacactaaggggctcagtttcttcccctagaaaaaaaatatgtcaaataatatctacctctgaagctaagaaatgaaataagctatgtaagttaagagcagctaccatgtactggggcttaccacaggaatgtgttgttcagtatatctgtctagtcttcctgacaaccctttaggttaggggttaataccatctagttacaggtaagcaaacaggggtttggataatgtaaatgacttacacaaagccacatctagcaccagagccagaatctgtttccaaactcggatgttttgctctctttctaccaaccatctgtgaggcatagtgccaggcacccaggtggcacccaaagagtgctagttttacccacttcctacccccacacccttcttatcacatttgtttttgtcttccataagcaattttgcagctgtgccagccagccacatgctgatttttttttttttttggtctttctgcaattttgacagcctcagttaaaaacaaaaaaacaaacaaacaataaaacatccatcagtcttgtcattcatacttctggaacaacataaatactacttctggggtttcctggagtctcaaagacatcaaggtggggaaggggcagacacttcttttttgagtttgacaaatgttatgtcaaataaagccttggttctgaggccgcttccctacccagggagtgagtaggctcgctgaaccagaagtcaacctcgtagggcaccagcgaaatcattttgagcctgttttctaccccagatttctttgctggccctctgcccccggcaaggcatgctgttgtcaaagggctgggaggaagttccctgccgcgctccgagcgggcctccccttcccgggaagtcggcctcggaggtcttctaccctcgggtggctgtagcggtgggggccaaatgcagtctcggggtcacgtcagcgcggggaggtcccgcgctcccacgctggggactccttcgtggcaccaagagcgcccaaaggcagggccagtctggcaagcacagcgcttcctccctttctcagccccttcctcccaccccacttgcccggccagcgctccccacagtgactctggattgcagcaagccactggctttttaccaaatcgggagctgcagtatgttttcttcttcttcttcttcttcagagggaataatttcagcccccttcagctcgcatgacaatcttgtgtgactggggagagtaggcgggcacatccttttacatgctaatactgccccacctcctttgaaccctcctctaagtgcctggcttccttttatttttatggtttatttttattttattttatttttattttacctcccccaaattcaccgtagggggaaaaattctttcttggttctgtccctccccccacacgcctcgttccccagggaagggagaccccgagaggctcggtacttgcccgcggcgttgcttccaccggggctccgggatggccacggcgggtgcagggggcagtgatcgaagcggcagctcggtctaggctgtcgctccatgtgcccggcgagcacagcgtttgggtcccccagcgagctgccactgccgcagcccggaaggaatgtcccctgttgttaaggaccctgactgttttacaccaatgatttgccactgcaaagttgcttgcaccaacaacactttatcgttgatgtttggatgcaaggtaggaagaggttcatgtctttttaatgcatgttgcctccctcgggggagagaacaattccttctgttgcttgtttatgtctgcctgttgggagagtgacagaagctgcgactgctctgctctttctgggagccagctgggtttgggggccaagagatcgcactgattttctggcgtccgatgttgggctcataactcaatggtgatgggaccctggtctctaacatacagaggctacaagagcagatgcagctcggaaatggggcaccttgggtggctctctgcttgggatctccttatgcatttagctagtgactgggctccagactgctaatttgggagctcctgaactcatctcaggttactaccacctagagccccaacccactgggctaactagcaggagtaagtggggtggtcgatgaactctagataaactgacattttttaagataaacagcttatttttattttagacagaaaatctggagctaggctcaggttgcccccagttgcatgcttttcccttttatacaatccacttgaaatcaacaaacaaattttatcaagaggtggcgcagttactcagtgaagtttgtagtaaataactgtcccaccccagatttttgtaaaggtgattggtgttcccagagaaatgaggtttgaaggtttttaaaacaggttatcattcattgctccttttctgaaatatattaatggtgcttccttgttggacctgacgacgcactccttgaaaaagatgcatagaacttggtgtttgaacagttttagcccattaatggcctgagtgcatgtcctgttactgtaagttacaagtcttcacttctttttgttgtgaaaagccagtggatttgtccagcttatttatataaaacacttcatgtggctactatggtgactgtctaaggagagagagagagaaagagagagagctttcttcatctgaaataactgaagtttgacttctctaagtgaatgtatatcacataattcctatttttctgaaagataacaccagagattggattggacagctggtaagcaccttaggcagtaaagttaatgaaacacacacactgaacttcatggatagtgctcacaggaggtgtaagcttaacggaaaaattgggagtcaggattttaagtcttatattggctatgcctagagaatcttctctgggcctcagattttcttctgtaaaatgaggactgtggatgagattatctctgaggcacctgccagctctaacaatctctggttatgtctttcatgaagtcattgaatgataatattattgccagagatttatgtttttctactcaatatgataggttacactgtagggttggttaaaaaatatattgcccatactaaagagtagcttgttgttcctttggaaaccccgaagagatcttagaattgttgaaggtttgtgtgttcatcactgtcaggaagatgtatgtgaatgaatagcaccaataactaaggagttaggttctctcccatacaacctgccacccctacctcatgcttttattcactctcctaactgcatttacagtagcatccttgcaatggctactgtttaaaatccattcccatgaacttacaagaattacttagcggtgctaaatgatatttaacaaaggtgaattatttgtcaagggaaattaaacacaagctaataatcaaataagataagccattggtgtagagaatgttgttgaatatgcattcgacccttcaagttcatttacaaacaagtttcttttatgctgttaggttttcccctaactttcaaaccatattggagggaattaaaataatttcaagcacacacttttttttttaaggctaaggaaatacattagtttaactttctttatgttctcttccttttggtattcggatttaacaaattcactttatgagagagattcatgtcaatagagtgaaacacctatgtcatgtgtgtttgcagacatcgttttttgaaaaataaattaatgttatgtgaaaataaaataatgcttttagagactctaacccatcttattttgcaaagtatttgaataagataattctcaaatccctttataatgggatcaattattatattataaccatacttaacagaaggttaattatagatgggttgacataaggattctatcttataatcttaaatatggaaagagtattgggactttctactgtagccttcctcctagtgaagttcttcaacattatctgacagatgacaacagaaaataatatgcaaaatttacctcacagacaggcttaagtttcaaagctaaattttatacttactattgatatgatttatgtaagtctcagtttcttcatatgtaaagtggccacagcaataactactgcagtatatattactatgtcattgtgagaaataacagttaaatgagatgcatgcagtacttactatgtataaattcatcaaatgattgttgcttatatggccttaattattttcatagcttcactgaggtgggcttattacttataggagaaactgctcccactgttattaagatagttctcttgataaattcttcatctttattaagaaatcaatcattacttttcccaaagttatttttctttgctctatgctgtttatgtaaaatataggaaccatttatatattgatatgacattcataaaatgaagtacatttatgaaaattaattaacaaattatactattattccatttgatcagcaaatatttattgaccacactagaaattctacacactggaggcatagcaataaactgctcttgttccctttggtctcaaatttaagtgatatggcagatgattacatttcttacaatattgatttaagaaaaaaatataaaataaggattttcattgaatcttttagtaattaaaatgggatttaaataatttttgaaaaaatcatggagacacagatttcaataaggatacttcagaaacctgcagtcatttcaagattacctactaagtgtgaaaataagattattaggatgaatatttatttcctttcctgaaagttatttacatggcaaagtctaaaaccattttcatgggtaggccagactgtcagtttcaaaaacactaaaactgtttgctctaattatctcagaatggcttcaaggatgctgagtaatttgagctttcaagctagacactcaaaagttatcttcttttgtcacttagccatctccagggtccgtcttgttgcatcctgagagctattcaatttagttaactgactatacgacttatgactgtaaacatggagtgtctttccatgctaggcattatgatgggcattagagatacaaacgtaagtacaacaccatttattccagaaattaattccaagcctattgaggaagtaattccacttcttttattaaaatacagatcacctacagtcccatctaaccttaagttctcatgagagaaaccaaaataaccttcttccaaaaaaaaagattttctattatatcagttcccccctacctttttttttttttttgcccctgtccatatgccatcatcacacctacaaggctatttatgggaatgggcttgccatggggaaggaggtcttctaaaaggtttttttctttgtcatagtagtttttatgtcattatcagaaaataggcatcaactttaccttcacttaactgttttctccatccacaaagatcaaagtattgaatttaatttcaagggccagcctatatagtatttctctttcctttatcttgtctatagctgcattgcaaaggtccacagtccatgtgtgtgtgtctcccttcttttattccccaatatttctaagataaaaatacatacaaacataaaagaatatttgttatttgtcctaatattctaaaaatactttataaattacagtattctctacaattattcctttgctttactattttaattaaaaggaagatgtaattgaaatatggcttatgttaaaaaaaatgcacaagggacctggatagacacttcttcaaaggagacattaaaatggccagtgggtacaaggagaggtgctcaacatcgttaagtatcaggaaaatgagaatcaaaaccacagtgagatatcatctcatactattaaaatggctgttatcaaaaagacaagaggtaaccagtgttgtcaagggtatggagaaaagggaacctatgtacactgttggtgagaatgtaaattagtgtgataattatggaaaacagtgtgaaggtttctaaatgtattacaaatagaattaccatataacctagcaatccccttttagatatataaccaaaggaaacgaaattagcatctcacagagatatctgcattctcatgttcactgcaacactattttaaataattcataatagccaagatatggaaacaacctaagtgttcattgacaaataaatggatgaagaaattgtggcatgtatctattttatagagatacatttatatctattctataaattagaatattatccaacctttgaaaagaaggataaccttacatttgcaataacatggatacacctggaggacattaaactaaatgaaataaactgaagataggaaaatgctgctgacctcacttatatgtggaatgtaaaaaaaaagtagaacacatacaaactcagtagaatggtggttatgggagattgggaggaaatttgaagatgtgggttgcaggaaacaaagttgcggttatgtggaatgaataaacctagagatctcaggtacagtgtttggactatagttaatattggattgtataccagaaatttgctaagagagtagattttaggtattcttacatacacacacacatacacacacacagagtgtaacacagataatgggtatgttaattagtttggctgtagtaaccatttcactatatcaaaacattatgttgtatattttgaatatttacagttttaaaagaaacatggctaaaacttgagcacctctttctttctcataatagcaatttgttaatataacagctcaactgaaccactgtgaagcccgtaggacacatcaggtatcttcaatattgtttttatatattaagataggggaaagtttttgaaaatgttatagagtcctgaaattttatttttttctggtgagtatttggaccttttgtaactgccctaaccctcaaaggaaaggagtcatcttctagaaagcaacctacctttcttctacagggtgactctcacaaaagagagaatagggagagtaagtggaaggttaaaatggaagaaaatggaaaaataaaaaagggagggaatcagaagaagaaagggatgagttcaaggactaaaacagcaaaaggaaggggtaaaataatttggttttattaaacatatatacagtatcttaggtgttttaccagtgttatttcttccaatctccgtagttaccaggcaaacagaagaaggagcagggaaggaaagaaaatagaacagaatgataggaagggaaagatgggaagggaaagtcttgggtggggcggggaggcagagagagagagagagagagagagagaaagagagagagagagagagagagaaagagaaagagaaagagaaagagaaagaaagagaaagagaaagagaaagagaaagagaaagagaaagagagagaaagagaaagagaaagagaaagaggaaatgggttgtgggctcccagcctccagagggtgctctaacactcacccaatatcagagggcctgtcagcacctccttggtggacagttccctggaaccttctgcctttctccacctctcccagacccctttttcctgcctagacagtctctgtggcagagaagtagttttgtttgcccatttgtttatttaaatgtggccaactttgttgtaaaacattagtggtagcagaggagccatcaattcatatatcattatgcatattttttgtcactagcagggtagtttccctttacctattttgaatattgccaaaggttgaccattttggtatatgttttttttttattttatagtaacatgtgttcattgaaatatattagaaaaaaacagaaattcaaaaaacaaactttagaaaatactttttgtttcagaggactagatgtaaaaacttaatattttagtgtgtattttcctagtttcccagtactattttggtttccttggtttatacatgacttattttaaaagtgtagttgtaatcatgttgagtctgcatttgaataatttaaatttatattaggctttgtgaatgtattttaattgctgtataacagttaaccatccttttgatattttggcttttttccccttaaattttctactattaaaaataaaatcaacatcttggggaataagtctcttttggatttaaaattatttcctttggataggatagaataagtaaaattactaagtcagattttaaaaaataatttaagatgcttgatgatgggtatttctgcatttattttaatcatagttatataaatttatattgctgcaagctactttatatgtcatcacattcttcatctttactttatggatttgtaaataagaggtagtctagtttttctcctgtgaatcgggttaaaactctgttagactttgagttaataggagtctcacgactatattgctttgtatcacctcaaaaatacctaatatgcaaaaaatccaagtgttcaaaattggtacattaaggagacagctatttacattgccaagacttcagtttctctctcaatacatacacacactgacctgctaccagttgtcagacagtgttttcagaaatgtcaactcacttaatctttacagtgcccctttgagatgggtatagtagttaccctggttaccccagtgttacaggtagagaaattggggtgcaggtggtttaagtaatttgcccaaagtcatatcactcttaaatagcagagccaaaatttgaacctaagcaggttagatttggaatatacactcatttccaatataattttgtactctttcaaatagcaggattctatgcttaagtgcctttaagctatgagtcaatttgcaaaaatgtcatttatgcacacctgaatttgaatgtaaggtacactgatgagaggagtcagttttattgtacaagaatttcttttgagaggagtttgatccaaacatcatttctcatagtattcacactatcattttctgcatgaggttattaaatcacatggatagaatatgacttactcaaggtcacacagcaagttacacagccaaggctacaactaggtcttctagtttcgaactcaatgttattctttctacgtcatgacctctaactctgaactagaagttttggaaatcaaggtgagaaaagagaaactgacaagttttatctgcaagaagttggaaaaataacaccctcctttcaggactgttgtaaaaattaagtgatagatcacatatcaaaacatttagcacaatgcctggtatgtggtaactataaaataagtggattttttttctattttattaaactactttacatattgctgagaagatgtagattgcagatagagtcaactgggtagtattaaatcaaacactttgaaattcacctatcagtaaattggaggtattttaacctaccaacacgttgttgaaggcttctaatgctacaaaaagaagaatctagaagtttatataattcataccaaaaacaaaaatcctagattatacctgacccagaaagagaaaatgaaaaatgagctaaggagttaaacaggtgctgaatgtcccaaacaagcaggctgcattgaccttttgacccccttgacaatacatacttgccacttcaaggtcttttacagtttttatttttaattttagaaaatttgagagaaaaacgttgaatataaaaaaataaggagggttaacttttatgccaccaataaagtatgttcacagaaagggaatattgaattgtacaattcagaatactgaaagagctcagactttaagaagccttttgccttgtactcacttatggatatccagggaaagttttaaataaagtacatatggtgaaatcattcccagtatcttttgaattaaattacccctggactcttatggcatgtaatacttaataattgtatcctaattgtaatattcaattgtaaattctgtttgcttatccatttgcccgtgtaaactgtagggattttaggggcaggagccatattatattcatttagtataatgcctggaagatccctgaaataaagactaggcattacttaatgtggtaccttgatgtggtggttaactttatgtgtcaccttgactggccagacatttggttaaatatcattctgggtatatctgagagattgtttctggatgagattaaattggtagacccaataaagcagattgtcctccctaatgtgggtgagcctcatccaaccagttgaagacctgaatagaacaaaaagcctgagtaagagggagctcctcctgcctgcctgctttgagctgatgcattgatctttactggcctttggacttgaagtgaagcattggctctttttgggttttgagcctgctggcttttgtgctggaacttatatcatcagctttctcagttctcaggcctttagactagaattggaactgcatgttggctctctggggtctccagcttgctgactgctgaccttgggacaaaacctccgtgataatgggaaccaattcatatgtgtgtggggggtgggggagggggtgggggaggatagctagatcgatcgatctctctctctctctctctctctctctctctctctctctctctctctctcttactggttctgtttctttggagaaccctgaataatgcagctagtatctggggtgagatgcctggctctgtcatcactaattggccattcttgtctagtaaggtacagagaagctgataaatcataaacgcaatcagatctccatgccatggtgatcttattgaaattaaaatagtttcctcataaggttatggatttactttattgtaagtcacagattatacttccagagacaccatagtagaaaacatttaaatagtagaaaacatttaaaactactttaatgcttttttcagctctatatatatatatatatatatatctatatatatatgaatgtacttgtcagacttatgaacacattatatatttcagtgattataaagaacacagtaatattttttccatataaatttaaatgatggtgtcagatagaataacaatagcatcctgaatgatggcttctggaaatcttataaataaggtaatatttttgaaacttccatttgtgtgtgtgtatgtgtgtgtgtgtgtaattcctaatataaaatacataattttgatggggtttcatgtattatctttattgaagtttttttccaaattcctaaagtagtttaaattatttagtttgatgaatgagcacactaaaaacagtcattatctctaaaatgctggtccagtgcactgtaacagccttaatatccacattatggattaaaccaggcagggattaatgatatcactgcatcatatggcaaataatgatactatcatattatcaaataataatgatattattttataagttctcaaataagatggcagctactcacatgtcagttggcttattatctaagggtaggagacttcgatttttctcttggagccatgtctcaagtatcctcattatggtttggtgaaaatctccatttggagaaatgtaggtacacttgtccattaatcaatttctagttctctcttgagcatatatattatgtttaacattatagtgggcacctcaggttaatgctcaaatacggtaaaatagttcctgccttggggacctttcagttttgctggtgagctagtactaagaaatgtacatgggaaaaacaactcacaaagcagattggactaaccctttttgggtgatcaccacccacagtgttttattctaaggacttgacatgaattaatctatatgctattcaaaattaatctatacgctattcatttggaagttattaattgctatgtgacactctctcttcataagtacaactaatatcagatgagggcccatacagtagtttaaaagtagtctcatacttcagtaagttgaaggccctgctccagataatgagaagacaagagaaccaatgatgtctttaggtatagagaaggattttaggagttagtcagagtaaatctcagttttttaaagccttgtactgtgtcagaaaggaaaaataatttgattttctattcaagtctacaattgatctctatggtccaacacttcttgagaagtgttgaaagtagtagtggggcattgaaggtgtgccttccccttggatagaagtgggaaaggagaaagggaggaagagggggagagaatgtgagattatatatcctattctaccctctgtaccaagcaaagatactctgtgtatgctcttgggcaggcaaacatagatgtaagaagcaagtcctgagggtagagtttggcactgcaaagtattgtgactgaaccattagctctgtgactttggggaagctctttcacttctctgagctctagtttcttcatctatatgacatagataagatatatttaatgtgtttgttataccaaccaaacaagaaagcaacaaatacaatgtctcacatgtagtaatcattaaataaatattagttttctttctcttactctctcagatgtagtcctttctcttttcacttttatttgcattaacatagtatgaaataacctagaaagaagctttttcatgttcatacccaagactcaggagtgagaaagaaaagagttaactgtgtcaaccagaccatatattaactgtattcaatcttccttcgctgagtattcaccaagtgccatcactttgctagataaggtttcatttatcatctctagcatattattaatatatcctattttctcctatttgaagtagttggcataacctttcccatccccattatctcacttcagagtctgatagagaatgctcccttccctcacagcagcttccatgtgagcacagattcagtaatgtgtgtgttattatagcttttgttaccagatgtattggtgcctgatggtattcaactagacaacttttttcctaacatctgctgcctgagaaaattttgttttaaatattagtaaactttattttctttatttaaaaggccagatgaccatccaaaagaaatgctccttgggattctgcaggcctgcctaattcctaaatacaccttttttgaattttgtaaaatgagacattttctctctgtacttgtgcattgccctttgctgtagctatttccccaacaaattgctatggttggtctctcaagccagaggaaagaaaagggttttataataaaaatgctgacaggttcctagctacagcagtatgagtggggatgctatgatctcatttattgtagaaaccggatgcctgttttggctgaagggagagcaagcatcttccagagctctggggtttaaaatttttatcttgaaaagtttgcaaagaaaaaaaaaatgtggctgtagataaataggaaacccagaatatgcaaactgcacctttgttcttccactagaagtactaaattgaatttcaaaaacggtcttagagaaagtggtcataaggtttaagagactaaaaatggggattgtgtatttgcttgctgtgtacagaacttatctctttgtaatgattttatctggcaatttagaaagtattctcaatcttggtctcactcatattttaaaataatgtttactgttattatatagaaagccttcgtaaactagttatcttttatcccttaatacaacatctctatgaggtagatatttttatagacgagaacactaaggcacattaagatgaaaattctctttactagtaaggttcaaacatcaggctgaagaccatttctccataatatttttcagatgatcaaagaactatttgggggctagactagatggccccaaattaaagttcctttcatgtttatacataaatttggctataccttgcccaaagtgaccaagcccaaagtcgtggcacttgggtttaagcccaggtttctgactctgagcccagggaaagtctctatttttcttgtttgtccctctttgagcattttccggggactgaccatgcttccaaagcactaaacctatgtatttctgggatgctaccaagagcaaagggagaagctggtgcttgccccacagtttttatttatatatttgtatgatcaaaatgagtgcatgttacctagtcaaatcttgaaagccagagtatacatagtacagagggctcagctaatgcatactctcaggtaaaattccatctgtgcaatgaaggctgacaaatgtttcagatcataagggcagaagtagagctgaaggacttcagatattggtctcttctttcctctggcttctgacctctttcagccagctcctagcttgggaatacaacctattgtactcttataatggataagagtatgtagttaggccagttgaagtcactgctggctttctgttttattcttttccattccacttcagaagtccaggacctggatattaccttgatacttccagttaaatcagtttcacatacacctccatgtcagttatttacacttttagtgtcaagccaggaaactcagcaagaatttgcatgtgcccaaaaccctgctacttctcctacagaggagatttgtagaatcaaatatatctgaatgaaaaaaataaaaatctttatctctctgtaaagatagcttaggtggtagatgttctgggttctggggaggcagataaaaatcacttatagatttgatctcagattaatcagcattctactagtattcagactctaggtgttcgcttggggagctatatttgctaggtctggccaatttttggatgttgccagaccctcattcatgttttttcttccattctttggactcaggaagataactttcagatttttctgaccagaaaggataatctgaaatgtttcattttgcactgtcacagctaggtgttctgcaattttgaataagcatttggcattggtgtacaagtctcccttaaatataactttagagaagaggtctatctggaaaactctagacttcctttacagttgttaggttaactttttgtatttacgtttaattgacaatgtttacttagtttctctctgaagcagttttggaaaactgtatagcaacttcagcgccaatgtaatgaaatttgtagcaaagtaagagataatgaatagacttaaatagatttatagaagtccctccctccctcccttccttcctttcttcctttcttctttcctcctgtctctgttttcttgtttatttacttgttttactagttacaagtcaagattactttcttgctttctgtctggagaagcagattttccaaagtaagtttcatcagtaccagcgtgttaatgttcaggacctgatgtatttcatagatgatggttttgaagatccttattacctatcacagactcagttccatttaatctaattctatgttgaattgtgttcaatcaagatgtttcaatgtatcactcagaaaatattaatgagatcatttatacagtatgtctaaagttgcttagtttcaattgaataatcctgacttattgaacagtttgaaatctttccttgtatataatctggcttttcagagcccccaaagcactctctgtatagttgcttttggctctgaattgtgttagcaccttgtgctattatttaatcattgcatataaatattctacttattgccaacaagaacattcgtttgtttagcaaatacagtattgatctttttctaaacttgcctagtgccttacaatggtatggacgctatccaaggagggaagccatcaaggaaatattaatagtattccttcaggactcaatttgtgtcatctcttcatggaagacatccctggactttgtatcatctctgctcacatggagtcatggacttctttccttcatattgaactcaagtgtcacaaggctgtaaatatcatgaggtgtcagagtctgggacttaacatccagaacacctagctactgctatagtgcttacaacataagttcaatttattatgtttgttgaatgaatggttgatataatctattgtttaattatttaggcaattgagacctagtgttaatttcaaagaaggacctgttgaataatgacacccatcatacttcatttttaagatatttttatctgcatataatttctactgaactccacttcatgacagcagagggaaaatgaggtatttgataaatatatattgaatgaacaaataaatgaatcgcttggtcaccaagactgagacctagaagttggttgataagtacttggtgaggaatgaatggatgcatgaatgtctgtaaacataattcccatagtaacctatattttgtgagttagtttaaatccatcttaaaataatcgatagtttcataccagctggaaaggatttgttttgcttttattgcttataaaataagcagcttttgtctctctgacatagaatccatgtatggtccagtgtcttcaatagaactgaatgatttgcaatagaactggtaagaagggttggtcctgtactttgtaggatgaggcctggttccagtgctgccacaggaacctgtcagccatgttgctctggtcttctggctttgttagacatgtaggcatgagatagtccaggggaaggaaatctctggaaaattcccctatgtgtagggggcttctcagcaccattgtcttctccatcccaactacgttagaattcccagtccctgtgtaagtctttctgaagtaagtcatttattttccatgtgttagttaaactactttgaatgcttcattccctttaagaaatcattctggccaactaggcagaactgctaaagactgttgctaagagcaaccagctaaaaagtttgttcttaaattaactagcaagccacctcaaatccttttctagaaatgagtgtgcacatgtgtacatgctcatgtgcctacttaaatttaaaatatatatataatatatatgtgtatatacataatgtatatatatgtgtatatatacataatgtgtatatatatgtgtgtgtgtgtgtatatatatatatgaattaactagttactacctgtagattcaactttaatcagggtttctgtctagaagaaccaatcaagaagtgggaaatgtcagtgctttgtgaaagtaacaaaattaatgaattaattacttaggaaaagctctggtcaataatggttaagccatttgaatagtaaaattattcatattttcatatttttaaacattatattggtgtgaatttgagcctacatgtagaaaatttaggttgtatactccatgagggccagggctatctcttatttatgtatatctttacctctaattttcagtatgatacctcacacatagtaggtgcttattaatatttgttgtatacatgaaggaatgactgtctagatggtagtcccattatattaatgagaaattaggggcccagagtaataaataacgtcccatagttttatagagctaaatgggctaagctggtcttcaaactcaagtctgccaaactctgaaaactatactctgaagtgaaatgttgtttcttcttttaaatactttacagaagaacaaaactttgcagaactcagatttagactccttataatttaagaatcagcatctgtgaacatagagtgtcatagaggtagggatgtgagtttgcaaattcaacagatctggattaaaaactcctaccatttattagcagtagggatgtgggaaagatacttaaacttcctgaagacttgtcttcaagtgcaaaatgaaaagactagtggcatattaaaacacatattgtaagaattaaatgagattataaattaaatatacaggcagttaatatgatatatgctaagaagtactggctgctgttattactgttatttaaaacagaggaaaaaacaatataataatgtgctattctggggaatgtattaccctaaaatacatatataaatacacacacacacacacacacacacacacacgtgtatatatatatatatatatatatatatcttcactacatagttttagcattattttctaagctaagaagacactaaaaatattatccaggagctcttatggacatttctagtctaaaaaatgtatttttattctcttatttaacactttcactgagaatatcttcaaaattgaagatttggctagtttgcttatgttcattgttatcaaatttacctaccaaaatttgttttttctcttaactcaagctcttgagacccaagtaactaatcgtatgctaatgttttgagaaaactatagtttagtgtggggcattttgtggacttgagctttatttgtttatctcatagagggtgtatttgtggtgggcaactgtgtgatccttgcaaacatgaatggtaaatatttgttttcttcatttgttgaatcactttttttcagcacccactgcttatcttggtagaaatcatcatcttcattatcctatggctttgttcaaatctaatctgaggaaagaaaagttgatcatttagagcaagtcagggtctcagggttttcttcagagaaatttagtaaaccctactacagtagacacaatggaaaccatgattcatttgtatggtagaacctaacagtctttcttgtaaagacagcatattcatttttttgaaagaaggatgactcaattaatctaagcataggaacacttcattcatcttgcataatgagagtgtggattctgcttaagcacatttttctctaataaggtaagccccttttaagtgtgtaaaacattttttatttttaagaatttttggtgaaactttttacaagtataaactccctgttttgataatactataaggacaaagtgatatcaggcatgaaatctctgtaggaaaaagttgattctctcaatatgtaattattagttcatttacttttttatctcgataagtaattattaattcattagctttttaacaagtatttatagatcttttcatatgccagacactgtgtaaggttctgagaaggcaatgatgaagaaaatagatgtagtccctccttcatggagtttatagtatagtggaagagacagaagacttaaatagatatacaataacagctagaaagaagggaaagacatgataggagatcgtgtatataaggcctgatttaaactgtgaggtcaataaaggtttcaatgcagaagtaatacttggaaaggatgagttagaattagaaaggtcacaaagaatgcctaaaggtgttaagagtgagaagtgctttgagacagagcaaaaggaaatatttgagaggataatcaaggcttagtgactaattaatgtgtaaggaaggggaaaacaaaagaatcaaaagaccttttacattttaagtccagaggtctgaaagaatgatgttctgtcaacagaactagggaaattagaagtaagtgaagaatttgattttaagtccatttgcacagtaagtttggggtgatagtgaaccattcacatggttgatgaacctgcccagttgaaacacagcactaagtacattagagtaaagctgtagctacagatttgagagtcaaccactgttactgctgtcagaatgcagaacatgtagcaagaaccacaaggtcaaaaatcccagctttgagaggtgcagggtaaaagaagtatagcacagaagaccaagaggtttagtaccacaggaataaagcaaggcaagtatcccaaggatcagggagctgatgttattgatgatttatttattcgttcatttagcaaatatatgtattcaatactattttccaggtttgtgctaggcctgtggaaatgaacaaagcagttatatggcccagcagaggagagtaattattgagaaaaacatgggatttggtaattccattagagttcataggatgaaaacaaaattgtggatgacgatttcgacagaaagggggaaacatagagaccacagctgagtatgacttgagaaaacctttagagaaataaagaagaaaaataaggtgtgatctggatacatctgcaaagacaaatgaaggcactgttcggggctttaagtagagccacagaaagaagacaatgaggacactgcaagttgggcatgaaggaagctgccaaatattaggaattataaaactgggatttcagaatcagttctgctatgagtacatcttttctattttcagggactcagtttacttttcagtaaaaagaaaaataaaatgtgcctgggttgggggagctcaaacacttccaaattccctttcaattgtaacattttggaagtctgagagagtagggtattggcttaaggacacatgtcccacaagaagtatccagggtgagaatgggagtacaggacctatcatgcattcagtatctattctgagctaggggctatgctacatgcattttccctcaaaataattcctagaagtaaaggataacttgaatgaagaaaggcagaagtacctacactatcatgtcatagttctcatgttaaagaatggaagtgtgacattatagagattaagtgacttatccagtcacctgacaatgcatagaagggctgagattcaaattcaggtagacatgaaacagaagaaatagtcttctctcttgctggaattgtgcaacgttaagataacagaaaaaaaaaatgtattggaagtaagagaaatggcttgggaacaggtgcctgtgaacaggagaaaaagtctaagtcaactgtgattgggagtggatccaagaggaagacaggatggtctcattggagtggctattcctagacctacagtgttcacccagccgtgtgactggtcttgtctatggctttctgttttacatcctgaaagccagaatggaaagcagagactggagacaatccaggatcaaggaccggtacatatgtcttggtggaagtttaagtgctagactggggaatgatggcaggatgtccctcagtggctcactgcaagttcaaggttgggcaagaagtcagggtagccagaaaccaactgatagtgaggatgtctttgcttttccatgttcaagttacgttgtgtgtcctctataataattaaaagtgcaaacaaatggaggaggatgttaaaataagacagaccaagcttgaaatccagacaacactcctactcactgagtgatactgagcaagccgtcaaacctctctctgttttctcctctggaatgtagggctatttaggccaatattccaaatatgtgagatgaaggaataatgtgactttttaaatgtaatgttaccatacaatgccattcttgatgttatgtttgaataagatctgattttgtagaaatttttatttccttgatattttggttagctatacttgatcagttattttgtcacagaataattttattctgcaacttcaacatcttgtagaaagcgttctcaaaatgtctcaatacacatcaatttttacatgcccatgaaactgaagactgcttttgttgcttgctatttttgttcattttttttttgcacttagcattcatttatgtattctgaggttggctgaactggacactcctatttgatttcagtgtactccaaattatcttgagtaattattttctcttgatgctataatttataaaataaatattattgttttatactgtacaaataatgtctttaatgaacactgtaaggtttcacccaagttcttcttgctgggttaggaattaatagcaaagaaagtaaaggaagaaaagtagcatttattaactacctattatatataagagctaaccctaagtgtttaacaaagcatatatctctaatactcatattggcatattaggtagttattagcccattatacagatgaataaatagtctaagatgagtttattttcttcatgtcttactgctaggaagtggtacagcctacatttgacccaaagttgttgagactcaggtcatgcactttcccaaacatagcctgtttactgctttcatgagtgcatgaggtttgccttcttgaattctggaagctatcctatatgaagctctttttccaattacctcaaagcaaaaagaggtagaaaagagtcctttagagttgcatataccaaacaagaaagaaagcagagtcagtacccagcccattaggaaaacgagggagacgaagatagtcagaatggaagagttagaaagcaagttttttgagtactttccctgtaccagattctaagcaagacatcagagctctaggttagggccaaatcaggtgagaattcttttagaatgttggaataagaactccaacagtcatttcttactttgcttgagttagtctaggattagtcactcttcagtgcattttggtgacagaatgctcttcccctcaccatacagctcatcctgttgttggacaagtctgagggcttatttagaagggctttcttttattaatattagttaaattaaagccaacagttattatatttagcctgtgcatcagacactttaacgacattatttctactctttaccctagctcttcaagttaagtaaatttctacaccactaacatttggagaaaatcaggaacatgcccaagcacttacagttaataagaatcaaatccaggtttctttgactcttccttatgcaaagctgcctggctacaaattctatccatttgcacttttccaagaagaaatccagaatatagatgtgtagctgaggtctgaagagacttggggattttgaatactgggcaaagacattggaaggaaatggagctcgagagtggggcacagagggtagtgataagcaagcagacaattgtaatggatcacagactatgggattttattcaccagaagatgactgaaaattctgagttttaaaaatagcaacgcagtgaagattgatgactatttcatactatacatatgaagagatgaaattttatttttaaacatttgaataacaatgtattttcagaactacctaaaatgtcctgtaagaattcaacagtgatgaattgtggcagaaaaacaaaaaaaacgcaacagtatattcagttgacttttcataaattaactgtgtcttcatctttaaagcaatgtatatgtaaaaggattcttatatatgtcattaatttcaggtatcttatttcttacttagaagaacgtttaattttttcagatacacatctttggatatatgctataaaagaacaattaaacttagaacgaagtatatgcacttattacatatgatgaagtagactctaaagtaaattagattttatgaattgtatattttacaattacttataccaaaaagtcgattgtattttgtcatttaaatcatagatgtttgaatctttgttctgccacttatttctgtttagcaattggacgaatagattaatctttctggaccttggtttcttcatttgttgactcaatttaatatattttatattgtgctgttgtaagaaggaaatgaactaatacttgtaaagtacctagctcaatgttcacaggcagtctgaaatcagaaacagagaaagtgagataattttgtatgtgaaagacaaacactatgaatttaaagttcggatcagatggctatatctcactattttgctttctgccttcatgctacctttatatcatctatttagttaatgacttatcagcaaaggccctatccaagaactattgtgtattttttgttaagcaggtcaaatccccagacacatttagaataattaagaatttcaagtgaaatatgtttaatgttatactgatgcattcttctttgatggtagacattaaataaaataattgaactgaataattgaattttaaaagtgatttggtgatagaaattagctgtgtttttttcaaaaggtgtcatgactaaacacattactttttattgtggaaaacaaatacaccttgtgcttttcaatggtgctaggtccatctagctgtaacataatcgatgtgtgcatgattaatatgtacttattatcatgaaaatactttgaaaagaaaaactgtgaaaacctgtcaatgacgtacatttttgagccaatgattgtgcttgaatattcactcttcttcagaaatgattttggaaaaataaaggctcaaagctttcgttctttaactgtaaaatagagataatgatagtaccaattcaaggagttgttgtgataattaagtgagataatacatggaaaaggcctggtacacttcgtggctcagtgtgtaagcattataaatgtattgtatttcaaatccatataattgcattggaaagactatacgaagacaattttattgtgtgtttttctaaaaaaaattagtttttgaaaagtaactattacctgattgtgtttcatgaaactgaataattatagctgaatttgattaaaaccaagttcacctgaattaagttgttttgtattcaaaatgtgtgtattcttaggaagagattgggatactaattcggctaggatgaataggtttatgccataagatgttggcttgtcatattagattctttgtgattatactgcctcagagaatctagctatagtcaaacaattacagaaaacagtactatgttccttttccagcaatagttccttaaggtttttgaaacaaaaccttggtaactgattaggtttcttgtatttttcttgctgttcctgtgatgcttttgtttgccctataaacacaggcagggggagaaataacttttatctctcccgttgcccaaggtaaaaatttggaggttattgttaactcctctatttcccttagccccaaagtctactgaggtacctagttctcctgagtcaatctctttaatatttttgaacccttcaatgtgggcaagttatttaatattttaagcctcaatttccttatatgtaaaattattataataataatacctatgccacttggaaattttgaggattaagataatgtttacagatttacttaccaatgtgacatttggtaagaggtctcaaatttaggctccttaacattctttctcacttcttcctccatatgtatccttcacattatttctccatatgtatccttaacattatttcatttctcacttcttcctccgtatgtctacatggtagacataacaaagtgccttctgtttgcttaacaagtgacagtctgtcttgtttttgcttccttgactttgtgttcactgtttttttctgcctggtttgtcaccactcacctccttgctcctcaagcctcttgcttccatggcatatactgctcacctttcgaacttagctaaaggggaatttctggttggaagatcctctaaacactctatcaacagcaaagtcaaggtcaagaaactacattctggagttttactgccttaattgaaatccttacttggtgtgtgatcttgggcaaaatacccaacttctctaagccccaattttatctatagatttgggtgaataatagggcatatttaatgagttgtatgaaaattaaattagacgacatacataagtgcttagcacagtgcatggcaaatagtaaggggtcaaaaaccatgattcagtaattataataagtagcatagagttctttgttctgacagagcacaaattgccctatgttttcttgcgtatttccgtgactttttacctaccagaccattcattcctcccagaccttctacttattcaattttattttgttctactcattcaattttgttttctctccatcttactttggagaccatgaaagacaattgttaagtgttcgttgaaggaaaattgggttactatttccattggtagtggtcttatttgaaaactggtaggattttctttttccatttttagcagtatttatggagcagacagcctagtatagggaaaagcattacatttcagtaaacagtacccagtatgttacaatctccttaagggtaaggtcaatcttgtatcagcctctgtacctccaaaacacctacatgtattactcagcatatgttaattattaagtaataatatatgtgttgatctctcttactaaactgtaagtagattttaagcagagatgtgttcttcctgttcaatagtaccaatcacataatacgtgtgtaataaattttaagtactctgttgtaattatagcctaatttataaagattatatttaaaatgctgatacaaaaccattccatgcaaaatgttcaaatctcattccatgctttctgacaaagctattataaatttctacagtaccagttattttagtaactttatttctttcagtgatgacttcagttctgtctgtaatttttaaaaagtgcatgctacatttaatttgggggccatatgttaaatactttcaatgtggtattcccaaagttgagtgtttaggattattatgattcagaggtgcttccaatgttgtgtttgctgttacataagccacacaaagcaatgcaagttgaacagagtggtttgaagctaaaaagttcaaggattaagtcttacctctgccagcagtgcatcttggacatgtcacttaacctctatgaattcacttttctctgctgtaatatgagcctgataaagcctaggcctattctgcagaactgtgcaaagggcactagtagatgtataatgcttggaacacaatagcagctttgcacagatggctattgtgattttaagcaaagaaggggggaccattttaccgaagcatatttttttaatcttatagaagctttgaccattaaaaggaaattcattcataagcatcaatatactagaaggtgccacaaagcccaggagcaatgaggcgaacaatttagccactttttacatgttaactgttaataaattgcatacagaagacaatttggactatacaaaatgttcttggaaaccattcctaacttaacaatagctaaatccatctgctctcctggagtttcatttagtttcacccccactctgtattacaaacccatatttggacttaactgattctggattaatatctaatttgttgtctaaaaatagaaaaagaagaggatctgataaacagatcaaaatcaggttacatgaccatggatattcactcttcttttttcctttcatccaagggttttggaagaaagatttttgaaattatggcttattctctgataaaacaaagtaggccagtaaaaaagtttgtaggattcatgtcgtaggtcgacagagagaaggaataaggctagagttgtcactctattactatgccttagtttaccaatcaaaaaagaaaaaaaatacctacatcagaataatgaggatattatatgaattcaatgagatggataaggtggaaatgcttaggaaataaaaatattgtatgtttacaatgtagttttcttacaaatattagttgcaaagctgtattctcaaattactaagattgtaaaactgattcgttcaagtgctcacatgaacattttcttttatatatgcaatgttgtctttccatggtgttttgtgttctcccatcataacataaccacagctctcttaaggagaataattttcttgatgagaagacacaatggctgagatgacctcagtcttaagaaccagatcaagtcttccttcccttctccacctgctaattttcttcctttctttctccaatacttgtttggctcctatgatgttataggcaatgtgacaattattaataatatgatgcagaggtgaataagggattgtgttctcttagtaggcctgtggtctatttgaaacttctacttaaaacaattacatgtatggtatgacaaaagcattaatcatggcgccatgaacaaaaaacccatagagaggagttcatctgaatttccagtttgggaatgtcttagagaaaaagacctgaatgtaatcttgaagaatgagttatagttttccagatgagtagtagtcaagaagaacatttcaggtggaagggactgtatattaaaagcagacttctgaagctgtgtgactcattgaaaaatactacaaagacccatatggtgcaagtacagtgttcataaaggggagtcctgggaaaggaacacagagaagtggatgggagtcagagtgtataagccaggtgagacaattggggctttatcctgtaggcgtataaaacaatggagttcttttactgtgagagtgcctaagctcgtttttagaaataatcttaatactttttttcctgcggcatgtggaacgtggatatgctgttatggagaggcaccggtggcaggagagtactttaaaaatatggaaaataacagttcagagtacgtttcaggttatagaattctctcttaggccttggtttagccacaagggctcaagttttgccttcatgacatgtcattacatgacaacacttcaggatatcctggtaactcgagtcagcaacagaataatcccagctgctaccatggctatatctaaatatcaattacagaaacaaccaagaaaaatagtccttgtgctatgctatattaaaagggaaattgtatctaatgttataagcctacaaacatacaagttatgtggtcttactttccacatcaattaacagcgataatatactgcctaacaagatgttttgaagagtgactaagtgaatacttacgagacattcttaacaattttgattcacagaccatttgagaaactaatgaaagcaatgaacatttcccaggaaaacagaggtattgatatagtggagaagagcacggagagtgggtcaaacagtttgggttaattttccagtttgcgcagttattaagaatgtggctttcagcaagttatataacttcgctaagtctcaatttccctttccgttgtagtgaaaattaaatatggtaattcttgtaaactgtttagcttagtacctggcaaatgataagtcttcaataaatgttaactattataattgttattattactattattattattgcatatcatatagcacaaaatttcaggtgatttgagccattttaaacctaacatagtggccagtgaagcctggttaagaatcataatgattgtgaaagctctttgcatagtgttttacacttcgatggttcttagcaaatgtttaatttgaatttaaattacccataataaatgcttcatttatatgcttaattatttgtttatttaaccatgcaattgacctgggccataaagtagtggtttcaggcaaatatgtttacaaacagaaatttttcaacctaaatgaaaatctagaggaatatacctggtataaactgggagaaaatcaaatcagatgtatttgtttttttaatttgaggatctgtttttataggcaacgaagtggatagttctgcatttctagctcctcagagggttaataatggacagatacatgttgccagaactttcaaaagagtttatttaatgaccaattaggactaagtatgaagatagttataattttatagcttgaaaaggtaatatgcttagcataccatgctaaatttaaagcttgttttaaagagcaggaggtaggaaaggaaggtttgttctttttggatatctaaatgagtcctgagtttggggaattttaagtaggctcacattcattaattcatctgtcgcgcgcctacacatgctgcgtgctgaacatgatgctaatcactgaggctaaaagaaaattttctggtctggtggtggagaaaaacatgcaataagtactaatagaagtctataaaaagtactgaatgtggagagaggaagctaacaaaaggagctgaaaggcagaaatgtggagaatggcatgttcagggaatgttaggaatttgctttgctagtattatagaataccagggaaggaggaaggtatgggaaatgagtctggaaaggaaggcaagagtaaagtattgaatgatttttgcatgccatgctaagttgattgcatttttaaaaatggtaactatttcaatcagtgttgaccattagtaataactacccaaatcaaacttgtaagaactagagtgctgtacatctaaaagtaacacgtatatacatgtaattctaatggtgtgggttgccattatagttgagccagaaaaaaaaaagctaaactgaattaataacaatatagaatagattatttttctatttctaaattattttatgtgagaaaaatgatggttttggatgaatactgatacccaaaggcctactttaatgaatatgtaagaatgattggtagttaccaactgatgtgtataagtgtatataaaatgctttaacatagtttttttaagttactaaaatttttttctactgatttttcatttatttaacatattcatattttcataggtagtttaacgtagaattttagccagtaaaataatgtatatcttgtctaagtcgttgcctgttctaaacacgtacaaatgttttctcaacacagagaagacacagacataatttaggtatagatcactacctccggaagcttgaagcctagtggaggagatgatatgttcctactaaaaataattaaagatagtaagttgtattataaaagcatggaagttcaaaatttgcagaaattactttcaactggagaatatcatggagaccttaaaaaaggaagtggcatttgagctggacccaaatgagatgactaaaatttatacacttgaaaaaatgttaaagatgaaagggcaaaaccttatgttaaaaagaacatagatatgataaactgttctgtggaccattaataacattttgtcttacagtagagagccatttctttatgtcaatgttataagaattcttatatggaggcaaagaatcaaaatatcatatatgccacaattacactggcacttatcaattccatttattttgattgccactgagtacagtggttaaatgcaaagtctttggaatcagataaacctaggttggaattaccacttctgcctgttattaagtatgtgatttggagtaaatcatgtaaactctctgaaacacagcttccttaaatgaatattgttgtgatgataacacctaactcacataattagtataaggattaaatgagatgatgaatattaagtatctgttaccactgtggctgacacgtaataattactcaataaatagctgccattaagtgatacatatatcttggggaaaattcttttctttaaaaggaattaaaattttttaatttctttcccacgctctacattgttttcaatgagagaagggataagggatggagggatggccatagtgacttttctttttcttttttttttccaatctaagtatttttaaatacaatttattccgattgacaaataattgtgtatatttgtgaagtacaatgtgatattttgatctacgtatacattgtagaattaagttccatgttatatgttaaataacatatccatccatcatctcaccagcttatcttttttgtggtaagaatgttatttttgcaattttgaaatatatatatgtagtattgttaattatgactaccatgtagtgcaataaatatctaaaactgattactccagtctaaccaaaactttgtaccctttgatcaatatctctccttttcccatctctttttccccctacccccaaccccatcccgaccacctcagcctctggtaactacctttctattctctgttgtgtcaacttttttagatcccacatataagtgagatcatacagtacttgcttttctctgcctgggttattttacttagcataatgtcctccaggttcacccatgttgtagcatttttacatacacttaatccacaaaatattttttgactattaattattcacatggctctattcaaatttgaacttttttgtctctttttcttctctttatcttaattatgtgcatggtctgcatgcatgtttgtgtgtgtgtgtgtctgtgtgtgtgcgttaacttagctatttatttctgctatttcctattgaccaatatggtagtaccaaaattttggacacctagttccctgctttatactcttttggctttaatgatgagcaaaatgacgtataactgattgtacctggagaattgtcaaacctctttttaacttctatagtaaaagtaggacaatgggtaaaacagaattaattacaagaaagatgatgtcaatagtgctcaaactgaagtagttaactatttaaatgcataataaatacttataaatttattcattcttatctttcacaccagtaaagtgagtcatcacctcattatccctggctcactagctgctaaagttaaatattctattgaggaggagggatgattgtacagtacatcttatgtgctattttttttttgaaacttaattgtttctcaatagaaacattcattaatacattcaaagtatccaaatagagtcttgctttattacattccattctgaatgttggtcccacttaagtagaatggttaaaaaaacaagacattaggcattttacctccagaaatactagtaaatgtcacaaaatgatgattttatacatattaggaagttaagaacaatatacagattttcttgagataaaactgtatagccaatttctcatttcatagttatttacgtttttgaatgttgaaaaaacaggtaataataaaagcttccatttggctgagcgactgctacatgtcagcaactgtgctagcgttttacgtagatagtctccagtctgcttaacagcactgtgaaggaaggcctctcccacattctaaaggctgggtaattcaaattcaggatcagttgatttctgtgtagctaactaagtatatgcagaagttgttcagagaaaataaactgtcacttttgcttttgaggatttcatagtcctccaccaggaacagggtagaggtgagagagactcctagaagtgtgcagtgagtacactgtagagatgtacagacacagacagtggagattggaagggtcatatttgagctgatcttgtctgagggcctttttccaagtgaaatggagtaggatgcacattataggcagagagagccagatttatgcttattaaattttaagtgtatagtatacaccttgacacttccccacaatatttatttaacatttgctactttagctcagtgcttctcttcttaagggcaagaactgtgttttatttatcttcatatctccaatgcctaaagcagtacttggaagggagcaagggctcaatacctatgtaaatcagtgaatgaaaggaatgaaatttttacatgtaagtgtatttttttcataactgaatcacatacctttgatgccaagccttctaaaagctaaccactctttacaagaaaatacatttattgagatctactttctttttcctaattttaatacagtgatttattttatatatactttggctgtaagagttgtgggcagtggtgagacctaacactgctgtatggtgaagttcaagagactaccaatagctattttctgctatgtcaagaggcctttatattaggctcttctcatgtttatggtgctaaataggttttgcaacacaaattttttctatgctttataatgtttcatgttctcatgctgtttcctactgctcagtgatgtctctatttagctaagtcatctgaaaactgaggaccacatctgagtttttctgctcttcctctgctatcacatatatacacagtacatctgaaggcatggtgttcagttgcacctgacagggacaaatgctacttctatgaagttcagtacttaaatgcagtactgtggaacccacctggtattttatttgcatctgaaatccctccatccttagttttcaattagtggaagaaaagtgcagcaaacactattttcctgattagatatttgtttcactcaataactagcatcatttttttcattttttttgacatttaatgtgtatatgtatgacttgaagaaaattaatggtaactatagttatgatcttcaagaaatttactcaaatgaaacctgataggtaggaaagaaggtgatgttagtcattcaaaaatatttcagaagtgcagggtgaccttgtacattttgaatacctggaggctattgtgcaaatgagtcataagagtgaaatagagtttatttaagaaggcaggtaggtttaaataaattcatagcatagactggaggaaagacaggtgtttttaataagagtaaatgatactaattgaggtacccatggaggaattagaaaattttacatgggaaaatatgttgaaagctaggtgactacagttaaggtattctatcaaggctgtaaagaactgagtttggagaaataataaccaggattttttgggcattatgcactaaggattcatactcattcatattctcatctaatctccacaacaaccctgtaaaatcagttatgtcgttatgttttacaggtgaggaaactgaagactgagtcccaggcagtgttacttattccagcagatgtagttagaatttggaccaagtatgtctgattcttatttaatatttcacacagtgttttgtggaaggcaaagaaaaatgaaatagagcatgtaacagggtccaactaggaaaacagaagtccttctaagtatttgaaataaaaggcacatcataaaacagtaagttgcataatccatgaaagagcctagaaacaaacagaagatggcaaggcaatctacagattaaccacagcaggaaaacatgcccactcctaaactgaaggactaaaggaaggaacttagggccagaatcaaccacaggaagctggaaccactgcaggcctgttcagcagagtaggagccaaggaggaggtgccactgctgttggaattatcacaggaagcagaaacatggagaaaaatgccttggctttcttctttttttctgcgccaccccccaaccacaagtctctttcttgaatgcaagcaagtaaggagtgtgatttctttatgagtgttaggcagtcactatcgactgttagaattcttatggatgaatgtttttaggctattatatgttacatggtgtatagcataaaaaaaaaaaaaaaaaaaaaacctcaaggccagttgaaagaatttggttacaaggtgaaataaaatatagttcaattgcctaatcacttagtttttcaggattttaataccatgtaactttagggattggagagaaccatgagatgtcattgagtagtgtttaatataagaacagattagtttagaagtcctgaaatatgagaaacaaaaccaaatccaggttgttgtttggattctgggtaatttgttattttagatctccagacacgaagcattgtagaaaggttgccttctgcatgccataaattgatgttaacaaggaagttgcgtattaaaaaatgattcagaaagaaccatgctgggtctttggacaaagtcctttacctcaggagacatggatttgacagcctcttatggagaactgcactctcaggcagcatttcatgtctgaccttaggcaagcaggcagagctacagtcaggaggttgactgagtgcctatccatatgctgtctggctcgagccaaatgtcctgttcatgaaaacgattgactcactaggtactgctcttaaaggaagatctctgttcagtgctttagatcttgtaaatgagtgaagaggcttgaagcatcagaactgctgctggcctaaagaatacagaaaataggccgggcgcggtggctcacgcctgtaatcccaggactttggaaggccgaggcaggcggatcacgaggtcaagagatcgagaccatcttggctaatacggtgaaacctcgtctctactaaaaaatacaaaaaattagtctgtggtcccagctgctcgggaggctgaggcaggagaatgacgtgaacccagggggcggagcttgcagtgagccgagatcgcgccactgcactccagcctgggcgacagagcgagactccgtctcaaaaaaaaaaaggatacagaaaatacagagcaaaatattactttgaaatatattttcatttttggaaattctgctatgtttctgatgttctcatgctgtgactcgtatatttggaatagtcctctggcagataaataaatctctagctcaagctcattagaacaggagtgagctgcaggaaaagaatgggtaatatatgtatgagaagactagaaggaattgattacctattggatctgggagataggctgtacctgattcagcttgctcttgctctgtgaaactactgaagtggcagtggaacttcttgcccaataatcctgggatcatgtctagattctgtatttaggactgactgtggttcttattaatgcttccaggcagaacacttattcactcatcaaagatttgttgactatttcctgtgtgccaggaacttggctaggcattgaggacacaaatatggaaaggccagctttctaggaactcacaggatattggagctcctaaaactgaagttggatggtatggtggataggttgtcagaaaactggaattatagccctggctctgcttcaaaccagctctgtaaccttggacaactcacttcttttctctggaacttagtttctgtgtctcttaaataggaatgcctggatgcttgtaattcccttaagaggttgttgtgagaatgcaaacagatactgtctaagtaagaatcaaaaagagataaattgcaaataataaaagagcgctactcaccttaataatgtcaaaatcttatatgttcttcctctagaatcattcactgaaattctcaaagtcaaacactgtattccacttaattctgtatctgggaacacattataattacgttaagtggaagcaagaaaagtaaccatgagttattagattgcagtaataattcacattaaacagaaaatacgattatatgccaggccttgcatatagtgatttatttatttggtttcatggaaattttacaacagttctgagaggtgggtattgttattcccactttacagaggagaaagtaggctcagagaaggtacttcaaggatctggtcagaggtcacatggctttgtaagtgactcagttgggatttgaaaccagatctgacccacatgttcaggttaccttcagtgcaccacatacaaactgaactctagagaagggtacccatagagttgatgctgctttcataggtagcccatcaacaaatatgttctgtgacgtactgtttaacaggccctggacaccctgtgtattagtgaatggagtggagaggcttagaaactcaatttctggagtgtgaacaagaaaaagaaagttgtataaaggaagtcaagacatgggccacagagatgatggtgcaaggggagcaagctgggtgcagatgataccaagaataaaattagcactcaaggaaagacaaaaggaaaaatataccttctaaatgccacaggggaattatctcctactactcagcttgtcatttcagatctttcaatacattttttcagtccttgatattgtagccaaagtagaaaataaatacacattgcatctatcctgtgcctgatgcctgattaaatatctgagatgtaacaaaaccaacttttccaggacattttttattcatgaggcaatctcaacatgaaacaaattgcttaggggattgaaaaactacattcatgcaagctaaatcagatgttttctatttgaaatttgtaaattcaagatgctttgttcctgattttgttggtatagatgttttctgaaacctgactctaaaaataagtcaacatttataactgggatgttttgcactgtggaaaacaaagtcaagagctttcttatttgcattaagggcctcttccttttttctggattcagcaataggacattgtggaactttgtttcacaatgaaattgcttctcaaaacccatccttccacctaaacaccctgtctccaggcttaattggtgctttcagtgcacctgcagataatggcatggtgctgcgacttcagcccatttcctaccagctgcatgtgctcatctgcgagtctcaaaatccttcagtggttgtgtcatttggaggctgatgaactttgtgtaggaggcttttcgttaatccctgtttcttggaggctggtattttcagcaactattatggcaagggcagttgtttcttctgaaaacttatagtacttggttttgcagttcttaggttgaagtcaaatatttggactatgattgttaagcttttctcccaatgcttatttctaaagcagtgaagaatttacaggtacatacaggcaagattacctgcaatacctggcagggaatctctgtttaagaaacatcaacccacaggcataggagagtaagtctggagaatggagatagtgctaagaaaaccaaggagaacctaaaattcatttgaattctcttagttggtcacaacacatattaaacttgattatttaacatgtctttcttttcagtcactataccataaggactcatttctgcttcctgtgctcacaaaatcttccttcttccagaaatgcccttcctttcccttttcttggataacttacactcatcattcagaccagtatatttaagtcattataaacattgctcaaatatactcagagaccccaccacaaattctgtaaactaatttggtcttcagtagctatttatatctgcattgtgataaagagaaaactgaggctgagaaatttggcctgtttatttaaaaccaaaccagtgatagatccagtattggaatccatgttcataggattctgaagcccataccctcttctcactactcctctgacctacaagaagaagggtgtgagatcagagcaatagaggcaatagagcagctggtggtttgacatctgtgccaccaagtcactgagtaaaggcttcctagagtcctctgtgtgagattagattaatcctaaaactgagctggggctgagtctttggggcctcatctcaaggccctagtcatggggactgagagacctgtgggtcaaggaggttggctttttcctccagtggcagaactttgaaagatcttcacccagagctgttagccttcagctctattcagcaaccacatctgattgttagtactaaccacaggaggaaagccgtggaggagcaccaggctccccactctccatggcacctctttaggacccttcccttgccagctaccacacaaagcctgtgttgagagagaaccaaaatattccttgcctttgcattttgtgtggtagtgtttcaaagctcttttccatgataatttcatttaaccctcacaacagttctctgaagtctgtagatcaggtaccattatcctcattgttcttacagctttcaaagagggtcactgagttactcagtatcacatagccagacagtgactatgttgggactgtgctataatttggtttgtttgactccttcaaatctcatgttgaaatttgattaccagtgttggaggtggggcttaatgcgaggtgtttgggtaatggaggtagatcactcctgaataaacatatgtcttccctggggtgggtagccggataagtagattctcactttgttacttcccataagaactggttgttaaaaagagcctggcacctccctcccttctatcttgcttcctctatcaccatgtgatctctgtatatgccagctccccttcatcttctgctatgagtacaagcagcctgaagccctcactagaagcagatactataatagcaatatttcttaaatgttctgcatcaaagtcaggcctaaaagtcagcaaagaaaagagggtttgttttttttttttcaataaggttcaatttttccacattggttcttgctttttctggcaagtgagcagcaacaatcactgagtctgaatctcagcaggggcgtgactttaattgcccttactagccaggagttcaagacagtgaaatggagtgattactgactgcagatggattgtctcatctgcagattcccacctgcagagatcaagcattaattgaaagcatgtaaaactgatggttggaagagccagcatgttctcttctctgtgttctgaagttttattctgccattaagagaccttggaaccacacattgtgagcataaagctgcatgttcaaatactgaaaccggtaccccccacttcctaatgtatattacacatttgaaattacaaaccaacagtgcctcaaccagctagattgatctgggttagtagatttgtggccttcttcaagtacctaagctttttgaacttcaggttgtccatctttaaattgtctactttacagagaaataaaaatgaaataagataaatcacttagcacagagatgggcacatattctttggtaacacttatacccccatatcaggggaaggaaggattgtgaagagaaatgattagtttgaagtggtcctcaggacagtaagtcactgctttcctatatgattattgaatacatttctcaaattgacttttacatttaaagaaaatagaggtttagcaactgtgtgaaataaatagaaaagaactcatttcaatgaagtcatataatttgatatgcagtgctgttctaatagatatttatggatcttgttggccactgcatcccagtgtcctgactaatgcctggcacatagttgatgcttgataaatgtttgttgagtaaattaatgagggaaatactgttatatatccaaagcattgattagaaggtgaaagaatctacttttctctgtgtactcaacttgggttctagcatttaaaaagttagtaactaagaattatgtataaaactgctagaagacaactgacctgaaaagacaacaatacatgcaaagacagtgttaacatttccttttattctcaaaccagcagtacaagctatggtatttgcttctgctctatggagaggctacctttgtccaaagacactcagctaggaagcagaagagcaaaaatttgaatctaaatatgtctggctgcaaagcaaaagtttatttcaagcccatcagattagctaaatttttagacaaatatttgggaaaggttttaagtgaagaaatgccaagctctcacaccccagtagaaatgatttcctggatttcaagattagtttgaataatagaatagtatcctttctgagaggaccagcatgtaaggataggtagattcaccttggaattatgaggaagtgaggaggcagggtgttggttagtccaaggggcaataattgcccttaagagggatggcccttatcttcatactgatactggtgcaataggcaaattgtcatactctttttgtagcctagatttttgttcagcaagaagcagaattgtgacagggtaaaagggatagacataactggtgaaaacagcttcaagaaacagctttgaagatgattggagtgttctgcctagaagaagtctgttgaggaggaggaaggaggttgactatggtttgaacagaggcaaagaccatatgctggaagagagagagactaagggacactgaaagatgtcactatcatgtataaagaagtgaagagttggaaatggctctaacattgcttatttggaaacctgataacctagtattactggatgaccaaactatgctcatgaagagcactacctgttggctcagtacgagagctaaattgtaagctccaataatacagaaagtgtggctgtaatagtcatctgtatatactctctgatattaaatactgttacatgaataaattgtcccaaacccaatatttattctttttcataagagtctggggtctggatccagactgcctgaattccaatcctggttctacaacttactatatttataactgcatctcagtttcttaatctataaaataaggctcacaatcgcactagttcatagacgaagtgtgaagactaaatgactttaatatatacgaagcgtttagaacagactttgacatatagtaaactctcaataaatggtaactattataggcaacttattttttctttcttctttatctcctaatcctgtatccctgatcataactcttgagattcttcctgaagtaaccctccttcacatgaaaatccatattctttcttgccctcttatttctttcttggtttattttattttcattcattatctcaggaaaatcttaatgtagctctccctttcattttgaaccctaaaaaactttgagaaagaaaaagcaactgtccaaacatttttgtaaaacctcaactggaatctgtcatcatttgcaaacattcctgaaaatctctatatattgacatcgaactttcatgtttccattgaaacgtgaaatatttcattatattttctttgcagacatcaatcattatattctgcagatatctattattatattttctccagcatcagcacctgagacaaaatattttttgtacagccacattgttttttttgtcttttatttagcaactattattggagtcattgctgttattttgtattattttttatttcaaatacattgtgtttaagctatgcttaaggtgaatacattgctgtgggttgtcacttgaacttaacagccatttgtaacaaaatttctatgagaataaatgttacttatcctaaatgctgactcaactaggaacttttttatgtagaatcataatttacatagccatacattatcttgtttaacactccaaacttatgcaataagtattactgctatatcacaaattaaaaatctgagatttagaaatttaaataaattacctaagtcacatggctatgaggacaggaaaaggaactagactcaatttctgttcatttctagttcaaaagacattccactatactaccttcttctaccacacatacaatatatttaatcagggtataaatatatatttacaaatgagaagctggctagctgttgagcgatgatgttgatagaagctacaaacttttcagtgatcattatgtgccaggcatcttttcaagtgagtgatcttagttaagcttcatatagttatgtgagattgttcctagcctcattcatcagtatagacaatgaagctcctagaatgaaagaatttgtcaaaacttacattacagttaagtggcaggacttgactgtaaattcagatctgtttgaccccaaattccatgctcttattcacctccatatactacttccttaatggcggaatgagatccgtatgttgtctccctggtgtgctaaccctgtgttaactcaagggtgtattagactgaaaacagatggactgctgttgcttttgatgataagcaaaacatccagtgaaaaaagttaaggctaaacagaaaagaagtgtgtgtcattagtttacatatgattcacaaaaccttgggaacagatggcattgtccatagtctgagagaaaggaagagaaaagcagctatggaggcctaggttagctctcaccatctggttgtaggtggaggaagaagtgattgggtgagagaagctgcttttccatagagtcttttaatgaatcttcagggacgcaattttttacaagtgagcttttgaaactcattaattgccttgatacttaatggcattctgcagacttggacttccttcagtctctgaagaattttgctttgtatgaatattagattaatattgttctatatgcaatttactcatgcattttgagttagtagacaatactattatttttgagacagagtctcactctttctcccaagttggagtgcagtagggctgtcatagttcactgcaatggaaaactcctgcactaaatcctcctgcctaagcctactgaatagctagaactatgagtgcatgctactgcacccagctaatttttattattattattatttctttttttgcagaggtcagctatgctgatcaagctggtctctagctcttggcctcaagtgatcttcccagctcaacctcccaaactgctaggattccaggcataagccactatactcagcaacatttttagtggttgaactgatatagtgttttgtaaaaatatgatctgtgtcaagttagaatgattctgtgcagggctattcttataaggaaggatttgtaagtagttctcatttctaggtaataagagatttttgttccagtatggtcactagagaaatatggtttttttcctactatttcttataatgatgtcttcactgatttacaagcagccacaggatttaggtaataactctcaaaatcctttataatcagcaggaagtttccagactatgaagtttaaacttctctcataaacaggtataagtgaagctactggaatatcctgaaatgcacttatcttggggatgcccggaatgactgatacgaatcaaaaggaagttaggcagattcattgtcccaccttcatacaatctactttaatgaatgccgtaaccaagattgttgatttccatccccgaaaatttagtcacgcacctacatttttcttctttgtattgtcaaattattcacatatctctttcaatggatgtctgttactcttgggataaaaccccaaattctttttatgacctctagggcccttcatgatctgtcccagtcccacctctccattgttatctccagtcaccaatgatgccccacgcttttgaaaaggcccttttctgctgcaggcttttctcacttgttccatctgcctggaacatcttttcctgcttttcccccatcctaatttactcctacacttcaagtatcaggccttttattacaatctgtcatgaaagtctatatttctttgagcacatattacagtataattaagtaatgatttgctaatcaatatattatattgatggctgtcacctctactagaatgtaaagacaagagccacttctgttgtttatgcctgtatttgccacaggtagtacagaatcaggtacacgttgcttcacataaagtattttatgaattagttaatatttcaaggcacctagaagaatgtctggcagaactgctctatatgtataaaccactttaaatgttgttaccattggtgtttttcttactttccctttattagtagatgttgattaaagggtgtgtgataaaggacctcagatcccaatcatagctgtgccatatgatctttggaaagacatctaacctttctgggtttcaattttcttacccatacagacatttcttaagaacttttatttttaaaatcattggaaacataggttctcttaaaagccaaagtaaaggggaaaaagaaagaactgactaattataatgttaatgttttccttccggtttccagactttctatctgaagtattctccacatccaggatggtcttcttttcttatacacaaacagccaacccatcatcaaattattctccttggtaaagctcatatatatattatttgttatgcttaataaatagctctcatatttattctggaaactgtatcagttgagaagcaagtcagcaggagaatgatagtaccacccttgttactagtaaaggtcagactagactggaatatgtagctcttatatgagattcaagtagatctactgcctttctgctatgtagctattactctatctggatagagaaaaaacccactcaagggccagtatgggtacccagaggaggcacacatatccaggaaactacctcctactgatttaagtggacaagggaggagaaagaggccagagtccctgtgcataaatcctttggcaattaattactctcagttgggaaacctggacaaatggccatcatccagaacctagtaattcagtcctcctcggtgtaaaagggatgagaagtgagacaatgggctaggattgcatagctaccaaaaaggaaggctaaaataccgtcccgtctaatgtcagttatctagtgaatttcaactagggtgtaggcagttgctagaaataagcattgtgaacatgtgtcaggcaacgagtgctatgtgaaccagaaaatgcattcactgggtggaggtaaactagagcaaacaaaacatagcccaggagccactagggtttatgagctgtaacaagcaatctcagtttctctggagttttaaggctgaattccacttgtgaaattttatacttcatcttatttgttaaaaatatcttcgaatccctgagaaaggtttttgcatggagagccttcccagagcctctgacattattccctaacagtaatggcaacttcccaggagagaagcggctctgcttcttagagccactgctgtatttatgatttctctttcctaatttattttaggtttttatctgaagaggctatttccatgatgagttttgttaaagcagtggaacccatagatgttctgttaagaacaagaatccaaacaggtgctgaaaatcaagacagcagaatcaacactctggatagagggggccgcagggttggactggatggcagattccctacctggcttgccaggtttatttcaggcctgcagttgcaacttgatgcaaataaagaaagagaggcagatgctgtatactaggtttatggaataggagtcaatgaaaagttctctgttagggaaactccataaatccaggattttcccacaatacaaagtcggtgacaggaaaattaatttcaactgtcttgtgggaaaaagtcattaacaaatgggaagacttggtgagatggaggctgaagtaatagattttagagattaaagatgagcccatgtaaggaaggtgaagacatgaacagacatatatgcgtgtgaacacacgcaaaagtagtaagtacatatttatggacacatacatcacatattatggtcatgctgcttaactcctgactattgtacctatagtcaaaaactaaaaggaggtcaatgagaggttataaataaatttgtattattcctaataatcttgtatactcaactaaagtgacagaacatgtcacagtggtcaatagaggccatgatgattgaagttcagttttgttttgtgtaaaatattgtccagagatattcagttctataagttaataaggagctaaggtttgaatgggagattgaagaagtatatgagtctccagttagcaggatagaggatcactaatttagaagccaggataaactaccacagtgcctgttacttagtaaggctcaataaatacttatttaattaattatactctgctcattcatgtagtatcacaatgatgatgactactcaaggaagtaaaaagtcttctcttggtgacatattggatttgagatttttaatcaagtagactgtgtgaggagctattaccaattaaacatcaacctggagtcacacatattttcttagtagaatttactgttgaatacagtagcaacatgaatgcatagttgtcttcatgaaaaataattcagaaagatggacaaatttagaaggacactcatcactatgttgctttcactactgtgcccaattctatttttgtctttcagttctagaaaagtttttctaagagttacccctacattatgtgagttttgtgccattattctgcacctcttataaactgatgattcagggtctgggcctaaggccaaagttaattaagtctgaaagcatatgaaagctgttactcctattcagaagacagcaagccagcatttgcatttgtttgctgtccctgtgctgaagtgctgagttgttgtaagttgcaggtagcatgactttgagtagttgacaggtataggataatagatgaggaagtccctataagttatccttttaaatatcttgcagactctgatgttaaggagatacatttaatttgaaatgtacctaattcattaattttttatcatcttggttcaaattttcttctaattcttccatggaaaattcttatttttgtcacagtcttcactacattagtgatttatttatttatttattttaattttttttttttttttagattctagggcttttggatgttttgtttgtagacttgtttttaactttccacctaatccaaataatccagataataatatcacacatatgctatatggtaggcacttatttataatatttataagccccttacccaccctctgtatatcagtctcattttggtaggaggaaacagcttatttttgacaaagccaggattcaaattcaggtctgtatccaaagtctataatctttcttaatctacaccatgctaccgctctaaattggttggaaagtggattctgttgcatataatttaaacctcaaataatagcagcctagcaatatttatttctctcttatgtaaaatacatttagaggaaggcagctccatgattgtcaggctccttcttcctccctgtctattatcctagcttgtgcattccatgtccaggtgatacggtttggatctgtgtccctgcccaaatgtcatgtcaaattgtaatcctaatgttggaggtggggcctggtgggaggtgagtgggtcatgggggtcaatttcccccttggtgctatttttatgacagtgagtgagttctcgttaagtctggttatttgaaagtgtatggcacctaccccccaacacaccgtgtcctgctctttccatgtaacataactgttcctgctttgctttctgccatgagtaaaagctccctgaggccttcccagatgctgatgctgccatgcttcctgcatagcctgtggaaccctgagccaattaagccttttttttgtttataaattaccaagtcttaggtatttcttcatagtagtgcaagaacagactaatacaccaggatcacgtcatggcccaagagagctgctaaaactttaactatcagagctgtattcctggtaacagggaagaatgagagggaaaggcaaaaggagtgcctcaggtgtctgtctccattttaaggcgcttttctagaagtcctgtctatcaattttcacttacctattttatgacttcttcatgtttataatgctagcagctggaatagtttctagtacaatgaatggatggatggaaatgagtgaatattagacttaaacttattgtaaggctgaggcttgcttaagacaacttctctattaaaaatatgttaggtttctagactttctgtatatgctttattttaaatttatctaccagatcgctctctctgtctctgtacctgtgtcatttgatgttctctttgcctgagatatgcttctacgtaccctaccttctcaatacatagatatgtcatgtgactcattccaactcatcatttaggtttaggcagagttggatctctcttgaagaagctttctgttcttctgaaggacagaaatagactagacacccactttgggtgactagcatcctccgtttagtcttactaaagcattttttacactattagttatgtttccatgagtttacttaaggttggaactatgatttgttccattatatcaccaacatttggagccaggtctagaatacaattagtgcacaataaatgtttgcttaaaaatgaggactgttcaaatgaggttctggataactgatagacttgtccaagctcacagagctagatacttatatagtcttaagtctctgcctctgaagcttgccttccatccagggaacacagaaatgcaaatacaagaggaagacaaaacaaaacaaaaacctcaaaaccaaaaaatctcgtttcacaaatttactgggagccagctgtcctttacttagttcccataatcacttttcagtctgttctgagtagtgactgactcagacgaattttcagaagccaagattaaaccaagagaagtccataccagtcattaaaagtggcgaaacttgccagacttcctgcaaaagaatttctaattattccagaattttctgcacaagtcactttttattttgtctctttttctctgctgagagcacatgcacatgggcaatagccaacacggaagtcattctgtttaacaggaacaggaattttcagcagtgtttattttacagcaggttcccagagcagaaggctgtacaactaatctcctccccctactgtcatcttgctcttccagctgtaggacatttatagagttgtaaagtcttcagaggaactgctgctctggggtcaagagtagtactgtaaggccaggtacaatggctcacacttgtaattccagcactttggtaggcctagatgagatgactgcctgagcccaggagttcaagactggtttaggcaacacagtgagaccctgtctctacaaaaaaaatttaaaaaaataagccgggcatggtggcatgtacctatagtcacagctactcagaaggctgagataggaggattgattgagcaagggaggtcaaggcaggctgcagtgagctgtgatctcaccactgcactccaatctgggtgacagagtgagactttgtctcaaaaaaaaaaaaaaaattattgtactcggtaaatcccagaagtgtggaaagagggtgacaaggctgccggatgtaacccttgtcttcttaccccacagggtatgcactatgtttttaaatacttgctgctgcaagaggttgtaaatttgtaattttttttcttatggtaattaattcaaaacatgaaactaataagtacaaaaaggtatctactctgatgttaataagaatactttgttcataggaatttttaagataaaatacaagtgtcaaaacaaatggtgctttggactatgagtccacagcaatattaggggtgggagcgatatgatggaaagaacaggggctttgaatcagacaggactaagttcaaatcttggctctacccactcagtcattgtgtgacattaaactcttggaagctgtttcctcatctgtaaatggagatgtattgtgattagtgacaatttatgtaaaacaacacatgttcaatcaatagtggtttgtattgttgtttgaattattatattatgccaccagaggcaatagacacagaattgaacattgtggtgagcctgttgtgaaatcgacaccacttgtgtgttctgtagcctctggtggacacactagcatcccatcataagcgccctgctctttgatctcccgcagccctgggcagaggcaacatatcactgaagttactctttttcctcatgatttacatcaaaatcatgtataactagagtgctttgttgctttaaatatgaaaaaatagtttgaatgcccacttcatgttctgaaaaacaaatttgaaggagagagagagagcctgccctctgagagttcacaaacctctctgagaatatggacattttgttaatgagaaatacagtgagtggtgaagaagacagggaaggctcagaatggtgtaaatgcgatcaagaggaaggttggaattgacctgagccatgttatttctctttatatctcattcaagaggaagtcttcatttctttggatggcgtgcaggacctctgaaatccagtccttatgtatacattttgccatcatgcccattcgccttattctccagtccaaagaacttcttctggttctttctacaacaggtcctgtttagttgcacctcagtgcctttgtatgtgctggtctctcttcaaggaaggctcttgtcttacctttctttgtcagttcaatgctactctttcttcgagttcccagggtttcagaatcctccaccaattctctgccagcatgcaaaggaaaggagaggtcatggaggatctccaaggaggtacttaggagtccaagcctaaaaatgaagtgtatcacttcttctgacagtccatttgatcaaaatattgtcaggtggccatttgatcaaaatattgtcaggtgaccctaaatgactacaggataggctgtgaaatgtggtcaaagtgtgtgtttagtagggggaaaaaggggtttggtgaatctttactgtgttatttgaaagcatattgttcttccgtacctatctaatatcttacaccatagatgctaacactttgtcaaaagaagtgaaggagtttatgaatgcattagtaaataagtaaatatatgatgagtagaacaccagaggtgatagtagtgcgttcactttggaaatcaatttaagttaacaaaatatagacagtctggtatttggagagcacagccaatgcttgccattgtcctactttggcatatgaagttagtctttgtgactggtaaatgttttccttagtatctggacacttccatccttgtctctagccatactcccccttgtttcagcttccttgccatttctcaaatacaccaagcatactgatggttctacatgaggatctttacccttgtttccctggtttgaagtgccagaccccaactccccttttattccccccaaccaccaagcacatgcttgccctttgcctcacttaggtcttacctctagtgtcatcttctctatgagcccttccctggccaccctaacttcctgtcccatatcctgtgttatttttccccatcacatttctcaagaccagatatactatatactcccccaatttgaagatacacctgttagaacaaggaatattgtctattttgtttgcttatttttttctgttgctggtacctagaacagtgcctggcacattgtggatgctcaaatattttttggataaatgataatggtttgtttttgcacagtgttttgtgtcttcttcgcatgaaaatgacacattaatttaaaaattgaatgtaaaaatattttcaaatttttcaacaattggatgtggaaatgcagaaggaaagaagaggataaaaattattactaaggggaaatggtgacttgactcagagtcagcgataaaatattattgctctagaaagacacgctagaaaccacgagggatgaaggaatgttttgaaagtgtttgtgttttttcttagaatgctgatttttatgccatccaagcgttcaatagatgtagcttgaaggaatcaactgcagagctcagtaaacccataatgagtacttaaaccgtttcaatttagttttatcagaaagggcattcagtgaacgaggcattctgatcacagcaattctcttcacagaaatggtatttgggaagctggttaccttctatttgataattcaaagatacatttggaatgcagagaacatttgacaaaacctatctttaaactcaattgcttaaagaagaaacaaaagctacaaacacactatgggatagaaatagtcagaagaatccattcagcaacttttttagtagagtcaccctagaatgtagggtacagatcatggcattatagaagtatagactcagaaaggaactttgggtgaggaaaatagggtctggagataggggcacaaatatttatcaagggtaccctctgttgggcactctagaaagcacttcattcgaaatgggcgttactatctttatctggcacttcatactcaaagtggttaacttttatactctcatatagcaggtgtgtcacagagctgggctcacactgagatctgtctcactcagagtccttattatttctagtctgccttttgagatctaaagattaccctcaaaagttgctcaattattaaataatatatccagaataatgactcaagtattttgattttttagtctgtgctctgtccaccagagttaactttttgggtggggacacaaggataaatttttgcaatggaacctagttactaaaaatctctttaatctggccaggtgtggtggcttacacttgtaatcccagcactttgggggaatgaggtgggcggatcactcgaggtcaggagttcaaaaccagcctggccaacatggtgaaaacccatctctactaaaaatacaaaaaaattagctaggcgtggtggtgggtgcctgtatttccagctactcaggaagcagaggcaggagaattgcttgaacccaggaggcggaggttgcagtgagctgaggtcgcaccactgtactccagcctgggctacagagcaggactatgactcaaaaaaaaaaaaaaaacaaaaaacaaaaaacaaaaacaaaaaaaaacttgaatcaatgttctatcctctcatatttcctctcaatttttttattttaaagactttgtctaagaatgatacatgaattcatattttacctttagtgtatttttaatatttgtgattatattatctatatttgaatattagccatgtttgtatatccataataatggtattttgtctctcacaagacatgcattagctttcttcactgtgtggaaatatcttgatggtctaatgtttctattaagttgcttacttacctgcccggtgcgaatggtgttagaatttagaaatacatttgtatattctgtttaagtcgtctcataaattggaaataagaacatgaagtattcagtattaagaataataataactaacactcacataacggatattttaaattgtggcattctcatcaataaataagtcatacaagatagactaatatataaaacaaaattcaggcaaaactgggttaaaaaagagggatatgtagataggacaacacataaattttctctaccatgaaatgaagctgatattcagtagtgcattttagtggttagcagcttagatcttgggtgtcatgtaaatttggatttggatcccattttgattccagttttgtgtttcttggttatctgtccttaggtaaacctttctaagctttatttcttcagccatgaaatagggataattataattacctcaaaaaaatttctgagtgtgtgattttatttaaatataaatatatatttgtaaaaatgtgtttatgtaattatacacatatatacttatatgtacaaatatatgtgtatacacacatccaattgcatatggagctagttgtttggtgagtacttttttgatatcaaattgttttgctgatgaggagagggtccctaaatacttgattcctgtaagtgtcagacttctccagagaaacagaaccaatatggggtgtgtatatacatatacatatatagacatatacatatatagatatatacataaagagatttattataatgaattggaattcatgattaaagagaggctgtcaagtctaaaatctacagaatcaatgtctcagttccagtccaaagaccagaagctgctgtagtagtaacaagagctgatgttccagttcgaaggctattagataggagaattctcttttactttgagaagagtcagttgtttgttctattcaggtctttaactgattggatgagagtcacccatattgtggagggcaatctgctttactcagtctactgatttaatttcaatgttaatctcatccccaaacacccttacagaaacacccaggataatgcttgaccaaaaatctggctgagcagcaaataaatgtgaaagggaagaaatggatttggagacctatgtgttagccgaattcctagtgatgcctataggggaggggagggcaacacatgctagagaaattgttctacaggtgaaggcgatgtaatgtgctaactccctattttatagtttataatgtgaactcagttacaaaataaaactgtagactaagagaatgcttacctattcccacatcttcttttacttgggtttaaggaacaaattgaatgggtcactagaactctaatagtcactcatcacactttttctgatcattgactaggtatcaagcacattgactctagaaatttaaaaataagtgaaatattttcctcaccctggaagagttcaacatctagaaaggaagacaagcacaacagaaagtaataacactgttacaacaaaactataaaatgttatgcccttatagaagaaagaagcaaccgtcttcaagaagtggggtggggtgaatgagaagcaattagactcacagaaattgactctctgagatgggtcatggaggatgaataggagttttctaagtgagaaaggactgaaggggaattccagaaggattagcatgtggaaaggcatggagatatgaaagagatttgaatatatgaatatttggaaatactactgatagatagataggtggtatagcgtaagatcttagcctctgaagccagagtctaagttccaaatctggcttggctgctgactatgtaatattgtgcaaattatttgactttctttgcttccattccctcatctgtaaaatgggattaaataatttaacacatatatagcacttaagacagtgtgtgacacattgtaaagctccatcaatactattatatatcatcattatcaatgtgttggtcagctgtgataacaaacatacttaaaatttcagcacttacaaatctttatttttttgctcatgttacttacaggtttgtgttaccactatagcttgtctctaggtaagggccagctctgcttccttgccttcccattctatagaagaatctccagctaagattctcatggcagcacataaaagcaagattagtggcagaaactcatggtacttctcctactttcacgaaaaaaaaaatatgtcatacctactcatattccactgaccaaagcatataccgtggccaaactccaaatcaatgaggcaggaatgtataatttcctaagggaaaggacaatggaggggtgttaacaatcataaacagaaatacaatctaccacaatcatcagatatcagcatcttcatattattttgtacagggtgctggtaaggaaaggagagaagtatgatagaaaataaagctggctaggggaacacacagccagagcatctctgaaaatcaatacaattttttgaatatatttgaagctttttggcccacagtgccctacttcccatctgtcctgcttggttttctgctttttccttctatgagacaattacctgacctccaggcataagtttgaaaagctggggcttttgccacatgttacaatatgtggtaatttggatttgaattataaataggaaaaatgagtttatgttacctctgtaattgatgtcctgacctcctgtttcaaagcactataaacatttgtcaaagtcttctgttaattataagtgtagttactaacttagagtcagttgtcattttcattatattccatgactttgtaattaagtcatttgaaatataatttgtaattttagtggacaaattatttcaggctttttgttttgttttgttttgttttgttttttgagagccaaggaggaggcttagaatttgaaactttttaaaaagggaacgatatgtacacaaatgtcattcacagctaatatttaacattgaattatgattatttttcattagtttatccatagagcaaaaaagatcatttgaaaaatgttaagactatatttcatggaaatgtgcctgccactttgcttcattcagaaggaagcctcttaaggtataaaatagtcgttgttgttctgcctgtaactttactttgagattaaaaagctgaattttggttgtcaggaattctagtccaaagaggcctaggatttcaaaacaggtgtcctttagtcatggcttgcctgcctgggcaccagatctggagacaagacatttgcaaggccctttgaattgagtaggggaagagagggaaaatagcaggagtggaattggctgaagtaaaagatcgtcgtccagtgtcagcccatgattaagaattagatatgggaacttggatataaggatgacagaacctcagggtccagatataaggggcctacaaacaggttcaggtatgaatagtgttggactatataatttgtcatccaaacccatttattttttgaaagtgaaaggtaatatataagtgtgccaagtaaatagtcataaattaagacagtcctaaagaaactagagtcactctagggatagaaagaataagagatacagtaaataaatatcctgtgttcctgccctattcattcatgcatttttcaacaaatatttgctgtgctctgtgtctactctggagacgcacagattcataagaaaaggtacctgccttttaggatatcctgtcaatagactgttagaatagattctaatttgtttgagataaccaccagagttcactcttggagcccaggacagcaatctttgatccagccttgggtcagggaagggagggagaaagagatggtggtgagtgccctcaagccaagagtctatctcacaacattgctagaccatgcagaatatatgaaaaaaaaatatatatatatatatatataacctgtaaaggcataattacaaataagcattatatcttggtatgtttttctgtatggagaaaatgtaatacagaataagttgaatagttaatatctgaggtgatcttcaaaatggtgaagaaggtaaagaatgggagaaggacatactaaggaaaatgtattttccggtaataaacagaggaaagtatttatgtcttaaagtggtcttgttggctaggaaattggaagagggtgatgttaccctgtaacctggtagggcttttcctctcagggcttaattataactgagtaggctggctcagaaaatgccccaatttgttaacaataaaactagacttatagctccaccttttctcagttctccggtttaatccctgactggaaggatctaatcaggaccttcaaactcagaagtgactgcctttttttttttttttttttttgtgacagagtcttgctctattgaccaggctggagtgcagtggcttaatctcagttcaccacaacctccgcctcccaggttcaagcgattctcctgtctcagcctccctagtagctgggattacaggtgcatgccaccatgcctgactgatttttctatttttagtagagacagagtttcaccatgttggctggactggtctcgaactcccaacctcaggtggggatctgccctccttggcctcccaaagttctgggattataggcatgagccaccatgtctgggccatgactgcttttaaaaagagatttatggccaggcacagtggttcatgactgtaatcccaggactttaggaggctgaggtgggccgatcacctgaggtcgggagttcgagaccagcctgaccaacatggagaaatccatctctagtaaaaatacaacattagctgggcatggtggcatgtgcctataatcccagctacttgggaggctgaggcaggagaatcatttgaacctgggaggcagagattgtaccattgcactccagcctgggcaacaagagtgaaactccatctcaaaaaaaaaaaaaaaaaaaagatttacaaagaaactgactctaagtactgatgatctgatactgacatctgaatgaatggttatggaaaccaggatgatgtgagaggagctggccctctacttccatattatcatgtcacatgtgtttccatttgtggttccctagtacaagctgaccctttctaaactagagaaattacagagaaaaaaattaaagctaaaacatgcatgggggaggggcagatgcattttgtccaggtgagattttactccctgtcttgttaccgttaattcagtatgtcttgtgcttctttaaggaaacttgagatgagttgtctctggatctgcattacgtggtcaatatataaacatttatattgaacatctttaatgatcaaggactttgctaagtcctgccaagttatttctatattctggaaagtgaatgagggacatctctctcagtctctctgaatctctgaatctccctccctcaacaccatttcccccacctgacttacagacacaaatatactgaattgtgaggaactcaaagagacagatcatgtcttagttgctcttatatccctggcttgtacttcagctcttggtccatagtgaattattaagtgatgataaattttcactgaaaagtacacataatagcaattaacattctcatgtcactctatagttttaagatgcactttacaaacatatcatatttataatccctgaagatgtgagcattaggtctatttcaactttataattgaggaagctgttgttcagaggataaaatgggtccccacgatgatatacagagatagaacccagatagataacctggttctcagctacattatattgctacatttgagactttgtaatccattctacaaggcaaatacttctgatgctttcagccttcatttttattcaagtgcccttaagccaagaaaccatctcacaacatctctagaccatgcagttaaaacaaaacaaaacaaaacaaaactacctgcaaaggcatgattacaaataagcattatgccttggcatttttttctgtatgaagaaattgcaggtgactttacctggagagagggggcgtatatggtaacaaagtcataaaattttattttatatctgtagatcataaacaaattttgcacactaactttaattaatcatcactgcttgaattgaattagatcctcccactcccacattaaactgtaatgtattctttataaaaatgtacaacttgaagttgagtccttcaggccagagagtttatttataacatgcgatgaaacattttgtggcatcaatttcatttaaatcatagattcaggaagtcacagaaagaaataggcccacttagtcaccttgcctttgtcagaaggagtgagatctgcatttgcagtgtacttcctattgcttgggtcaatgtgtatatttatatatctcttcatattcaacactgctgatgaaatggctttcatatgaaaatgcgtaaatcaaaggctggtgtgggatgtagattttccttcttttacagcatgttccatcatagtctagttcaaactgagggttattttctttaggcctggacaaaagcatctctctactgccctgcctcagattctagcatttctactctgggtcaggttggtctgcccatcatatttacttccttaaaagaggtatcagaccagtcctcagaaggttatagagataagacacaccattatggtgatgcagataccaaaaatagcacaaaccatagtacagcacatgttttgccagagcaaatgaagtgtcagggtacccagtgaaatatcggaattgtcaatgtcaaatccaggatcctgggagttaagaggaatgctgtgtaatgaagaatttaacattatcctaacagaagtctgacctttacactcagttcctgggaggtaatctttggattcttagaatatgatgcctggtaggaatgcctttgtttgcctggggtttttgccattggatcgtctaacactgtgatttttaatgggggttttggatcatgtggtatcaattctgtctccagatggactggagactaaatttcagccttatgaacagtatgtgatggagccccagtaaaaactctgagcactaaggctcaagtgagctttcctggttggtaatattttgtgcatgttgtcagacatcaatgccaggagagtaatgtgctcatgactccatgagtagaagacagaagccccatgtttggcacctcttctggaccttgcccaatggacacctttctttggctgattttaatgtctatttttttcctttaataaactgtagtcgtgaatataacagctttcactgagttctgtgagtctttctagtgaatgataaaagttgaaggtaaccttgggaatcccccaaacttgcaattgatatcagaaaggagggtggtcttatatgaactgtgggccctcatatacctcatagttggtttagcatcttatagagacattattgaaaatcaacatccaaatgataattcccagggtgagaaatttggaaaaagagtgaaggatagtcattcagtaacttacttgatttcaccctttttattcttaggatctgtgatatctgcatgtaagttttgtttcttgctccagataatcataaaagcactgtcatgccccaaagagatagtagagcttctagcatctctagatatctggaaaacatcaagagattttggatccagaagtttattggtagtcaagagatatattaagaggatgacattccagtctagacctagagcaaactgaaaggagtcttgaaaaggcattatagcagacctagtgggaattgaggggcagaatagagagcccacactttagagagagggtccagggacagacaggacttcaaattttaaaaagtgttgaaaaaaaatacaaagctccacccagaagatacacaattagattgaggctacctacaagttggacttgatatttttgtcagttagaattaaatttgtctgtgagtgacagaatacttgaagtaaaaagaaagaagttcctttctcattgtcttagcttattcaggctgtgataacagaatactatagactaagtggcttataaaccacagaaatttatttctcacagttatgggagcttggaattccaagatcaaggcgccaacagatttgatgtttagtgagggctcagttcctgattcatagatggccatcttcttgatgtaatctcacatgctggaagaggttagggagctgtgttagtccagtgtgcattgctataaaggaatatctgaggctggataatttataaataaaagagggttacttggcttatagttcagcaggctgtacaaacatggcaccagcatgtgctggcctatggtgagggcttagaaagcttttaatcgtggtggaaggcaaaagaggagtgggtgtgtcacatggccagagagagagcaagagagaggtgaggaagtgccgactcttttaaacaaccaactcttgtatgaactaatagagtgagaactaactcattaccatggggagatcaccaaatcattcatgaggaatctgcctccatgactgtaacacctcccaccagaccctacctttagcattggggatcacatttcaacatgagatttagaggggacaagcattcaaaccatatcaggagccctctacagtttcttttataagggcataaatcccattcacgagaattccagcctcatgacctaatcactgctcaaacgccccaccttctaacgccatcacactaggggttagatttcaacatatgaaatttggcagggatacaaacatttcatctatatcactcacttaaatgaacctagaaagaaggattctgatcaaggttggtagttccatgataatcagggacccacgatccttctatctggtcactcaaattaccctcaacataaatagttcatctcccatccaagatggcatttcaaaattaaatcatcgtgtatacattttatcctatagaaagtaagaaggaaggaagaagggagaaagaagcagcagtaaataagccacccactgtattccccattttggaattgttcctacacagcacatgtttacttaaattacattgtccagaaataagtcagattgctataccaaagcttccaagaaggcagagaaatgtcatctttattatatatggttatatgcccaactaaaaaggtcgagaggagggtgtggggcagtcctctaaggaaaaaggaatgaccgtttattggaggttaattagcagcctttgctgcaatgctagacaataaacaactatattaaattttgactgcgagcagtattggaagcagatcctgcagttgagtgtggcctaatggtactggcctgtagcctgttaagaattaagacacacagcaggaggagagcagcaggtgactgagtattactgcctgagctctacttcctgtcagattaacaacggcattagattctcataggagcaggaaacctattgtgaactgtgcatgtgagggatctaggttgtgtacttcttatgagaatctaatgcctgatgatctgaggtggaacagtttcatcctgaatctgtctccccacccttctcattcgtgaaaaaaatatgtcttccacaaaactgtttcctggtgtcaaaagggttgaggacttctggtccaatgtgtaggccatagagctggtctcataaaaagaatgttctaggggcagggaggcaggcttgccagtcccatggctatggctctttgctcttttctatggctccttacagcatttctgtctgtagtcattccatcaaagcccctgtttgccattgcttgattatctcacacatttttagttgagttcagtaagctgcagtgctctaaaggatcactgttgtgaactttttggccattagattaaaataggtttatttttattattactatgattatcattgttattacaggtctgttgggagatggattagcacattaaaacagtcatatcaggttttaatatctgctttaggctttactagctgtgtgatcctaggaaagattcttaatccttctggccttcagttttgtcatatggtaaatggggacaataatgactacttaaagaatcgttgttaaggttaaggataaagataacacctggcacagagttggtgctcaataaatagcaattattacaaacaaaactattagtttgaactgatcctaacacaataaacagaaatataaacttgttggggggtagagaattaaaatagttcaaatacctactgtgctccaggtattttaaatgcatttttttccactccctattacaattttttgagagagataatcttatgtccctttaacagatgaagataccagggttctaattatttagagattttttcctaaggtgacttcgttagtgagtgctaggatggagatttgaactgtgatctctctgtttccattatggtccagattgtttaaattcaactatactctttcacaattaaggaaatgggacagagtagagtcaagagacttttcatgatcccaaacatagttgcagaatattagatttatgacatctagcccagagtatttttctttcctccctgctactatatttaacttatatttctcttccactacatttggctatactcttcgtatgataaagtttttctaaaatttcagtgtattatattgttttgctgattcacatttttaatatactgagtagcctttttagcaagcagacctatgttttatatggtgatttttgtttccatggctcaagtgaatcgaatggatgtcttttcagagaagtgaacagatgttggatatatttctgaatacttcagaaagattggactggttatacacatggaagagtttatttgctactgatgataaattggaactgaatgcatcatgattccaacctgtcgatgcatgccatgtgaaacaacagtcctctctctagcaggactgggtttctttccatgcagaggttttgtgctgtgaggtttgttgttaatggtgtctgtacggttcctttgtctttcttgtacataatgaaaattgacctaaggtaacacatcttttctttgtctctgttactaagtcatgaataaattagtcttgctttctactctgaggcccagatcaatattctactggaatgttgattgttttagtgaatggaaatgaactggcagaatgccattcagaatacttgagcacaggctaatgaaacatttgcatgggtggatgaaaaggccccctgatagaaattaagagtaacatttgcatagtttcctgctatttacaagcacttgcacatatgtttaattctcacaaccactccatgaaaaaaaaaaaaaacaaacaaaaaaaaacaaagtacagtttggtcatcattttacagatgaggataaagaggtttagagagattttgaattgctcatggtcacagaatgacaagacaaagccaagagtcacacccagatcttctggctttcattcctgatgttctttcttctggtgagctccatctctccagatctgggccctttcttctgaatatttcttttctctgtgacttagtattttttttgcttaagaaatagatggtgtagcccattacgtttattttctgctctgttctctagtaaatcactcaggataagagaaacatttaactcttggctcgaaggagattaaggattatttgtgccattggacaaccccaagcaggctgctcaacattaaagcatatggagtcaaagtatgtttgcattctcttgaggcttttgccgctctgtagaaattgagtagctggattataggtcaatgttctgcttatgtttccagtttttgtgaaatatgaaatgaaaggagattggaatgggacgggaggaaatagaatggttaaattgccctgcaaacctattgatgatgggtacaatacacagggcagatcagagcctttcatatatcaaagattcacagctggtcagcattttcatttttctagggaaaaaatgtttatctacacattacacatggaacttcaattaagagaaacagaaattcagaaatgctataaaacatttagatacgtttttgtctcaaggaggcttctgtttaaataaatcaggatagaaaaaagtgagtttcccaaagctctggtctttaatgagacaggtggtctgctgaggacaaaagatggagaggaagagagtggtaagaagtctgctgaaaccagagctacatcggggtcccagcagaggagtgtcagcaaactcttgcctctgaacttcatgccagcacacactactaaagtaagggaatgaatgtgatgaagcaaaggcttggtgtgaggtagctttgcatccaacaaacatttgtgccatgttcaaaagtaagtaagatccaggccccgatattgaacataccagccagctagagagagaagtgaataaatattacaattcagaacagcacgtcctttaatacagttggaaaaatggtataaatgacaggacttactaaatggtgactataggcaagatttattatgtaccattcattatttgattatatcctactaatgatcctgtgaagaagctactattttattcccaattacagataagaaagtagggatcaaagactggcatagttagcaggtgaaaaatagtccctccccccaggaaagtgatcaatggtagactgcaattctttaagaaaacatttatgaatgctttagatgatgtagggcatttaaaggtaagttatccatagcccctgccctcacagagtttataataagtgagaagaaattagacaaatctgataatcttcaagattcagtgagagatgggatgaggtgagtgtcacaaaaatcttcacttcaaggaggatatgggggttacaaagaagttccatgggtgaattgcttgtggtggcaatggagaagaaagcttttggatcttcagaaaagagggtcctcaggttcatggtgtggcttgtgagtactatataatgtaatattaatgttataagacaccacttcatattctattaagaaagcattcagtcttatacacttggtcatctacaaacagaaaagctgagttataaccaacactgaatttgcatgaggtacctaaggctaaagatcttttctgcaggaatgccttagaattctggagtgatggagatgccaaatgcctctcccaagaaaggctagaagagacaataagctactaattcctctgtcctcttcctcactatgccccatcctgttattgcatgaaagagccaagagaatgcctgacactgagaggagcaggagacattttcctgagacccaggtggaaatatttgctgtaatatcccataagttaggaggacttgaacatatactggtggaattatcacttagggagcaggatcatcactcttgatgcataatgtgtctgcttctgtcatgatagtgcaagataaatactcaaacaggagctggcacatgtgagggcagttcaaggtgaccatgtaagagactatctgaagaagtgaggatgtttaaataaaggatagacgatgctgaggtaacaggggagtcattactggaggcaggaatatggaaactcattacttactggtttcaaataactgactatgtaaggagactttggtcttgctctgttgattgcagggatttcaaggtaggcattgggtggaagttaccaggaaaatcatttcagtttaatgtaagttagatctttttgaaagagccttcagttagaattgaaactgctctgaatttctttctacatctgtcaagtctggaatcacatctactttaattattaaaaatctaatattgggcaaggtgcagtggctcacgcttgtaattccagccctttgggaggcccaggcaggaagatcacttgaggtcaggagtgggagaccagtctggccaacatggtgaaatcctgtctctactaaaaatacaaaaattatccgggcgtgatgacgcatgcctgtaatcccagctactcaggaggctgaggcaggaatcacttggacccgggaggtagaggttgcagtgagttgagatcacgccactgcactctagcctgggcaacagagccagactccatctaaaaaaaaaaaaaaaaaacctccaatattggattctattgtacctcaccattgtcctgcactatcttgtgaaacacactgactttagatttggagtgcctagatttatatccaggttcttcctcttgctaactctgtgcattgggtaagtcacttaataacttaaggtttaattttctcatctgtaagatgggtctaacaataatagttaaaaggtttaaatgaaataatacctatagcagttgagcctggtccctggtattcagtaagtattaaacatgataattaattttatttttcttggcatgtctatttttatatgctaatgtccaaatcaataaacttagcccagacctatcttcttgactttagatcttatcccaaagctattgaaaaaaatctttccttacacattccataaacagtttgatttcaaatgtcaaaagctgatttcattgccttcttctttaaacatgatcctgctcctgtttggtctgtgacagtgaatgccacaatgatccaaccaatctctcaagacagaagggtgtgcgttaccctaaatttcctcccatagcccatacacctaatcaataaccaatcattgatataaatctatctcttaaataactcttgtatatcttccattcctctactattatttctcattagactattacaaaactcgagaaaaagaaacacacacacacaaacaggcacacacacaaatgtctaacttagttttgcatcaaagttatgacaaactttggaaagaagtgacacgtttacaatatttactcttccaggaacacagaacattcttcatgtattcaaatatttcatgcttcttgcttaggttttatagcttctttcataatcatctggctatcattcttccagacaagcctatttttttcctctcttccctctaaaactctcctgctatattatctagtctttcctcatatatttacagtgatattcttcatctcccaatgtacctcctccgccttccaataattctgaccacttcattattactggcattaaaatctgtatattggtactcatgactctttggggtcttagaatatatgaaaaagtttgatgctgaactggatcacagagttttcacctttcatggtgcctactggtgttatggaagcaaagttatagatgtctctagtccagtctccaaggttacattttcccatagattatacaagtcacaaaaatcccttttcccattaacacatttcccaatgcctcattagttacaaatgccatcatatcaacataataattcaaaagccatagtctgttttccaataccaatggcttcacctgattttggattccaacaacctgtgaccatctcaagcagtgtgaaattcacccggagacagaagaggagtgacctttgctctctttatggctttgaaagcttctatttttatttgtctcaagacacatagcatcttcctgtgaactctgaaaagttttctggatctggatctgaacatcttagtatgaagagtatcactgagttctcccccattaacataattaattggtccaaaagtacaaaaatactacataacaacaggaaaaggctaagattttctaagacgatatggagtgcagtttaactcttatagttggaacaataagtatgatgaaatcacttgggaagaacttatagatgaaaagaaaaggagtgagcctgagaaaacccagtgtttaaaggggagatgaagggagaggatgctctaaagaagatggagaaagatcaggcagagttagatatcaactggaaggtaacggtatcatgaaaatgaatagattgatgaatgaaggagtcaacaaagtcaaatagctcagaaaggtcaagtaagataatgtttgctttcagaaaaaaaaaggtacagcatctctggagggcattttgaaagtatccatcactttttaaaaagcacagatccttgagacttagcaattccatttccagaaattttaccatgcaaacggtacttcaacaaatgcacaaaaattttatatatatatatatatatatatatatacacacacacacacacacacacacatacaggaaagtttattataacttttctgttatggtaaaatccattacagcatattaacacaataaaatatagttcatctcttaaatactgtgatcagtatatacttattgggagagcctctgaagcatattattgaaaaagtaacatcataagagactatgaatagcaatttaatgagaggttaagcaagaaggagcatagctctctgacttcaaagtcaagatctgctacttacctgatataggatattgggaaatttcttaatccctctgtgtctgtcacttcatcagtgtaaacaaaataaacaagattctcctaccttctcactattcttggctttgtatgactactccagttggctcaagttttttgagccttttaactgtaaataatgatctcaattcagtaattaagatgtccaatttctccataatagtctcaagtcagtaatgaaaatgtctagtctcaggccaaaactcccacatctctaatacctacaacgaaagagagagaaggttcttttcatttggtaattaggaagtcattggtgacttccacatgggtggtttcagtggagtaatgagggaggagagttcaattgtagtgggagaaagaaagaatgaaaggtaaagaatggattaaacaaatgtaggcagacttttggagcagcttcagaggaaaaagttaaaatagaggaaagaggtatatttctgaggagatggaatgaatagatgtaattttcagctcatggggtacattagttttggaatagaggctactagagtacacatcaactggaagctgaaagggttctttcttggtaccttgtatttactctctgaaagagagagattatattatggactcaaagaaggtggtggaatttggaatagtttctgaaggaacatgagacaagggaacttcctagagtcatctctaggatttctgagcagctttaagagcaggtctgagtttggagatgtgttgatggaagggtagaattagtgtggctctgtgattttccctggaatccttccttagaaccaggattgcaggcataaagcatgccttcagggccatgccacaggcagtctcagaggaatcaaagcacaaaatgggccaaagacaagatctgaccacctcactattttgctgcaggccagttccagtagacagcaaacctatcaaataaagagttacagaaaatacatttttgcataacttcccctttgaaaatgcagtaccttgattttcctgtttaaaaacatgttacaaaacacacaaatcatagccactatgagtagctttatgcattaacacctaattcatcaacacactgaaatcaaacctttgggtttctttgtttaattcatgagtttctctccatcctattcattacacagcctttctccttcactaataatatctacctcatggggctttattctgtaggatgctgagttggtcccattatataaaaacaaatattttctgctgagtatcatagttcattttaatggtctattaccacctttttgaaaatgggatatttgtacatggtgacactctataaagaaactgttactagggaattagtcgtatgttcctttcatcagagaatccttaatggtcatattcaagagctctaaggtttgtggaacttctgagtgcatggcagtactcaagatccaggaagaaaacaaagaacaaacctgcaaagaaaaatggccccaattcaaagcttatatagcttaagtacttggaagctttatacctgaatcattggaggagaaatcgaggaaaaccctatatgtcatttgtaaaaattcacattttattcattttgttgctttagaaaaaaaataataaatcataattactcagaaatgaggcactgtggcactgtctttgtgttgttataagggaatacttgaggctgaatgatttataaagaaaaaaatttttatttggctcatggttctgcaggctgtacaagaagcatgacaggagcatctgcttctggtgagggcttgacattgtgtgtctgtgtgtgtgagatatatatatatatacacacacatgtatatatagagagagagagaaggagagagagagaaagccagagtgagcgagacagggcgggggttgagggaggtatgccaagctcttttcaataaccagttctagcaagaactaagaatgagaactcactaattaccaaaaggaaggcacccagcagtgcatgagcgatccaacctaatgctccaaacacttcccaccagcccccacctccaacattgggtatcaaatttcaacatgagatgcggaggagacaaacatccaaactataacggatacaatagagaaaaatgaaataaaatgaaagtcaagaagctacagtcttccccttagatttcaatttctcgcacaaattttatctacttgcatctctgtattagactgggaagcactagcattcattctgaatccatttaactatgatacaaacaccctagaatgcaggtgccctttgcactagtggtaaaatcagcctttggtaatcaaggtatcagaaccagcctgtttcttcttctatgaagggggtttcttcttctatgcatctccaagttcctttttagtattaatacgcattagcattctaaatgacctctattctcaagtgcttataatcaaaagtgccaaataagatgacttgggtataagagcataggttttgtaggcagtaagatcttgttcataatctagttcctgtttttactagctatgttaccttgggtaagttacctaaggtttctaggcctcattttcttcatctgtaaaaggggctaataattcctactttatggcattattgtgagaatgaattgaagtatgctaagtactaagcaccataactatcacatggtaagtgcccagtaaatggtagatgtaattaatattaatgaatactcatacaactaaagaggtgcatgtagtattttctgcatatggaaatcatttcactgtacattcacaccaatttgggtaataaatgctagaaagcctagtaggatccgctttagcccccaaatactgttcacatctctatgacagaggttactgaaccaactgtgtcacagactagatgtgagctctcatctgcaagtcatctacgaacatttaatgagtacataatgcatcctcaaggaatttatgatctaatggctacctgactatctataggtgtttaataaagatgttttaaataaacgcagaaatgagtgaataggctaatggaattaatcttggaaaatttacacaggacaaaattttgatcatcaaacttaattttgaaaacatttctaccgcactgatctattgaaatacctagataatcgtagtctgatgtgcctaggatttgatgcatgcttgcctttgttgtttatatttcattgaatacattatggcccaatattaattatcagttgttttataagaaatattaatttggtgatgattgtaacgataggtctagagaaggcatcattatcatcctttatttatatatatgtacacaaagatgtctgagcaaaaccttctctcccactgtttcttcaactggcataattgtacgtacctttctaagtgcagttaaaatgtacctcctatatgaagtttttcttaattcattctttgtgctttcatagctcttattatgccattagtacctgaaatatttattatatatgttatccccaatagatttagataatatattatgtattatatatgttataaatgcttctagcatttataaatttgtattatgtttgtttcatatttacctgtcttactctctcaatacctacacacacaagtcacatataaagacatacactttaagccctttgatgacagagaatatgcctgggttataacttgtactactaatgtgtgaagagaggatgtcccatcattagacatccgctggataacatttttcatttcagggtccagcacagcgcttatcatatgtgcatgcagtaaaggtttgatgattctaatgaagtgaaacccacagtataattcagcaggaactgactataacctttatattaatatttgctttttttccttttttttttttaagtgtaaaatcttgtgctctgaggttgttattttttgaaccaaagttgaccttccaggccattggtttctagaatagagttttttttttctttttacattatgaagctttggattctggttatttctgtcagactgaaacatccaagtaattcatactgcgcctgtcttctgggtgatgagaagtctgcagaagttatgctggccccctgcctggctctgacaaagataaagtaaatgccaaagaattaaagtccaaggaagttgtcaagaagttactttcttctgtttaccctcatacattttcttaattgccagcttctataaacaactggcatcttttattttgtacctgattcaaattcttcgaaaagtccttcttttcatttacagccacggaggtggtcaaaccctgtggtgtcaagtactccatactgattcatttgaatttaaataacctgttttttatgggaaagggattattttcttccatctactgtgtgcatagattacttgaagccacatagttacttattaaccactgcaaaccagtgctagagaatacagccgcacccccaccttgaaaatttttaagagcccacagctttgctttttatggaaaactaaaaacagacaaacagaaaattccaaaacaaagctttagatatttcagagctggcccccttctcagaagttttcgggaagatatctcacaccatcatcattgtggaagaaatgtgacaaattattgtgtagttcttttcactgagttagcctgaatgttgtgaaccaggtttcctatgtccatccagttgtggagatgccccactggaaatatgttctactggagtgcgtgcaattaataaaatcaagcacgggaaatattcacctgtggtgctagccactctatgcaaaaacattattaaatataactatgggcctggcgcggtggctcacgcctgtaatcccagcactttgagaggctgaggctggcggatcacgaggtcaggagatcgagaccatcctggctaacacagtgaaaccccatctctactaaaaatacaaaaaattagccgggcatggtggtgggcgcctgtagtcccagctactcaggaggctgaggcaggaaaatggcgtgaacccaggaggcggagcttgcagtgagccgagatcgtgcgactgcactctggcctgggtgacagagcgagactctgtctcaaaaaataaataaataaataaagataattatggatggtcacttaatagcttatccttgtgttcgatgagaacctttcccaaactttcaggacaagtgatctacaatctgctcctcaggctttgggtaaaaataactaaccttattttaggcccctttatatatcagatattgatagttacttgacatattttatttaacccttagaaaaggtacctattataacgcccattttactgataataatttgaggttcagagacgttcaatagtttgcccaagagcacatagctagtagttggaatatgaagggtgtgaacaaagcctgtctcccttcataaccagttccctctctcttatccctgactgcttcctctttatccaattttgaaagtaggagtgcctgtagggtaaggtcatggttttgaaactcttcggtaaattttccatgctaagctgttaactttcttaatgcaactctgcaggggtacagataatcgagaatgtgctgcagtatgaattttctataaatgagagatatgtgtttctttagcactgcaggttccaaattcaagagaatttgtgtgtcttgaaacaatggcagaggatgagggagaggcctttgacttatcctatgtcagccacacagcgctcaggcacccacagaaccctcattattttctacatacaggaattattagtttcccacactccccattttcttttcttggtctgcttaaaaaattacttcattcccataagacatcttttttttttttttttgaaatggagtctcgttctgttgcccaggctggagtgcagtggcacgatctcagctcactgcaagctgcgcctccagagttcatgccattctcctacctcagcctcccaagcagctgggattacaggtgcccgccaccacgcccggctaattttttgtatttttagtagagacggggtttcactgtgttagccaggatggtctcgatctcctgacctagtgactcgcccgcctctgtcccctaaagtgctgggattacaggtgtgagccaccgcgcccggcctccaataagacatcttacatgtatgtatagtgccttgcacactataatttccagatgctcttttgaaaggaaactttaccaggtggcgaaataagataatctcttattgctggaggaagtgaagaaatatttttcacactaggagatgctcagacagatatgagcctctcattcttctgaattgggttgaggatcattccatgtgaagcagtgggataggcttagaatacatagatggacctttgaaaagacccatctcagcccccgggaaaactcaggaatgatttctggattcttaatatactgcatcttcatgtatagacggccacgtattggggaagcaaaaaataaacatttagaaacaggcaggtttgggtttaaattccccatctaccacttaccagctctgtatctctgggcaagatactgactgtttgaacttctttactcatcagtaaaatgagaatgacatagaaatacttaagtgggtgattataaggatcagaggtaacatatataaactacctggcacaatgattcaacacatggtagggctttaacacctgcttgcttctatggttattttccttgtcatatttcaaaaacatcagacattgctttataagaagcaggcttgtatgcccattggctgcaggggcatttttgctgttctgccaactagtgaaagaaaagttaaaagccctatacacctattcttctgtagagaagtcttggccttaaaaaacaaacagaaaacccaaagcaattagtggtctaaattgttctcaagttatgggtgaaatctctgctttgtaagagataagattcccctattttaagagaaccatccttccagatttgagggaataataattatatagaacattttacagtgtacaggatgattttactaacctgcattatgatttttctgcaaaggaaatctatgtggtcccttagtattgcaggtgaggaaactggggtaacacctgggaaataaagagctgggtcatcagattctacatcccatgctctgaagctgcttatgtaatggttataactgctctctctgtttctaaggaaagaagttacaaaaactgcattacttgtttctggtccacagagatttcctttagaaagttacatcttcatcaaattcactaaaagggcccaattcctgagtaggccttcctggacagactgatttggcagtctaatcacctcgcatcctgccccccaacccaagtaactagcacagcctcaaaagtgcctactgtatacccagagacacacagagcatctaccttaaaatgtattaacaggtgtctacatagtgatggaaaataaattgatttaactgtggccagagcttgaatagagtagaattaagtttagaatgaaagatatctctttaatcaccagcttagactagagaagaaaaaaaatactggtaaggaaaaaattactgtagcattattttaaggactcttttttatgcaggtaatttttcttgattcttttaaaatagctaaatcaatttgcaggtgctctctggggtttcttgatagaaaaataaaagactttgtcttttctttgtgtcatttctcagggctactacaaaattgggcaccttgactgttcaatgcacattatattgaaaaaggaaagcacttagtctccctctctacttcattccagctaggaggtaaaactgtccatgtagagtggggaacctctagctgtggtttacaggtagcacagcaggcaggtacatgtcttctcttctgcttcatttatggtggattctatcttacttaattcctatctccttgtcaccttgattgtaagcaacaggaaggcaggcactcttattgtttcccattatatacccagaacttcatatggtgcttggtacataggagctatttgatttaaaatttctttgatctatgagtgattgcagaaatttaaagtgtatctctttccgtcactttaaaatttctcattatagcaaaatatgtatctggatttgatttatactccatacaaatttattcctatgcaatttaggtaggaaaagctttgtatatacaaagctgcaggagttggctttagtttactataagtattatttttcaggactttgctgtgttacttggatgaattggttactctaagtttgaaagtcattgaggaaattttagtggtaatttaggagtaaggtttggtaattcaagctcctgtagaaacttataaagaaatcaacctgtctttttttaatacacacacacacacacacacacacactctacatatacacacacacacacactctacatatacacacacacacacacacgcgtgcgtatatatacatatatacgtatgcatgtgtgtgtgtgtgtatatatatatataaaacatatccacacacacatacacacatgcatacatatatatacatatatacgtatggatgtgtgtatgtgtgtgtgtgtatatataacatatccacacatgtacagtttcattctttgacaaaaatggacatttttacttcctctaataggaactggcatttattcaacaaactcgtatagaatttattgtatgcaggtaatgttctaagcattttacaaatattgaactaatatataatcttcataatctgatgagttaggtactgttattatgcacagcaagattaagctcttgcccaaggtaatccaagcttgaaagtagaattgagccagagtttttaactgggtagtctggccttggagccacttaaactacgctgcctcactgaagcgaagcatatagggagagataggtcaaatccaggctactatacagaaaaacaccaggtttggagcaccccagagttgctgactctcccggaaacatgcagtttttctcatcattaggctttgagcttgttttaaggatggattcagaaggaaggggaatctttgagaagcccatctccggaaatcaaagtgaagggcaactgagaaggacatctctgaaggaagtcaatagtagctaataatagctaacatttattgagcgcttactatgggttaggcaatttcctaaagactttatgtgaattaacttatgtcatcttcaacataacccttttaaaagaggtattattgttatcttcactttatatatagtgaagctgagacagagagagtttgaataatttgctgaaggatatgcagctgtgtggcagaagctgggattaaaattcagaaagcatggattcaaggtctgttctcttaactactgtactgttaacagtgttaaggaaaagagaccatggactgtgtgtgactctaacacctggttccccagatcagtttccccagagggaaaagtgatcagaagtaaaaattttgtttattttttaaatgtaaaaaaattttccaaatcaatagttgttttttttttgttttttttttttgtttgtttgttttgagacagagtcttactctgtcacccaggctggagtgcagtggcctgatcgcagctcactgcaacctccacctcctgggttcaagcaattctcctgcctcagcctcctgagtagctggaattacatgcgtgcaccaccacgcttggctaatttttgcatttttagtagagatggggtttcaccacgttggtcaggctggtcttgaactcctgacctcatgatcgtcacgccttggcctcccaaagtgctttgattccaggtgtgagctaccatgcctggccatcaataggtcttttattgtattgtttatatatcacaaataggtcttaggaatcatccagcatcttgtttctgtagctgggcaactcttagaccttattcatcatcctgcagaactgttcctttttcagacacatagataccatccaaaagttttctgatatctttgtttttaactgttgtggcttgctgaatcaaagcagctgaatttgaaataagctcaatgttgtttccttcaaagattaattcatcgttctgggcttgagataccaaacaagcaacatttggccttatccaaaccctgaggatttatttttcatccaagaaatttcggatgtcaacaagagacccattctcctagataacgacattgatagggaagtgagcatgtgcagacctcgtcttgtaatggaagcccactgttaacacccttgatcatgttctgtgcatgactacaaagagtacagacagtagccaggtcttttctgtttctccatttgtcaaccggagcctctttttctttccaaggagactgagttctacattgatatgacagaagtcccttcacagggttcctctggggcccttcacaataactgtgtgtcccttcagagtaacgttgacattttctggagtgccgacagtctgattgctgagaatagtcttcattcttgccatagatgtggcaaagagtgaagcaaaaattttagaattgaaatagttcataggcttattatcttcaggaaattaatagaatggggatgatgaggaaattctattgtcagtctggagggatgaggaagcctactcagacaggtgtgctgagcagcctgagagtgggaggtacactgagcataggaaggaattggatatatcaagaagagagggaactgagaaagcagatatgaccctgggagggagcattggcattgagcaacccagggcccatgtgtgattgtctttgctcatttgggaagagccactaataatgtttgaaattaggactccagaggtagtaccaagtagcaggcagatgtaagttgagaagttgaggagcattgggttttagtcttagtaattagccttatgacctcaccaatgccctggaagtaaatggtctagtgttccttcatacaatttacaaggcttgaggtcaagcaaacctttataataagtattagaactgtcaatgttataagatggcaacagctattatttgtttatgctttatttgtagaagccttaatgattctttggttttacaaaaagaaaataatcaaaaggtcactttcagacaaaaaaaaaaaaaaaaacacagatatctgcaatatgctgcagttgtattgccatttcagaacatgaaaaatatgttcagtataaaacatccaataaaataaaaagtatggctagttgaacaatttcaaaaaataacactcagattatattagaccaaaatgtcaaaaataagcaactctttccaaatgctagagtctgggatcctattatcataatattggtttactgaatgaggaaacttaaataaatgagaaggaactcataacatacttgataaaataactaaatttaaaagttaaagagagctaaagacctaagttgagtattttcatgcagacgtgatgtgaaattacactgagtgctctcagattttatcagtggtcctcagattgggtatcccagaagtgccaatagaggttcttgaattatattcagtgtttcaatgtaaatatgctggtgatgatagccaacaagctaatgaaggtatgaattgttacactggaattctatgaatgcagtatcaacggcatgttgaccaacactctaatttgctgaacacacacacatacacacacacacaaatatgaaatcaaactaataatttctgaagataatacagagttctgtgttaagtcccatggtgagttatggagtctctggaatatttgatttcctctgttccttctacttcatactatggttctattattaaatttataatgaaacaaaaagtatggctagttgagcaatttcaaaaaataacactcatttaaccttataatggataaagtatgtacattaaagccagacagacaaagaagttcacattatagcttcatcattttgttgcttttaatcttaaatgattattcatcttaacttcttttggtcttaacttcttcccttccaaaaatgggactgtcacctattttgttaggttgccatgggatgtaaatgagataacataggacagtgcttggcacatagtaaacccacactaaatgctgatatcatttctctttcccatcttgtctgtggtattattactgaattttaatgaaagttaaattatctatttatatttcctcttcaccttccatttggtgccaaggacacatttggaccatgcaggaggttaagcaaggattacaattgatgttcttccttatattctgtccatttttattactcttgttgaaattgcttatttgcaatctggcaagatttcaagacaatgaattgaacaacacatctaatattggatcaaaatgaaagtagaggttggaactgctaaatcaaagatgaaatcagccaaacaagcaaacacgttttcattccagctctctaaggcaaacataaggtagagaaaccagacagaaagtaacatagttaagaaagccactgaagtcattagcagaggctaaatgagcttcatattggcatgttgtaaatgtttaactttttttaagcctcacaaaaacttaagagttctgctagaaaatcttgtaagaatcagattttacctcttacttggccagggtgtcatgttttgaagagactgcatcgcactgtaaaccaaaagctccacactaagagccatctcaggccatagacatcagatctaaaccagagttcaatcacagaccacaaaacaaaatgagctgcgatgtctagagagtagtgcctggcacttttgcctttggcattgctttgctctgaatctgaacttccccagacaagaacaaatgaagtaatctttctccctctcttgtctcccttagatcccaagcagctgcagttttgggttatagtttgtcctgctacttaaccacctgccttttcagaggtccatgacaattcaattcagttctttcaggcatttatcaggctgcttctctaggttagaacctatgggggatgctgaaaattcatcttagtcaaagtcatgaccactgctttcaagttgttcactgtctagcagcagagctaggtaattaaacattcagttcaatataaacaatgctgtgatagagatacacatcgtgtggtgggttcacagaaaagagtgatcacagcctggggctgttgggaaacttttcataatcattgctataatctttgtaagggaaactctttgtaaacttctcgaggtggccttatctgactctccttgtagcctgtcctctggcctgcaaagcccactggacatcgctttctttggacacttaccacacttcacataatggtctgttaacctgtccattaaagaggacatcccagccgggcacagtggctcacacctataatcccagcactctgggaggccgacatgggcagatcatctgaggtcaggagttcaagaccagcctggccaacatggcgaagacccgtctctactaaaacggaaaaaaaaaaaaattagcaggtgtggtggtgggcacctgtaatcccagctactcaggaggttgaagcaggagaattgcttgaaccttggagtgggaggttgtggtgtgccaaaatcgtgccactgcactccagtctggatgacaagagcaaaacgccctctaaaaaaaaaaaaaaatgtgcatcccttgagatcagagatcttaagtttataacttttttctccaagtaccttataatagcaaagagcattatattagtttcttaagaaatgttaatagaataaataaatataacatttgaattaagacttacataatgagtagaagtttgtcaggtgtgcattccagaataggaaaatgatgtttcctctgcctagcataataaaaaccgtcatttttatgtgtctgttttgtacccaaaatgacagtaagaattttacaaaaactatctccaaacatcataataatcctgcaaggtagattttactctccacaactcacagaaatggaaacccagaccactagtagttgaataacttggccaaggaggcacagctggtaggtagcagaatcaaaatttgaatcctagtctccttaacttcaatgtcacagttatactacttttcaatacttcttaatctgtgtaaatagcatataaatcctaggcattagaattttagggaggactgtggctatttctcggccaaatgaatctctgaaggctcagaagatatatttcaaactttgatttttacacacacacatgtgcatatacatacttctgtgactatacatttgtttcactcatattctgtaagcaaaagaaaaacttaatctgcattgtccagattagcaaagggaagaaagggaaatttatacatgcaccctaacttagtcagaaacaccaacatggttcctcccaaacaatgtctcattggttttctcaaaccatggtaaactaccaagttctacattttgtccttggcttttcactgtttctcatttatcctttaattaacgattaaactgtttattgttaaatgtcatggtacacatttttgtgtgaagaatgtatgaagaagaatttggcagtatggtgttgtggctaagagcacagatgttagaggtggacttcaaatcctggccataccactttcttagtatgtgatcttggtgggaggaggtttcttaacttctctcagctttactttcctcatctgtaaaatgaggaagatgacagagtccttgagggaattaagtgaaataatgtgtatgaaggcttagtatagtgcctagaaatataggtgctttgttttttgtatttgttactatcttcatagttaaggtcctaaacaaaataatgagagaaatgcatagctgaatggaaagaaaatatatatacaagtattaaataataataattatacttgtatttttatagttcaaataaactatttaacacatatgtattaggtatttattacaaggaagatgctcaaagttctaaatgctttagctttccgtgcacgcctgtatatttttcacgttccttttaaagcatctactgggcaataaattaagaccacagtagacattgggcttttaggttaaaagccaagagtggtaatgggcatcagtattggccccaaggaagggtgggtaaggaatatagaagggctgtccatcaagcctttatcagaaaggcagcattggacttcctgccaacagatgcccagtggagctggtcacatgggcacacccaagctgtggcttttgagggcaaatatgctgatcttctgtctgaaattcccgctgcctgggaagagctaaaggaaagtttgttgttattgttttgcttttctctgaagaacttcttgaggaaactgaagctttgttttcttcaaaggatcacttgctctttgcagaggcccctgttgtcatcctctcctccagcggattgaattattgtgcttttctgaggaacttctggattgaccctgtagtcttcatctattgcctctccatttccttgttgaccttgaggatgtccggtatttcccactttgtgctccagtgctacttttttaaaaggcttgttgaagcagattgagaggaaagtgggagctgctgaagctcttaatgcttgtaggacacagcctccttcaagtttgttactgtggctcattctgcaaaaccccaaaagcagacagggaaggagagtgacatttattcattcatttagtcagaaggataactttggataaattaaatttaacaaagtttaattgagcaaagaacaattcataaatcaaacagtccctcgaaccagaataggttcagagagactctgggtagctctatagttagagatttatggacagaaaaatgaaggtgacatacagaaaatgaaagtaaggtgcagaaacagctggattgtttacagcttggcatttgccttatttgaacacagtttgaatagttgtccgcctgtgactggctgaaactggttgataaagagtaggttgtagtctgtttacacatccagttaagttacagtccactataaatgaagaaatctttagcatgaacttaaataagtagacagtttaggctaaacttaattttactatttgttatgtatttttgaatactttatgtgtgtcaggggctctaccaactcagaatgtcaaaatgaatgagacttttgaactaaaaaggagatcaaagatcacgtaagaggaaaagactgagaatcagggagatgaaggggctgattgaagacaatacagatggttagaaacaaagatctcaaatccagatttctcaacccaaatcgcctgacatactcttcacatatgttttaatgcccaagctgcagatgcctcaagtgcaaatagagcagctgtacagagcatttttggtagtatgtatgtatgtatgtatgctttttttctttaaagaatatggctaaatgtgccaataattctggtctccccattatcctgttccagttattgcagtgaggcaggaagttgcccgtgattacttgcttattcttattattataatgattttcttgttacagctgcctttgttatttcactcagtccaaattttactaagaacccaacaacgagagcaggccagtgtgtgtgattggttcagtccctgcatcataaggatggccctgaacttgtatgtttctaggaaacaagcctggcccatagtctgcattcatcaataacaatgacagtgtattgagcaactaccgtgtgacaggctctgtatcaatatataatgaagaatgagacacagagcctaccttcaaggaactttttttttttttaaatagtcataatacacggtgagaaatgctgtgataaaaataaacaatgttgtgggagaccagaggacagattcctatcatccagggataggggaagaggaggcagtcaagaaatgtttcttggagtaagtggtgcacgagttgattctcaatgaatgagtaggatatatttaggccccagaaacctgtgttgcagtaggtagggggtgggtgagaagaggaggcatatcacagtaagaggaaacaggttagaaaaaagcacagagaagtcatggtaatggctggtagttaagtgtggctgaaatgaaatgtccaggaaaaaaagtgagagtttcagattttgttgggaaaggtaggaaaggaccagatcaagaaaagctttgtataatatgctgagaagtctgaactttgttctaaaaataagagcaaccaaagagtttcaaacagggaaataattgattggagaaagtccagaatgattataaatagccctgactttctctaaatggctacattaatatacatggatcataaacatcattttatttgaattattctgggtagccagtctttcttcttttcatctcaggagcagagtcctatttgatgctgaggagtttactcaagaaagaaaagctatggaattgctcaaagtcattcatagctactgacttatgaagaaggtatacatttaatgtgtccttttattgtgaataggaaagacccttattacccaaagacaggagcttgcgtgcagtaaaactaaaggatgtaaaaattctggagtgttgctttttctgatagaagaaactttaaaatataatcttatttccagtagcaaccaaaaagtctaagggcaaagcccaagccacaaattctgaagcttcaggtattaaatagttttaacatttaccttcagggatggcttaagcgtattagaagaatggtctgaaatttgcttgaatcatctgtctccactgctagacatgattcacttagtggaagttggaactcttcaaacttaaacctgactttactaaaggctgtcagcttactatggtaaatgctccttttagctccatttgtaaaatgggatcaaatttacatgttgcagtgtgcctcttccttttcagtcagagtttcactctactctcaaacggagcactcttctttttctgggtcaactgaccttaaaactaaaagagtcaataaagattcttatttccagtaatttttttttcttcaaacatgataaaataacctgtgattttaaatatattattttggagggttggagctacctcggtagaatgatcaatgaggatttgtctgcttctgtcttggaaaaaaaaaaagcaagactgaaaagagttctggagtctctgctgttcttgttgacaagtgctaagcttttgatagaataacctctgagttctatgtttgaagtctggtataagtatttcaacacagcaaacttccatttggcagtttggtattcaggtctgatggtgggcaaggccttaggcaaaactgtttagtataaataacatcttcctctcactggttcaggcaaagcctggggtgtggcagtgaggaaaagcaagtgaaatgacatttattgaatatatattatgttagggacttctcatccttttatttagttctcataataatcccaggaagcatcagttgttataaaaattttaccaaagaaaaaactatgccagagaagttaaacaacttgtccaaagttatacagctaagaagaggcagaaccaaaatttgtgcctaggtctgtctcctaaatccatcattttttctactatttcatgttacctgaaatagcaccagctggtacccgtattccttgccacccattttaaaactttcttttcagtgaagatatttattttgttgtattgttactgttgtctttttatgtgtatgtattgggcaggggagtggtagtgaagtatggcctattgtaatatcgtcttggtgctgagatcctaggacattttgaagttccaagtttccctggttccctacactgtcatctcatttgatcactgcaacatctctataaggacactttattgttgtgacaatttgacagaaaacagaggatttagtgacattgtattgctattgtgtgttttaagatgaattttcttgtctaaatcttaaatcattttctctatagcacagttcatttttcccaaaataatgtgatagggtcagaaaattttattatcttatgaccagtcttcttaattatggtttatgtccattctctcagttattcattcattcattagataaacatttcttaatggattagatttttttttatgggctaattactggtctaagcctgagagaaataaaaatggaaaagatagagtctctgctccataaggagcacacataatctagtgaattatttgcaatgtactccctgccattacttttggtagccttgtttaccattcaacagcatttttctacactgatactctgtggggatggctcacagtagaaacaaaacgtggtttctgtgtgtgtgtgtgtgtgtgtgtgtgtgtgtgtgtgtgtgagagagagagagagagagagagagagagagagagagagaaatgcatttaagaatcacccagaccaagttcatagaattggcgtcatatttcctgaaacagacaaaccaaacaaatgctcaggtgatacttctgactggctgctatgctatgctaggaaaaacaggaacagtgagtgcaggctgaagtgaacagtgaggctgactgctagagttccagagctttcttcactccctgtttccttacaaggaattgctggaacataaagagttatgccatcagaataatattgaggtgaatttttaatgaaagaaaattgttataatgtgttattcagatagaaaaagcagattagaaactatgtacagtatcatcttattcttaagacaacaaatatatgtgtcaatgcacattaaagactaacatactatcagtggctctatttaatagataagatcatgcatttatttttaaattttttatagttaagttcctacaatcaagagttactgtttttgtcacataacaaattacatttaaattctcatgatgtttaaaaatgttgagaaaatgaaggacttgcagttaagagcacagcaaattctaaagcaaaagagagttggattgaaaattagatcaaaggaggagtcatagtagcaaaaaagagctaccccaaacctaacctcaggatgaaaacaggggtggagaaatgtcccaaatggtttctacaagattctgttgccccttctgagttatttactcagacataggctcctgcagtctttcccctaccctagaggctattaggaaaccactggatctgctgaggctaaatagatgatggtcttgggtggcgttaaggatttcttgatgggtcagtaagggaaagggttgaagaatatcactcattacttgagcctgaaatccttcttaggtagaccaaggcaagaggcaggtaaagcaaacatgatacatctggaatgtgtctctattgtacctcagtggctctaagagtcaacaactgcctggagaggggctttgctctcacagtaactatgaatattttggaggtgttttatatttattttaagatgctgtctcttgtaaaaattatgagaaaaaagtagaggaacttattctccattttccctttctcttgttcttctttcctccctcttttcctccacttttccttttctcccctttcacagctatctctgtaactttctctccctctctccgttcgtctgccttttccttcttccctttctcagtcatatccccttgcctgagcttttgagtatgtatgtgaacacttaatttgtcaagttctgttaggtactggggacacaaatgaataagatgggccaggtatctcttctgaaaaaatagagaatgacagagggattgttagaatacttgctaaatattataacctaaggaagaacttgaactcttcaaagttttcacatgaagagcagaaacatttcctaggcatttctgccggtgtgatcaaatgaactcttcagctgaatctctcagttggcttctaggagctgtcagcttcaagagcttggagatgctgctaatctccagtgacagctccccagcatttccacagctactctctaaagcaggttggtttttacaattacatgtgaataaaaacaacaaaaaaaggaacaaaggggagtattttttcagtctcaaataattttgtattgatcttatatttccctttacttttgaactctgaacagacgtttcttgttttctttgttgtttttacaagaagatgtatgtggggaggggttgcagaatttgtttataaagctcagaaaatcctaagtaaatcagctattatatctcagagattaggagattgagacaaagacagagcaaaagtggcactataattaacaggcagttgcaggaaaggaaggattcatgctgtgcaatatgtaatttggaaaccaaatgttcttgtcagagagacctggccgtgtgcagaaagctatgggggctgttctagacaaatgaactgacaaaacctgcttagtgtgctggagaatactggtcatctgttctctttttcaatctcggtcacagccagactattcatcatttcactcaattatgcattttacaattattgatcaccaactattcattgaacactttgctaagcatagaaacacaaagatgaataatttaaaaatccttgccctcaggttggtttctgttttataaagaagttaaacataaaactgacatctttgtctccaacccaccaagtgacttctgagacaaaaaatcacatagattgtcatgaaagtagagaggctcttcaaaattcatgcaagtttcaagaaagcttctgagaaagacttgaagtatatccaggtggaggtcatttctgagcagaagacgtaacatgtgcaaagatgtgaagataagcaaaaatgcatcaaattcaggaaactatgtagttcttataataaaagtgcgtggtagagtcaagattggtatgtaaagaacaagaaatattctaggataatttggaatatagctatttgattaaggaacatacaatcaatttacacaaacatcaaatatctcaagggcagagattgtaaaccttttgatttttgcattgccagtatgcagtgtagtgcttgacatatagtaggtgctcaacaaatgtagagcttggactaaccagagaatagttccttggcaatgttgaataatagattttaaaggaggaggatagagagaaagaaggaatattgggctcctaatctgtgccaggtgctgtgttaagtgttttacaggtgctatgctaattaatagtcacaataacctcctcgggggtatatatatatctatatgtgtgtatatatatatatatatgtgtgtatatatgtgtgtacatatatatatagtcatttttcagaagagacatttgaacttttgggaggtctagtaatttaccattgtcactgatagagtttggatcatatatgtccctgacaaaactcatgttgaattgtaatcccctatgttggaggtggggcctgtgggaggtggttgggtcatggtgttgcattctcatggcttggtgctgcccttgagatagtgagtgagttctcatgagatctggttgtttgagtctgtggcacctcctcccaccgctttctcttgctgttattttcaccatgtgaagtacctgctcctgtttcacattctgccatgagtaaaagctccctgaggactccccagaagctgagcaaatgctggcttttgcagcctgaagaactttaagccaattaaacttcttttctttataaattacccagtctcaggtatttatggcaatgcaagaatagcctaatacagttacatagctaatgtctgttgagagacaagattcaaactcaggtttatctttctccacagcctgtgcttctacttttgggtacaagcctttgctgaaatttccgctgcagtactctgggggagaatgctacaaaatttgttcgtttatagtaacagaataatatggggttttacaattaggtactaatttaatttttgtagtatatgtgtaaattctgtaagagttcagaaatggaattggaaattagagatttttctgtattttgtgggttcaagaaaccttacgttcaatttactaacagcaaatgatataggatacaaaatatataaataacaactgagaatgttgaataagtgattgtgcataggcttgtgtttaaagtgaatgtctctgacattgccaatgttaggttgctaatatactgtgttcggatattttgaatgtgtaattgggccgggagtggtggcttatgctgtaatcccagcactttaggaggctgaggcaggcagatgacctgatgtcaggacttcaagaccagcctggccaacatggcaaaaccctgtctctaccaaaaatacgaaaattagcgggcgtggtggcgggcatctgtaatcccagctactagggagactggggcaggagaatcacttgaacctgggaggcagaggttgcagtgagctgagattgtgcctctgcactccagcctgggtgacagagtgagactccatctcaaaaataaaataaaataaaataaaataaaataaaataaaatatgtaattgatgagccacttggcttccaaaaagagcatataaatatagcaggtgtggaggagaaaatgcttctagagcactgcttagaaaaccttgggccgtagttgggtcttgctgctcctgtacatgttcctcttgcatagctcttccctgctagtgcagagctaactttgtgtttccctaccttcagccttgttgctgattttataagcagtgcctttttcattttaattaataaggactggatcttttctttctttttttccctctgagtttcaggccaaaatatattttagcctcacatatcaagaagctctgccaccttcagacctctgagtcatgggcagtgactggctccaccaactttcctccctaagtcccacatgcttcccaatgtgcacatttgctagatgaatcaatgatgtggaggaggattccagatacatagaccttcccacttcctgtgcaagctacccatggcttccctcccaccccagctttcaagagttaggagtgttgtgtcttgaagtaaagaggaatcatgctcaggaccttgttgccaggggtaccagagataagggctcctcacagaaaatggtgtgcttcttactccacctaatgtaaatttagaaaccactgataagttatacatatgttcttttaagatctcctagtactgttgaaagaggaccatattatttaatgcaggggcaacacgcctgcctcatattgttttcataataaaagataatagatctgaatcacccgaactagtctcaaaagagtcggtcctcaataagcaatagcagttactatcataattattatgataaaaatgataaagacaatggtgacaaagacaaagaaaaatacattctatgcttggcacctaattgttaattcctgacctaaggatcccactaaatttcacatttaaaatttaagagaaaagagaaaatattgatatgattagaagactgcacttgtggttattctcttataatctaaatgactagtgtttccaaataacatgattttctttcacatgttaaactatagtctggcccatcatgagaaagatacaaggttcatgaatcaaaaaaatagtcaaaatttcagataacctcagacttcaaattttcatcataccgatatttttagggaagtgtctgtcacttggatcttgaataagggtaatgcaggccaactttgtttccatctgaagtttcaatatttttatcattttcctccaacagaaatgaggtctggcttttagttagggaatctatttcatggatcataagattgtgttctcagagtacctggaagttacaagcagatgctcccagaagaaacttcagacttgatttgatttctaggtgacacatatagagtaaccttgagtagagaaataacataattatcccagtcttgatgggaactagtcataagtaatgcggaagcagcttgttcaggagaaatggagcggccacttggtaatccagcccaattatggtttccagtttctagtgcagttgccagtaacaggtagtctgtggtaaagagtcatctgtgatgaatagtgtcctaggaacatgcattggcttcagggggagtaatgtgaaattttagatgtttcattcttcaaatttttaaggacttttgacttgaataaaaggttgactctcgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggaggctgaggcaggagaatggcgtgaacccgggaggcggagcttgcagtgagctgagatcccgccactgcactccagcctgggcgacagagcgagactccgtctcaaaaaaaaaaaaaaaaaaggttgactctcttctgagaggtaactctcagaagagagtcaactgtattatttgataattttatcatgctagtcttaagatgagggagtggtgtgggttaaagtggggagtgcttgcactatttgacctgtgatgttcactgaaaatgctgaggaccaataaaaggaggaatgtcatggggaagagcttgatgagtaaatctttagtccctagtttctgtctctattaaatgggaatgatagtgaagctcttggaggattttattaaggttaataataatgatttgatagacctcatacagtacctgagcaataaatgcttaatgtatgagaactcctagtaggagttataactacagtagtcattctgaccattgttctaatagtgataataaaaataatataaataatcatgacagcaatcaattgtaagatgtttacaaggttttagtgtgttaaagttttatatgtatcaatttagttattgaaataaagtgttattatcccattttagaattacttgtaaatatagtggtggcgttagtgatcgtgggagtaataacattaggtattatgatggtactaatgcctcagatcctctgtagaaataggcatggtataaaagaaaaacaggaaaatacactgctgaagtttctcaagttctttgaaaaaacaaaaacaaaacaaaacaggaaagtttttagaacctagatgtcacctcccgatttcttccccctatctttactcaagttgaagaatccaacacatggatgtctgaccatatcctacattattcaaagattttctgttatggttcattattctagtaagcatctcagtaaataatccctgagtacatattatgtgtgagcacttagtaaggcattgaagatacaaaaataaatgtactgcaatcactggactactttaggacctagcagagaagaatattaggataataaatgaattacagtataatagttgttgcaatactgaggtaattgtgtaacacatgaagagaaaaaatattctcattgtggtgggaaggacgtatgtatactatggtggtagggaagaagccagtgtctattttagattggaatcatttgaattgggtacattaacattgcatttgtttattaaatactatgtgtatgcattgtattaaaaacaagtaattgaggtagtaactattaaaatgtgtgtagttaatatttctcaaaaattcaaatgcagaagaatgatgtacagagtttagaccatgagatctggagtaagaagatccataattaacactaagtcactgaacctctctaatcattccttcatctgtaaaactgtgataatattataataatatttctctgccatactttcaatgatataagtgatccataagctataaagtgttatacaagctagaaagtgctacataagcactgattattattttacatagctggaaaggtctgggaaggtttcatggaaagaattttccttgagtggagtttaatgagtagaattttgatagggagggagcaagtttgtgtcggggagatcagaaggtctgccgtttccctcttgaaaaaaggtggggtcattacgttgattatcctccacatggtggagggaatggcataagtaaatacatgtaggtaggaaaactcaggatgaagttattaatagttgggatatatccagtcatcagtagggagtcatgtaatgataaacagaagagcagcataatcaaaagggtggtgtttgggatagtactcttcaaacaactgataggatccactggaaagcagagagactgaatgcaaagttaagaggctagagttaataagggcctgcactagattggaggctatgaaactaaaaaggaggaagttgatgtaagggatagcacaatgataaaatttccagagattggtttatctctcaaatctccagcatagatttgaaagagctttgaggaagtatcacagtggtcgatatcctccatctccggcaaaacagagctagaacatacatggcattcaaagctttccatgtttaggtcttgatctaccattttgatccttcaattctaagctatagccatagtaaatttttcctcattctttgaccatgtctaatgttttctttatgccatttcttctgcatggaatattagttccaacccacatagaatgctctcatccttcaatcacaagctaaatagtcacctttgctatgaagtctccctggcaatgttctcccctccacttctgtgaaacacctaacacgtgttgctggtcccattgattctcaaaatcagtgtgtgctaaagttgatactattcagtaagcaggactgatgtatgaagttttcagtccactgtgggatcagactcttatgaaggaatctgacttttggatttcatatccaagaatgtttgtagttggtctgattacactcgtaatacccaatatcagtaaatctctgctgctgtcagagcatgttgtatagcattctatacagtcatatgctcctatcaagaaagactctttctggtggtgaactggaagtataccaatttatctctgatagttatgaggaaaaaagttattcaggataaaggtacttccaaaatataaatatttttttctctgacacaaaggaagacactttctattcccttaatcatgctaggtttcccaaagattgcttttgtagcaaaatctaaatacaaagcagcccattctctgtggacaaactattaagtcaaaattatatcaaacaatgccccctttgatgtgtaaagtgggaaagtgcggtccgcaactttttacttacttactgacccttaaggagtccagtaacagcttcaaaatgttgtactactaatgtacaatttcaacaagcaactttctatttataggttacctgtgctttgtcctgggtaggtagaattgttttccagcccaatgtgctgacaattttcagcttggcggtgttctgagcaaataaatccctcctgccacccttcccccaagcatcttacagccacacactcttacccttgcgctattcctatgacacagttactactgatgctgatcttaaaatccccagcagcccacttggatgctttgcccaggtaattgcaaatacccattagtaggaactgaccaaccaattagtgagtcagccagcagcccctgcttttagttctcttccaaatagcttgtacatttatttctctccaaaatcttattggtgacctcttagcaagtttctctatgtgcctaaattaattctgacttcctataaatattttattcaattagcgagtgaacaaatgaggcgtacatgggaggctcatttatttttcaggccaaaacatgaatctataatatggtgatcccactcattgaggaaatccatctattccttctccatactcacagctagtgcttatctttttaaaaacaccataatcttcagcatgaaaataatctcctaattaacccccagcttccagacttcctctactccagttcattcttctcacagtagccagagtaatttttctacattgaatttttttataaagaaacttccatagtttttactctgttatatttaataactaaaatatatgagtggaaatgatatagtataataataaaaccaacaccataagcccctcctccaagttaagaattagaataatgctgttacctttgagggtaccttttcccattccctaattctatttatgtgctttcaccttctgcaatttgcttttctcatttattaatgcttttaaaagtcatccccattgttgcatgtagtagtatattgttcgtttctactctgtgcaatatttctgggataatatttattcatttttccatgctcttgctaacagatactttgattctgtccaatttttgctactgcaaacaatgcagcaacatttatttttgcacaattttattggtatcagtacacaagtttccttaggattgaaattactaagtcatatggttttcacctattcaacttgacaagatcatgtcaaattgttttctaaagtagttgtgccgattcatctgcctactagaagcgtttaagagtttgcattgttcacatcatcaacacaaaattttatcagacttatgaagtacaaaaatatcgttgagttctttctttatattttcagaatgaggaatactattgaggttttaaaaatatctttattcagcattcatgtgtctgcttctgtaaaataatggtttattgctgtgtgcttacacctatattgtattatctttttcttattgatttttaagagttctttatatcttctggatactatccactattcatcatagatgtcttctcccactttgtagattaagttattcattttaatatgatcaaaattattctttctttatagttgacacattttctgtcttatttaagcaatattttcctatcccaagatcataaagatataaaactgtaaaatttttatatttaagtatttaatgagtctggtgttgattattttgtattcttattttccaaataactaaatatttctcatagcaacatgtgttgaataacacttctttcttctccccttacttatctgcaatgctcactttgtcctatatcatatttctatactatgtgagcctgtttctatgttctgtattctgtttcatggtcatcttgtttatctctgtgccaaatcaatactatattaattaaaaattctttataataaattactacattaactaaaaatttaaattattattaaaatgggtctactagatcaaattcttccattttatttttcttcaggtgtgtctttgtttaggttttattctttcatgtgcattttagatgaacttggaaacttgtgaaaattcttattggggttatttttggaatttctttgaacctataagttaatttgggaagattgatttcttatgatactgaatttttctatttataaatatagactatttttgcatttatttagatctttaatgtctttcaatacaattttataatttcttccttaaatattttacatttaaaaaaagcattaattttgaaaaactttcgagaatttttttatcagttctcttcatttttgttgttgttattgttgataatgaatagtatcttttttccttctatatttgttgagatgatcatgatttttctcccctattgtgttaatgtgattatattgattggggtgtgctagttcaagcaactttgtatccctagtgttgtcattttctctttttttctttcttcttttattcttactatttttgttttaattttattattctggtattattattaactctacttttggggctttaacctgctttaacataaatgtttcagagggatgtaacattgacttctgccattttcttttaattaacaatttaaattacaatacatttatacatttatttcaatatattttaggtgctttggtattatataatatatgatatgcagtattttaaattaacattccaacccacctatttacaaatatttatttgtttgagccaggttatttaaaatttttttaaatttccctaagaattctttcttgtgttattaatttctgatttaataatatctagaaaactttttatggtaactattctctgaaattcattttaatctagaatgtggtgaatattttgtcaatgttttttgtttgcctaagaaaaatgtgtgttctgtaattattggatgcaagtttataattatattcattaggtaagtttattaattgtttacatttttcaaattttctatacctttactaaatttgtacctacatcatctatcaatgagtcaaagaggtctgtttacaatcgccttcttgggtagtggatttgttgatatttttaaatattttcttcattatttatttaaatattactcatggctattttaaattatgtgtctgataatcttaatatctaaagtccttgtaagtctacatctgttgtttctacactttgtcactcatagtagtctgtttcatcctatctccttgatggtggtctcatatttttgctggacttaaatagtgggaattttcagggtcaatatggagacgttttcttccagagaagattagacttggtttttgattggagccaaaagactcttctgagtttgagccactttggtcccttttgagagtcttgcttaactttagattctcaaattttctgatctcagacctgaaagaactatttttcctctgggcatgctggctttcattttgctacagcccacttttctggttttagttgataggattttgtgtgtcatttggtttggtcttgcttatttttctcatattcttacatggctgagattcattaaaaggatgatggttagaatgtattaaaaccattgacgtattatagcaggacggctcaccagagtgagggccttgtgtgctgtaatgacggaagtgggaactttttaatatagattttgatcatgttgcttccctgcttcaaaatcctcctttagcccccaggattaagtacaatccctttagtaaaagcatcaagaccccaggttcaacctctttggacttctccaagctcctttccttctacttactcatatgaacctatatgctcctccccaaatagttacaattccctgaatatgacacactttttaaagactctttctgctgcttcagatgctttttactatttacctaccaggatacttcagcgtttaagtttcagtgcacagatcacttccttttttaagtgttctttaagcccccaagactggtttaagtgcccttctttcaaattcccataactacctacacatacctgttttaccctttacaacactgcattactttctttgactgtttttacctattttttaaatcagactcttagggcaaaggctgcttttgtttattccttgatttccagtgcatattacttagggtgaccatatgaattaggtttccagaagagtcctggtgtttacctcccttcttcgtagtgtacccattagtagtgctcacttttattttcaaaagtgcccattgttaatgatgaattatatggccatcctaatagtctaatgtttgttgaatgaatgaaaacataaaaaaaagggaagcaacagatgctggagaggatgtggagaaattggagtgcgtttacatttttggtgggcgtgtaaattagttcaaccattgtggaagacagtgtggccattcctcaaggatttagaaccagaaataccatttgaaccagcaatcccattactgggtatgtactcaagggattataaatcaatctactataaagacacatgcaaacatatgtttattctggcactgtttataatagcaaagacttggaaccaacccaaatgcccatcagtgatagactggataaagaaaatgtggtacatattcaccgtggaatactatgtggccatataaaaggatgagttcatgtcttttgcagggacatggatgaagctggaaaccatcattctcagcaaactaacacaggaacagaaaaccaaatactgcatgtcctcactcataagttggagttgaacaataagaacacatggacacagggaggggaacatcacataccagggcctgttgaggggtggggggctaagggaggaatggcattaggagaaatacctaatctggttgacgggttgatgggtgcatcaaaccaccatggcacgtgtatacctatgtaacaaacctgcacattctgcacttgtaccccagaacttaaagtataattaaaaaaaaaaaaagaaagggaagagaggaggaagaactggatgatgatatctgattcacatttctagcaatgcttctttgcaaaaattatttacctttcctgtgctttagtttacccattggaaaaatgagggaaatgttatctgtccactttaaaatgagactaacaataataaaacttcagataccttaaatttatattacattttaagatttgttaagcaccttctcaaaagtgatttcatttgtcttcataatgacagtgcaagggtaggcaattttggtgttattatcatcaattcatttttcattagatgaggtgctaattctgagcctaagtggtttaccaaagactgtacagccaacaagtagtagtaaactatattgtgggttttctgatttaaaatttaggactcttttcattttatcacatcatcactgtgagattttatgagaggcttcaattaaattattctactggacagtgctttgtgaattatagaaagccaccaaactgtacggtcatgcaactattagtgctaaaatgtaccctcatcattattttaaaatcatcatcctaacaatacttcagacagttcccctgcctattcaattatttcatttcaagtactttgtttactgaaataatatttcattgtacataaaacaaatatcaaaattcagtcccacaaactttatagtttattaaattggaaagtaaatgctcaaacccattaggttatctgtaactacaaagaccagattttgtcaactgaaaactgaaacacaagctcttccttcctacaactgccccacctttttaccttgctgattctttcttgtgcttcttatctcaacccatgtaaccttcttagattagccttctctgacccccctttgccattccagtctgaaatagatcaatcctgtttttacttttcatagtacttttttgtcatttgtaataagatattcctttgcttactaatgtctgtcttgatcactgaatggtaaattccataagaacatgaacctcgtcactatatatatttttctttaccatttatacccagaattgaagtctgacatatgttgaatggatattgttgaatgataaatgactgaatggaaatattacatggggtactggaatgaagttttttttttttttttttttttaccgtttttgtcctgaaattttctctgagtagggattttaaaaatttaataatttcagataatttggagacaaaatatcatagggccctttttaatcaggtcaccagcctctattttgtggtattttgatagatagcaatattttagatggaaacagagggcaactctgtccctttatgacccctaaaaaaaatgatactagaagagtatatgctgtaatgacagccagcctggatacaacacttatatagctaaggactgtgtccaatcattgttaacttactattctgaatgacaaatttggttaacaaataatgccttaatgaaaggctgtattgtgtacctaaaattaagaagaattattagctacctggagaaataaaaaccttttccagcaaacatttccatacctttaacatttcaggtgaccaagagcagtaattagtagttagtgttagatggttctggtaactctgtttgcgtccatgtctgtatttattgagggtatactatgtgtgcgatgcttgtgttaggtattgatcaatgttacttttgcaaatcaaatttatgtcatgtttaatgtggctattagactcatccaataaaaataaagctacatttatttttcattggttcctctaccccagaattacaattatgacacataatacttttcatgattttcacataactgtcatacacaaccatttgtagtgacagaataaatcaagggggtaatattccattgaatttgtatcatccttatgaattgggtgcctgcttgaatgcttggctgaggaattaagtgtggctttcacttaagagttctatcagttatgtttatttctttcttactggattaattcatgaaaaatgaagaaccatggcagggctcatatagctactttgaaagtcctgtaacagcagatgtagattatagcacaattgatgtaactgctttagtagctatagctgaattgattgtccagatggtcaaaatggcaagacaaaataacggtaatcatgacacatcttgtgttatatagcattcttcatcttataaaactcttccactcccataatctcaagatgactttgtttatcataacagctttgttaaatagacagggaaatattttaaagatcaacaaacaggtaaaaaatgtatatatatttgtcattcactatttagcacctacttgtctgactccaagacaactggtctccctgactacagttcactttactgacagaaagattgttctaaatgcagatttaatctgctttctctattatgtaaaacctatttctctctgttggtattagttaaaattcagacactataatatttgcctataggcaagtcatggtctagcttctccttgtctgtctgaccttgactttaattgccccttccacaagtgtgtcaggcttttacatgtcttcttttgcccacacggtttcttctgttggcttatgctgcagtgtcagctcagacgttacctctttcataaagctgccactgacattctccacctctccctaaagatactcattttcccaatcttcccagcctctattattttatatcaacacagcacttattggtttatagtttgcttctacttactggacttactgtccatttattttcctatcacctggcagggttcaaggcacatactatgcaatcaaaagatatttgttgaaaaaattaataaatgattgaataatacacagtgctagttatcttacttcactgaaactgttgttacatattcacagttgtttactattggtcaaatgtgttcatatctctttttccatctgattacagaaataacataagatccataggcaaggtcccactttacaaatatgaaagagaggatctataaaagtattatcagtgactgcctccaacttggtgaccatatgatgtcacttcaacctaagaatgtactttctgatgtgagttctctaagtgtgatcattagctgctcttaggcaaggaatctccattgtaaggtttaatgacttgagatagcaagttttagagtagtaggttctgaaagagattgaagcattctaaagaaggataaaaaacttttaatttgtatccttctcatctcatccttttgtcttgacaattaggcattgtatctgtggtatttagtaaaagcaacaaaacaactatggcaataacaagagtagttgataattagtgagtggtcactatgtgcagggcaccatgataactgttacctgtgttttgtcaattaaccagcaaaataaattattttaatagatactattttcttcaccttacagttgaagaaaccaaatctcagagaggttccaataccttgtccaagctgagtaggtagggcatagaagagtcagcaattctctcctctgaagggaactggctgtatctgctaacctagtctgaaatttttgtgggaacttgccattaatggagtgtctccttgatgacttagatcacagagactcttttcctaatatagttatgataaactgttatctggtgtttttaaactatctcatggtattatttaatataaaataccgatatttccttcctgatttggttttcctgaacattctgtgaagtcttagttcctcaagagagagccgttgtcctgatagtgttgctaggaggattccaaattagatcaagccagtccccagcgtcttgcagtgttctcgatcagcccaactgcctcacggagcaatgcaggacagagttgttcaacagaagcttgatcatttatatttgcatttagaaattcgtgaggttccaactgtgtaccccattttataaagacatatgagctgctatccatgattaagaatttacatattggaatgaacaaaatcttttttgtgaggtggacctggactcaaatcacagccacaccacttactagctctggtgtattggacaaatgacgtaatcattctgagtccagattgagtcatctgtgaaaattgaaccaataaaaattatcttatgaagctgtaaagacaaaaaggaatgtgtgtatgtgtatatacatagtagttgcttaacaaatattattacttctttttaatttaaaaaagttaaaaataatataaccatattataaaatatttatgaactaagaaaagaaaaaacattacctttagtcttaccacacaaattaaactaccactctagctttaatgtattttcttattttcattttcatatggctatgtttaaatcttacatttatataatacttagtgttaaccataagcactttccacattgctagccatcatgaacgttatctactaaacaacttagtcattccactcctaggtatttactgaagagaaatgaatgcgtatgtctacataagtcaatgacgacttctccctaaatgttcatagtattttatttgtaatagaaaaatggtggaaatacccaaatatatatcaacaggttctactgaaaaaaaaaattgtgacacttccatacattgaaatactattcagcaacagaaagaaataaactattgacacatgcaacatagaaatcaatctcaaaataggtatatcaaatgaaaaaagccaggctaaaaaagagtacataccctatacttccctctatatgaaattctagaaaactcaatctgtagtgacagaaagcttgcttgaggatgagaaaagttgtaaagggaaagagtacaaaggaaacttttgagagcaatggatatgttcattatcttgattaaactaatggtttcatagatgttggcatggctcaaaacttctaaattgtacactttaaataggttgttgttagtcaattatacttcaaaatagttgtaaaaaatgatgtatctttttgaaaagaaatctcactataatggttccattgcatcattatttttacaactcttcccattgctgtatgtttagatgcttcagatattttgctagcataaacaacattgcagtgaacatctttggcataaaggtattgtatagtctttgatttctctttggagtctactaatggtgaaagtatctttctttgggcaagaatggcacagaaaaatctttgtagtcactcctcatttaagtttcttaagaggtggagttatgtgtatagctgacttaccagctatttaaaaaaatgattttaattactggtttcctggcatcaccacttgggccactgataaaaatagtagcatagaggcacttgggtgacaattagagtggtaaagtcaagagtctcaggcaggagactaataatgatagaattttaagcttcttcaagcatctgaccccatcaggcttccagggacctcatgaactgtctctgttcatctgtatatactgttaaccatattgttcaatagttgacaacactggtcacacagtcactactcagcacttccttttcttcttagtaaatggcgttttctctactgtcaatgtagaaactggcatatggacctttgtctgttgcctttaacactcatcatttatttattcatacaataaaataaatgtttgctgacctcaaactatatgccaaaactttgattggtactaaggacaaaactattaataacacatggtccttggcctcaaaaatttgacagtattatttgagaagccggtaagtaaatagtagatttgaatagggagtgtttagctcagttagaggcataaaccattgggaaacatatagtgtgtgtgtgtgtgtgtgtgtgtgtgtgtgtgtgtgtgtgtatgtcatctaacagacagtggtacacatatcccagactaatgtgttaaggtagactttctagagtaagaggcatctgagttgataaataaagaagaaagatccaggtgaagaaacttggcaggagagggaggagaatatttcaggcagaggaaacagcgtgtatgaattccagagggagaaaaggtggaacagtaatctgtggctatgtatgactgggatgctggtctgggaatgaatggcctgtgctacaccctcaagctgttacccttgggttgggtcacctctcccagaaaagatgaataggctgaagctataaagtcaggattggcaaggccagggaaggaaaagtgaggagggcaaggacactgtcaacaggtcctggaggccaggccaggggaggggcttgccattgacctggtggttcaggcttccaccattggcttaccccttgttccctttattcatcagtagtggagtagattttgtgtctttcagtggataggacctaccaatccacctgacttctcttccaagataattctggtttaggtcactatctggaaccttttatgacctggtgatatgactatattgatgaagttgtcatgttttttaaaaaatttttctttatttaaggaactcataggaagtattaagggcaaaaaaaatcttgcaaaaaatttttaaaaaatatttgttacctggttgcaaaagtaatatatgctcactacagaataataattagtattaattttatgatattaatatgtttattatagaaaagttataaaatacaaaaatataaggaataaaacaaatattactggcaatattcagaggtggcatcatgaaaagctttttccttcagtatcatccacatatctcattttatgtatttcatcagtgccccactgataaatattggattacttccagctgtttgctattattaatattgctacaattattatccctacatatgtatcttagcatacaagtagtagtatgccataagataaatttataaatgtggaattgttgggttaaaggcaaaaaagcataaaggatttcatagaataacctattccccaacatatatttaattatcataccccctattactggacatttagattgtttccaaattatattcttatagataatttaaaatattcttaaatactgagattgctttgggcctaaccattaaatgctgccagtccatgtgtcattttatgttggcaaaagatgctggagtttggctaattcactcaacatcctctactagtatatccaatcataaaaaagggaaggcagggaatctgataatcctatttgattaccaaattatcagtaatcaaaggtttcattttccaatttttatacatattaactcataattttcatcccatctatggcagaggtgtgttaatcatcggcagttggagaaactgaggcctagtgtaattaagtgcctttcccaaggtttccattggcttgggttgaccttaactggagttcatcagatagcacagtttatatttttccaactactatgtcttctcaccaaaaactgcgagaattacggtgcttcttttgtaactctgagacaagatagtatctctctttttaacaaacaataacacttaacaactattgactattattactacttctcaagtaatgtttttagtactttataggtattaactcatttagtcctccaaagccactgagatagggtctattattgcacccaatatatagataagaaaaccgaagcacagagaggttaactaacttacccatgaacacttagctctcgagatcagaatgcaggattgaagccaagcagtttgctcttgagtcagcattctaaaccactccaatgcattgcctcccagagacactttgtgccagaaaccaaatggtaggtgttgtcttactatatgtagtaacatcacgtagcattaagaggcagcgtagggatcaagaacagagattctggagccaaactgcctctgtttcaattcaggttctgccacttactaaatctatggccctgtgccacttactagatgtgtgaccctctttctatttgaatttacttatttaaaaagtggagcagataatagtaagtgcctcataagattattatgggaataaacatttacatagcacttgaaacagtgcttggcatatacttatcagtatttaagtttttgtttaattgtttgtagtttgatttgtcctctgatttctgtctcacaaagcatactctagaaaacggttatctcagtggcaacctgaagtgaccagacacatccacagtgtctgactttgtcaagtggccctactcactatggatgccacggcaaaaaactgggccctgaggcttcatagtatcttatatttctgtgagatctgttttcaagggaagaatcagccttgccaactttccaaatttagccataactgggtcacctaaaaaagtagtgcagtgttccctcaagtaaccttttgcttatgttaatttgatatgaagtgtttctcaccgaatcttagcacgttgtgaatttcatgagtcactgcttcagcagataagtgtgtgaagagtgccttttcagaaccattgctggaggtggtgcagcttgtttctaccctaggtcaagtctgtatctctagggactgtggtaaaaacaaacacacaaacaaagaagaaataggatcagatatgattgtgtttatttttgtcttttgtgttataaaatgttcaagaaggaattttgccttgaatgagttgggccacatgtctaatactgctcactggccagtgccagggcctttgctaggtgctctgtgtatgagaggaattggatcctggtgctgcctttaaagtcaaaagtcgcacagtctcctgttgctcactgcctctagagagatgcttataaggaattgtcttcaatttgtggttagaggttgcttttctcaagcctatcttgacacaggaattgttatctgacacaagaccttctccttaggtcaccaaaccaaagaaaagctgttcagagagactggttgttagagtcatgtgttatgtctgcagtaaagaactattcttatctcagaggacaaaggatgttgggatgaggggagaccactaacatttttagagtgcttaccagaggccaggtaccatattagagattaggttaccttacttcaaccttgaatcaactctgtggggtgattgtctctttcattagatatggggatcaatacttactagataaatgagaataacctgattaaagtcagagataggaggaggtaaagcccagaatttgaacttaggtctgtcttgctctagagtccatgcacttcccactgtaggaattatattcattaaaaaaaggagtaaactgaatttagaatattagaaatctttacctgactctttatttaataagttcaggagacagagtatgaaattttaaaagtccactgacttcactttcctgcagaaatgacatttactggtctgctctccctgcccccccaaaaatcttacatctttccttatgaggacatcattatagcctgctctagtttagctcaagcaaggctatgcatcaagaagtggaaggttttatgtggctttctcaactttacagggtagaagaaaggactttggagcctcgtggaaataagttctatctgtatacttgcttctgactctcaagtggagagaataccttgtttaagagttagcataaaatatataatagttatcgtaaatcacttgaattatagttgtggctcaataaattttagatccctttctcttttacagtaagacattccagtgactcactatctcattgaaaagggctcatctgaagatacttactaagcatgtagtgtgtctggctgttttagatgcttgaataacactaaaaaaaattaagctctatggccccctgctcttgatgaccttggatcctggatatggagaaagaattaaaaagtagaaatgatttagaaacatataaaatgctttcaaatatgacacttgtagtaaataaaacacaattcagagaaagtagagactggtacatgcgagggtccagggaagattttccaggggggaagggattgaactggtcttggggcagaattgatactacaccaccaggtagaaagaggagcttaacgcatcaatgtctcctatgacctttttcttcccctttttattttcttgtttctgtagcaagaacataaagatcattttccttttccttcccactcccctttcataatgcgagtgcacttgtttttacttgaatatagaaacagaggcatttatcttcttgtcagctgtccaaaaggaatttagacagtttcacttatgtgtcacaattgccatttaatccatcaattaatttttaaaaattttatcttgcagttttgcaattgtacttattttaaagaaagatggaaataaagctatttaaagtaataccatgcatgcttaatatagaaaatttagaaagcataggaaagtttatagaaaaaatatttagaagaggtccaccatacaaagacaattataatttatattttggagtatttccatgtgtgtgtgtgttgtttattttgcataacagtgacacacattatatacatttctgtactctctgtttacaaattgttatcatgtacgcataaaattccatgaatatgctgcggtttatccacttccctaatattgtgcatttaaattatgtatactttccactgttaaaattaaaatcctgttgaaaatgttaaatgttttcatttttttaatgcactctgaggtgtggaatacatagaattaattttttgtaaaatcaattatttcttttagaagtatttgagtagctactgtcttccagctaccatgctaaaggtggcttttgtatagctaacaatctactaggaaaacaaagaaaagtagaatgtgatcagtgccttaagaggagaaaaagaaatgcactgaagacattcaaaaaagaggtcagttatgactagaataataggaatggtttcctggagagaagcagaatttgatctaaggcttgaatgatggggttgtaaattccacagcatgatcacaggtgcagatgtgggaaagaaaagtataatgaaagatcagtgagcaaacctatttgaagagaacttaggagccatgtaaggaaatttcagaccagaggcctagaaaggtaaattttaggcagagagtcatgaatgtcaaattaagaagtccaaacacctttctaatagacaggagttctgggattttttgcagaggattacatggtattacagatttttccttataaatgggtgcaattgacagtgaagagttctaggattttttttttttttttgcagaggattacgtagcattacagattgtccctcataaatggatgcttatatgcaaagatgttgaatagtgttagcaatggaatgtgaattaaagtaatgtggcattttcacctattagattaataagtattttaaaagattaataataattagtactgacgaagatatagaaaagtaactattatcattgatgtaaattgtgcataattatgagactataacttggtatagacttcctgggaaataatatgacagaatacttcagtatttaatatgtgcatacccttgtatttggcaattcttctaaaaatgcatgctaaggtaacaattgagaaatactcaagaatgatcatacataacaatctgtagtagtatattgcctagtactgttacattggcatcaaaggaaatgcccattaattggaatattttaaataatttatggcattaaccttgaacaaaatgcttataattatggttttccaaaatgatgaattatatttttatgtactagccttgaataatatttatcatatgttaaaaaacaaaccaaaacaaataccaaacagtaacttctatctcatttatgtgaaaacaaatatttatattattaatttaggtaaaaactatcaagaagaatatataccaaatagttaaaaataattatcacttgggagtagaaattttttaaaagttcccttttactttaaatctatcgacctttcttaaaggaacatattatttgttaaaatatattttgaaaaactatttagaagagattatcacaaacattattttggctacagctttgagtgtaaaccatcatgactacaaagacaaagatgaaaatcagtgtcctctgagagaccttttaatatcatctggtgttgaccttgtcatttcccgtcacatcctattttcagtccattgtagcacttagcaatacattttactttctggtttattttttaaattatcttcctgagattaaggaccttgcttattttgttccatgccatctctagcacttagaacactgcctgaatgacagtagcctcacataaatcaggaagatgaaatgaatgccagtaggatacctattgcagtagttgcctttaacataaagtttaaataccttaatttgacttataaagccctacataatttaatttctgctaacatctctagcttcattatcttatcattactttccctaccctactccccactgccccaggatttgtacacgctgaactttcttcaattatcttaatatattcttctctctcatctcctgagttttgtacatgttattcttacttctggaaaattaactgagctcttctttttcttattcctgttgattcctctggtatcagaatatcttaagcagtgttactgctcaaggtcacagactcaggagttaaatgttaaattagttatgcaatcttagtcaagttatttttgcttagatacactatccttatttgtaaagtaggactaatagtacctatcttataacaatttaaggataaattagtagcagcttattacatattaggatgatgatgatgatgatcccttgtgtagtcattgtggtggtagtgatatcatttctttaagaaaatttccttattccagcatgtgataggtgccatttttccatgtcaaaaactaatcattgtgtattattgaatatttgtttgtttttagatcctactagaatataagctccatgggagcagaggctgaagccactgagttcatcagagtacccacaatacctagcacagtgtctggcagatagtaggtgttcaataaatgtttataaaatgactgaattggataatcttgtcataaaccaatacatgagataagatatattgtgagaactaagaagatagatcttggtaacaaagaagaatgagaaagagtgagagtcaaagatgactcaggttcagagattgagaactaggaaaatgaagccattaagaggatgagtgactagttttgaacctattgttgacccctaagaattgtcttttatcttttttcttccacagttatcctaaatggctcttagattgattgcatcctttcacatctaaaactttatgttagaggtgatgcagatgcatacctgcttctacagatgagcaaattgagatctagaggtaaatggcttgctctaggtcatattcaagtagaggaaaagtcacatttcaatagaaaaatgtaattttatttgaattattcattttttcatttagaaatatatatggaatgtctgctatgttcagaccatcatgatccgggtgcatagagatataaataacctggccacagccctttaatagctcaatatttattggtagagacagttacataaacgagttcaggacagactaataagccttctaaagcatttataatgtcctctaggagaaccatgaacagagcaattaattctcagtagaagactaaaagaagatgctcgattgatgttacatttgacctaggcttttatgctagctattcatttttcagtattttattctattctatttccttcaaagataagctggactttgattctaaattagaattttctaatttcaccaatgcaatcagagaagaacattatctaattcatgtctatcatttagtttgagttttagtttcttttaaattgttttacactttttctttttttcatttaatttaactcagcaacagtaattctctgttgtgaagaaacactgaatgaattaatgtttgaggtgacaattgtcagcagacttttaagatcttctgcagagctgataacatattgaggaagctgactttttgcaaaatcaaaagtagactccaaatgagaatattccagagccccaaggtgatcactctatttctcccactgcatccttaaagggacataaaagcaaaatcaaattacacttgctttttggtgataataggaaaataggttgttttaatatatgtagatgggatcactggtatatggtttacagagctaaatttagattgaaaatagaatcatagtgtttatgaattgaaaggaaagcttaatggaaatctactcaagcttttgtctctttcttatttagaaactgatagaaagattgagtgaattgtttaatatcacaaagttttcattatttaatataattactttatgtctttctgttacttaatacctttatgaaattgggcaagtcagttaaattccctattttttttttcaccagtagaatggagaaatggagaaaataataggtatttcttagagttgtttagagaataaactgagacactgcatgcaaagtattgattttattgcagctattttactgtgtcctaccctacttctccatctctaggaaaatattaagatttgatcacaatataagcagctagccacctctatttctcccactactgtattcccagtgtccagcacagagcctgacatctaataagcagtcaatatttcttcattgaatgaatgtctgaatctgagtttcctgatgcttttatattatctgatggacctctgaaaatatttgaattctagacctctggaatttatgctactcttttaacaaaagggtaaactgagaccccaaatgttaaataattggcttgtgatcacaaagatgaaccctcaagtgtattcatttggggctcaggttttctaaccacgaattcagtctattttctaccacagacctttagcaatattaataaataatatgttctcccaatattctatctatagtcatgattattcaagaaaatttgtaaactacaattgtgtaaaaactgaaatatattttttaaatttacttacataaacattgtcaaaatgtaggcatattttctttggatctttcatttaacatcatcacgtgtaattattttgtcactatatattctttaaaaacattttagtaggtgattaagattcaattctaccgagataccaaatcctgtcattttgtattgttggatatttaggtaatttccagtttctcactgtcataagtcatgctctcttcaacatatttatgcaaaattgcctgtcttgtcttttgattacttagaataaattactggagatgaaatgattgttggattaaagctcttagatgatacatggaagcactgcatttctttccagaaaatgtactaatttttctcacaattgtagtttccacgggtatttttcctaatgcttcttaattacatgttgatgcctatctttattattggaaaaaatgtgtcaataatgaagagcaatattctctgtatgtgcatgagtgcgtgtgtgtgtgtgtgtttcaaaacaattctttcagtggcaaatgtatcactacagcttccagaataacctgtcaacaccaaatataatttctccttattcttgcttgataatatatgcgggttacctgtgtacaatcttctacataaaaataacagagtagagatagcttcagcatagctagatcactacctttatacatataatccaaacacaatgaagtgagcaaagttcatattttaattagtcaaatataattattctctactgtaagcttttatttttaccttgtgttaagccatttatcctttgagcatttgaacttctatagcaattatctaaacattccttggacacctaccatgtaccagttttgagggataagttgtaaaaggcaattatttccttctttttctcattttttaattaatagtgataattcatagtttcatttcgcagatttctttggtatacaaagtttactgttgttatccaagaaatacccaaaaatgctatcctataagaggaataaagttctggttttgttaagcagtgaggtcttgacactaaatactgcagttatatttatacatgataaattccctttttaaattcctgaagaatgaatttgaaaaaataaacaaggtatgttaaaagagcattatatttgaaggcagatagattctagtcatatcctcataaccagcttgtgttacagaacaagttacttagcctcaataatcctggatttaataatctgtcgaatatttctgctgtccccacagtattgtggagagaataggggaagggtggaatctgtcatgtaagtgattaaaaaactaccaatacaagttaataataataaatgtttagggtttaggttgaaatttattttcttcattgatggtatgatggctagggactcagaaatgccctatttttgccctgacattcatactcctccctgtgtccggcctgccgcctgcctgcctgcttgcttgcttgcttttctgtctttctttctctttctttctttctttctttctttctttctttctttctttctttctttctttctttctttctttccttctttctttctttccttctttctttctttctctttctttccttccttccttccttcttactttttttttttcaaggtgtcactctgtggcccaggctggaatgcagtggctccatcaggattcactgcagcctcagcctcgcagggctcaggtgatcttcctacctcagccatcaggattcactgcagcctcagcctcgcagggctcaggtgatcttcctacctcagcctcccaagtagctgggactacaagtgtgcaccactatacctggctaatttttgtaccatttgtagagatggggttttgccatgttaccctggctgatcttgaactcctgggctcaagcgatctgcctgcctctgcctcctaaagtgttgggattacagatgtgagccccactgctggcttcccttggaatttctaattacggaatgtatacataaggcatagaagctaaattggcctcagagtaccactttatacctgaatactaaatgctcccaaaacacagctctggtaaaagctgagaaatccatatggcttaagcctgtaggtgtaaaataggcatcctatttccttcttcatgaactaagatgtatgaatacaccattcaaatttagacacaaagcatttaaaatagaaagagtaagtcctagatgagtctacccagaggggcagtttctgctcagctcttcacaaaaacaaggcactaaagcaagaaagaagagaatgacccaacatgcctggagaaagctgattctgcctagatgggtctgtactgtgaaagcagaagtagaagagggagcaccgcttatggatgctgacatatgacacagttttcatagtccctcgtaaaacaaggctcagttaatgtcctgagatctgatttatcatattattattattatcatttgagatggagtcttgctttgtcaccccagctgctgtgcaatggcatgatcttggctcactgcaacctctgcctcccgggctcgaatgattctcctgcctcagcctcctgagtagctggaattacaggcatgcaccatcatgcccggctaaattttgtatttttagtagagatggggtttcaccatgttgtccaggctggtctcgaactcctgacctcaggtgatctacccacctttgcctcccaaagtgctgcaattacaggcatgtgacactgtgcctggccaagatttgttttatttttagaggcagggtctcactctgccacccaggctgaagtgcagtgatgtgatcgtggcttaatgcagcctccagggcctccaaagcccaagcaatccttccccttcagcctcccaggtagttgggaccacatgtatgtgacaccatgcccggctaaatttttttttttttaatgtttttcttttttcatagatgggtctccctgtgttttccaggctggtatcaaacttactgggctcaagcaatccttctgccctggcctcctagagtgctgggattacaggcatgagtcactgtgcctggcctgttatatgattttaacaaacatagtaactaaaatattatcagaggaggtggaattcctttcatacactgatattttcaatatagtttagataagcgtggtacctgggaagaaattctcagaatttagtgatgaataggattagataaaatgtaaaatagctgagttggattagggaaataagcatcataacaccagtgtttcaaccttagctgcaaagtggagccaccttgggtactttagaaaatagtggtttcttaatccaaccctcaaagaatctgatttaactgatccatattgcagcttgggcatcaagggttgcccaaatttataatttgtagggacagaggagcactgaatttggaattaaggaacctgtaatctacacctagatcctgcaagtactagttggtggtttctgagcaaagggcttagtccttctgtgctgcagtaaaatgagagtggatgaaataatctctcttggggcagtgaggcccagtgcaaaacacatcctgtgaatttaggtacagtactccccaaaccttatcttagcttgttactctgcaactttggatatcttaataaagccttctgagctttggtctcattatttgtgaaaatgcacagtaatagttaccttattggagttttaataatatgaaaagaaaaacatagattgattaagcactattctcatggtatcatttaatttgttctcttttcacctgtccttgttcctgtaatttgctaattaggagtacaggcctgattacattaaatggattttgttgttgttatggtttcaaatggcaagaatacttcatagatggtgctccatacttcctactgaaggcaaatgatgccttcttgtcctacttttactgatgctgtaattgatcaatggattcagatgatatcagtgcaatccacccattataaagttcaaagcaagcttttggagatagatttttctttatttacatctagtaactctaactgctgctttaatggttcatggttgccactgccatatcatcttagcctttctcttgaaaagcatccatgccttacaaataatatgaaaaccagagactggaagaatatatgtatgctttcatcttcctctactcattatcatttcacccatcattgacatcattgttctcatgttaaaaagacattttgacataatttttggattctagcatttgtagaaacagagtgcttttgagaacagtatcaactttttggaaaaaaaatagtctgtctaataataatagtggtcataaggaggagaaatacaagtacttcctctatcattatccctccttgtaattaatgcttactttgctgtcttcgcagttagactctaaagctccataagcgtaagagattcattcatttttttttcttttttctttttttgagacagagtctcgatctgtcatccaggctggagtgcagtggcgcaatctcggcttactgcaacctctgcctcctaggttcaagcaattctcctgcctcagcctcccaagtagctaggattacaggcatgagaaaccacacctgactaattttgtatttttagtagagatggggtttccccattttggccaggctagtcttgaactcctgacctcaggtgatccgcccgccttagcttcccaaattgctgggattacaggtgtgagtcactgagtctggccacagtagattcattctgtcattatcattgctgaatcccctatgcctagcatagtgcctgatgcataacatagtaagtcttttagaaatagtattttgatataaggatttggaaagtgatatatttcgtacaattaagttaacagttcaacctcagtttcgttttcattgataatatgtaattccaaaatcaaaagtaatttagaggtcatctagttcacccatatgcttcctgtggcaaacgcatgatggtctcttagcttctgccagagtaccacccacaaatgactacatacaccctctcaaatgctgcatagtccatctagagatagtgctaattgttagaaatgccttcattaccttgagctggtatttgccactgaaattccattcttcctctagaaatttcaacagagtaggctgggtgcaatagctcaagcctataatcccagcactttgggagaccgaggtgagcagatcacctgaggtcagaagttcgagaggagcctggccaacgtgtcgaaaccccgtctctactactaaaaaaaaaaaaaaaaaaaagaaaattatctgggcatggtgacacacacctgtaatcccaactacttaggaggctgaggcaggagaattgcttgtacctgggaggcagaggttgcagtgagccaagattgcaccactgcactccaacctgggtgataagagcaaagctccgtcaagagaaagagagagagagagagagagagagagagacagagaaaagaaggaaagaaatttcaacagagtaagtctgataattctttcagctgatgagagaagtttgtaagttgcctaataaatgttttcttttttccttaaaattagctaatgctaggtgttaatgtggaaaaaatattttttctcctatgtgatttaagtcagattcttcagagtggctcctattttttccacattaatattcctttagctcttacctttaagatgcaatatttttattaggttggttttgttggtttctctatgctgtagagttcaagtcttctaaaactccaattatttctttaaagtaaaaaataatcagagcatcaaatgcttatacctcctgctttaaaaccagttttcaatctgtgactttaaaaccaagaaagcatctgcagtatttggatgattttgtgatatttcttcttttatgctttatttatggttaaaggaatcatagtaagcttttttcagccaatcttaaataaagcttgaaacaacttccggaagaaatgaaacagtaataacctatgaaagcttcactaccttgagagcaagattgtgttttctccgcaaaatctgtctgtgcagagccaggaagttcctggtgtctgtagactctcccactggatctcatacaaggttcagttgcttgaatgcttatttcaatatgcaacaaataagcttttttttttttttagaaaaaggaaatttacctttttatgaggtagctctgacaatgactaagtctttcattaaggtactattgccaggccaggtgcagtggctcatgcctgtaatctcagcactttgggaggcagaggtgggtggatcacttgagcccaagagtttgagacaatcctgggcaacatagcaaaaccctatctctccaaatctcaaaataatacaaaaattagcccagcatggtggcacgcacctttagtcccagttagtctggaggcaaaggtaggaggatcgcttgagcctgggaggtggaggttacaatgaacagagatcacaccactgtgcttcagaaatagaactttttctaccataactatatattcaagataggtatgagacccccaaaataaatataaaatgagtatcttctcaaatctccattttacaaagtgctgctgtaattttttcaacgacctacattttgtgatctactttttgcatgaaaggtcatctacatgatcccaaataactttcatagcagcagttgatataaatgctgagtttatattttggaaaggtgcccaaatcctgaggtaggaggtttgctttaaaccagtaatgatcacatgatgtttcaggctctgttactaaataatactttatacccagttgtatccatggaaacctgcaacagttccataattgcagtaggctctaaactagtccctctgtggcaggtctccagtttatcactcacactgctgtcaaagtgatttttctgtaagacaaatatagcatgtcttttcctattttatacctcataaatcccaaactgtttgttttgcatgccatttaaagtttttgtatatgtgtggcctagtctaattttccagcctcatgttctaccagtcccatccgtatttcagtcacaattttttggactgctactttgttctttcattgttgttttctcatgctttcttctgtctttcatattcttctttttcttcctagtgaattatccactcacttttgaaaaaccaatttaagtttcattttttgggtgaggcttttgttggcattccaaatggaatagtcacctctattgtctagacgagacacatagaagatgctcaataaatgttgaggcatgaatgaatgttacattagaatgccagtccatgttcccttgtcttctggactctgtgaggtcatcaatggagaagagaggcttgagaaaagaaaatccacccacagtttaactgtgcatttcttaccagggctaaagaaatcagatcattgcttgttacagcatcttcaattcctccctcccctatgtttcattcttttcattctacaaatgtgaccaattatttcctattctaaggatataaagtcttctctcaaccattctttccttcctctaagatacatcattatttgcactgccattctcatgtaatttcttgaaattaaaaaaaatgtattggcatttcttgggaaaattaataggtgttagatgggaaaagtagtgttctgaagacaaataaatttagaaaatattcaattaggtaatgttaaacaggtttctttgttgaataattgctcagtcttcaatatgctaatgctatcaaagatggggcatgtttcctaacataattggctatagagagaatctcttttttctttttctttttttaaattataatactttaagttctgggatacatgtgcagaacctgcacgtttattacatagatatactcgtgccatggtggtttgctgcagccatcaacccgtcgtctacattaggtatttctgctaatgctatcacttccctagcctcccaacccctgacaggccctgatgtgtgatgttcccctccctgtgtccatgtgttctcattgttcagctcccacttatgaatgagaacatgtggtgtttggttttctagtcctgtgttagtttgctgagaatgatggtttccagtttcatccatgtccctgcacacaaaggacataaactcatccttttttatggctgcatagtattccatggtgtatatgtgcacattttctttttctagtctatcattgatgggcatttgggttggtcccaagtctttgctgttgtgaacagtgctgcaatatacatacgtgtgcctgtgtcttcatagtagaatgatttataatcctttgggtatatatccagtaatgggattggcggtcaaatggtatttctggttctagatccttgaagaatcaccactctatcttccacaatgtttgaactaatttacactgccaccaacagtgtaaaagtgtccctatttctccacatcctctccagcatctgttgtttcctgacttttttttttttttggagatggagtctcgctctgttgcccaggctggagtgcagtggcacgatcttggctcactgcaacctccatctcctgggttcaagtgattctcctgcctcaccctcccgaggagctgggactacaggtgcccaccaccatgcccaactttttttttttttttttttttttttttttttttttttttagtagagacagggtttcaccgtgttagccagaatggtcttgctctcctgaccttgtgatccactcgccttggcctcccaaagtgctgggattacaggcctgtaatcctgttactggcctgtttcctgactttttaatgatcactattctaactggcatgagatggtatctcattggggttttgatttgcctttctctcatgaccagtgatgatgagctttttttcatgtttgtcggccacataaatgtcttctttcaagaagtgtctgttcatatactttgcccactttctgatggggttatttctttttttcttgtaaatttgtttaagttccttgtagattctggatattagccctttgtcagatggatagattgcaaaaaatttctcccattctgtagtttgcctgttcactctgatgatagtttcttttgctgtgtagaagctctttggtttaattagatcccatttgtcaatttcggtttttgttgccattgcttttggtgttttagtcatgaagtctttgcccatgcctgtgtcctaaatggtattacctagactctcaagagactagcatactactggtctaacacttgtttctttttgctttctcattgctcatactttaattcagtgagttctggcttattgcccacatcatatactttcaacaatactcacaaatgtccccataagtaattgaacccttaaattaatggatctcagtcttgattacacttagcaaccaaccggtgagctctaaaattcctgccgacttggctgggtgccgtggttcactcctgtaatctcagcactttgggaggcagaggtaggggcagattgtttgagctcaggagttcaagaccagcctgggcaacatggcaagaacccatctctacaaaaaatacaaaaatcagcctggcgtgatggctcatgcctatggtcccagctactcaggaggctgaggtgagaggatggcttaaacccaggaagcagaggttgcaattagccaagatcatgccactgcactctagcctgggtgacagagcaagactgtctccaaaaaaataaattttaaaaataataaaatccctgctccttgggtcctacccccacagagattctgatttgattgcggatgcaaactgggtatcaggagttgtaaatgcttcccaggtaattctaagtgtagcaaagttgggaatcatcacccagtacctcaagctgttagttctttcttttttattattatttttatttttttaatttttttgagatggagtcttgctctgttgcctaggctggagtgcagtggcatgatcttaactcactgcaacctccacctcccgggttcaagtgattatccttcctcaacctccccagtagctgagattacaggcatttgccatcagcaaatttttgtatttttagtagaaacagggttttctcatgttgaccaggttggtctcaaactcctgaccccaagtgatcctctcacctctgcctcccaaagtcctgggattacaggcatgagccactgcacctgactgttagttctttctttcttctaagtgctgagggaaacaaacaaacaaacaaacaaaacaaaaaaaaaaaaacaaggcatggtcttttgtattttccctgatcaatattatgtagtggagaaagacgcgcacacacacacacacacacacacacacacacacagagagacacatatatagcagtgtttataacaaaactttagggtgggggcaggagtatgaacatgacaacagcatggagtatgacagtatggtcgttaaggtaattgcagcaatacatcagagctactaataggagggagcagaggatgaaagataacattggagcaggaccttcatactagaaacttttgtgtggcactaagtaaggtggactctattgtgagagaaataaggaagtatagcagtctttgaatcagagagctgcataatccagtttgcatttttgatttgtcccatcattttcttcccaatttgcacctcttaggaacaggcccagatctcatagatgtgccccatcacccatcgtaggctttaaatttctgttattatttggttaatcagtatatcaatatcctccttcaaaagtttgcgtgctctatgagaggtgaacttctgcattattcacagctatatagtccagagcatctgttgggtagggagagatgcagcatctattgagtaaatgcaacagcaatatgaaggtaaggaacaccttcatatgttagactatagcactttaccattgacttaaatcatagtgtttggaattagatctttattttctattttcccctacgagccattatctctcacccctagaagatagaaagtaaatatttacaagatgtaatttacagttttgttactctagatactgtcagattaattaacaattgtgtgtttattgagtgcctgcctattacaaagcatgaaggcgctgtcaggaattttaaaagctaaagttatgtctcctaatctcagagcttatttacttgggagaaaaaacgtgccaagcatagccaacagtttaagaacactaagaaagaaatgtgctaaatatcctaagactttggagaagaatgggatctcttggggcttgctgagcagcaataattgtggcaagttttctgccattaccacatttaaatggtaattcaggagctgatcccatttggacactgttcattacacactaattactatttgccctacagtgattgttatgtgtgacagcaagtgtaaatgcaaacctagatgcttactattgcccttccaacagggtaggacattgattatacaagttgacatgtcatgttatttcccgttttctcagataatatttaaagatgaacatttccaaagtgcatatccatgcttagtagaactttgactctatacaaatattaaacataggtggtacactccagttagaaaagactgcagtatttgccttgcacatgtgtatggaagtatgaggaaacacttcaagggaaatgtattgtaagaaatgagttttaaaataaattccgtcttggtagtttatttccatgtatatttggtgatttgggacaattgtctcataaacattgagttctttcagtatgaaaaatcttgtgccatagccggaggtgacagagatgattaagacatgacccctgtcctcaaaacttctggcaaacagagggacaggtaaatatataattatagaacatattgatgcatgttataatagaagaatgtgtaattgataagactcaagacaaaagattaggtttgcattaagtataacattttttaaaatttcttttttttaatgtttaaccctcaatattctctaggagaattctagacttctagttataagggatttgttctcctcctcccacccctagtactgtgaaaagttgtgagcatttttcacattaatgacttttcacaggattgagcttctagagtgactgactgatcaataccttacactgattttcatggagacagaagtgcattgcttaaaactctatggtctcatgccttcttgcttttctgatacacttagggtgtagaaatcattagcaaagctgagaatcccattctctaggtgttgacttctccacaggcaactctcaaatatttctccagatttgctatctctccagactcacagacatttattttcatctcaagctcctgcagcctcccctactcactttccagcatctcaaagacattctctctttcttctttaccttcaacccttcagccacaacctctccactccctctccaaagtcaggatacctagaatagtactttgaaagtgttaccagaccccaccacttacctggagttagtctttgggtcaggggtttcctcactattgtcccttctgtggtcaccagaaagatgttaccagaaaggggtcccaatccagaccccaagagagggttctttgatctcaggcaagaaagaattcagggcgagtccatagagtaaagtaaaagcaagtttattaagaaagtagaggaataaaagaatggctgcttcatagacaaagcagccccaaaggctgctgcttgcccatattttgtttttttttttttttcacatatgctagaaaaagtttaccatcttggttttgatgggttttggccggcttctttattgcaacctgtcttatcagcaaggtctttatgacctgtatcttgtgccaacctcctatcttatcctgtgacttagaatgctttaacttactgggaatgcagcgcagcaggtcttagcctcattttagccagcctgtattcaaaatggagctgctctggttcaaatgcctctgacaaaagggcttcagagtccgtaaacttaggttgagtgtgtcctgagccttgtcagaatccagagacaagggataaatcatagctatctgtttggaattggggagtaagaaaaaatttagtaatgcaaacccaaattctaattatcttgccaccatcatagaaacactaagaatacaaaagaatgatgattcattgtgcaaatgaggtgtttgggggtggggctgaaaagaagatgatgtgtgagtagtttttggaagattagtaggagttgctagagggttattctaaacctgggagacagcatggattgcggagtcaaactgcatcttcttattctctgtatctccagtgtttggcacatagtaggagctcagcaaatgttagttgaatggagaggcagaatagtgaggcatatttagggaatgtcaataaatttggtgagcctagaacagtgtgtgtggcaggaatgaagaggaatgatgctggggccatggcattcacaaagcacacagctatgtaggtcatcctaaaatgtttgggcttgttaagcagaggagtgatgctatcgtaataggaagtgcactgaaaagaggagtgattgaaagccaaatccagttatgatcaccatggttcaggtgagctgtaaggaggcatgaagtagtggggctcctgagaaaaataataccaatttctttacaaaaatgcaattgattatttttttaaaaccagtaagaatagagctaaatagcatggactgcataatataatgagcaaggttttcatggagttctttagattcataggagtgaaagctaaattctaggagtattttgccgatcactgcaggagtgaatctgaccaaggaataaacctgcccactaagtgatgttaggagcttggagcaagtctgccatcagatgcactggggacttttaaatgccagaaccgcctttttaaaaaccagaaaaacacatctaaatattgtcaagaataaatatattatttcatttgtgaaaataaacgttcatgagaaaaaaattaaagtcatgacagaaaaacatttatatagtaggctacatacatcatgaagcttgatttactgttttaatagtaaaaaatgataataaataaattttggctcaggggtcatgggaatgtgtaacagagatgtcagatataatgatggaatgagagcagtcttgggtaccttcttttcatcagaagttctcccacaaaatacctatgagggagagaaatgaacataatcagtggcaaaaagactcagatcctttctcagttaaagccagacacataagccaaagaaaataaatttgggattttctggctctgtaactcaagttccttctgctactttctaatcacaatagctgaaagggatttttcctctcaaattgcacagacaaaaagttgtcacctggatatgtacttctcacactctcccataaaaccagtgacctgaactagactagggagcagtgaacaataagatattaggaggttaaagttccctttaagaaaatgattcaagtgtctgcaaaaaagtgattgagttttctgactttactgatgagctttgaaaacccatcaaggtgggaaacccaatataagattactgtattatcacagaagtaatcagatttcaagtctttgtacttttttggaggatggggatggcaaagcattggttaagatagtaataaactttacattttattaagatatgaatgtatgacaaaatttaagaagtaaccattaaaagattagaaatagtgtataaatgtcaaattagtagaggaataaaatgtaatatataaaaaattctaatcaatcaaaaaagtcaataacaaatataaagcaaaagtgtatgacaaaaacaaaaaataatatagaaaaatagtttcaaatataacaatattcatacaaatataaatagattaaacttgccagttaaaagacaaaaattgacatttaaatgatttttaaagtccacctaatatgccatttgatgagacagaagcctacacttgatcttagccaacaggctgagaaatgatgatacatgagcctaaaatataaagactcaaaaatttgaaagttaacaaatggaacaaatatgtactaggcaaatgctaaataaaataaagttgaggtactttataaatgtcaggcaaaatcaacttcaagacaaaatagactattagagttaaagaagatcatgatataatcataacatgcttatttcataaatatacattgtaaatttatgcatatttaataaaatatccttagtgtatataaacagaaacagaacacatagagaaagtaataaatccaccatcacaatgaacaattaattacaaaccctttttttttttttttgagtcagaatctcactctgtcaccccggctgcagtgcagtggcacgatcttggctcactgcaacctccacctcccaggttcaagcgattctcctgcctcagccacccaagtagctgggattacaggcatgcaccatcatgcccggctagtttttgtatttttagtagagacagggtttcaccatgttgcccggctggtctcaaactcttggcctcaagtgattcacccacctcagcctcccaaagtgttaggattacaggtgtaagcccacagcgttaacgctataagatacgttttaatgtcaagagttaaaaaattactaaagttacagaagatttaaacaaggcactgctatttctagtagtatggaggaccatctccatgtaaaatacaaataaaacaacagcaacaaaataagttacataggagttaatcaaactaaatatatgcaaaaaaggatgtataaacatttattgaaatttaccaaagaagacttaaatacaatggcctgctatggtcatggatataaatattcagtataataaagatattccttccaaattgatctgtagattcaatgcaattcctgcaaaaatcttaacaggactttttgaggagctggacaacctgatggaaatgtacatgaggagagcaaagggtaaggaatacctatgataatcccaagaagaagagtcaggtgagggtacatggcctaacagacatcagttatactaaaacaattctgatgacagtgtggtttcaggattagataagcatatcggctaaacaaacaaaaggaccttgaaacagaaggtaagttcaccagttctagagccaatttactaacctattcatgcctcaatttccttattattaaaaaagtaatcctaatagtacctacctcatatatgaggacttaatgagttaattaaatagtgctgggacaattatatataatacgaaaaattaaattaattcctatctcacatacataaaaatgaacaaacttttgattaaatacataaaaaaggcaaaatattaaacattttagaaaaaatatagcataatattattatgactttgtcattaggaagcgtatcttaaaaaaatcatgaaccaataattgaaagatgttgaactcaactacattaaaggaatgctggggccgggcgcggtggctcacgcctgtaatcccagcactttgggaggccgaggcgggcggatcacgaggtcaggagatcgagaccatcccgactaaaacggtgaaaccccgtctctactaaaaatacaaaaaattagccgggtgtagtggcgggcgcctgtagtcccagctacttgggaggctgaggcaggagaatggcgtgaacccgggaggcagagcttgcagtgagcccagatcccgccactgcactccagcctgggcgacagagcgagactccgtctcaaaaaaaaaaaaaaaaaaaaaaaaaaaaaaaaggaatgctgggccaggtacagcagctcaggcttataatcccagcactttgggaggctgaggcaggaagattgcttgaggccaggagtttgagactaacctggacaacatagcaacatagcaggaacccatctctataaaataataataatattaaaaaaaaatagccaggcatggtgacacccacctgtagtcccagttacttgggagcctgaggctggaggatcacttgatccaagatatctgagattatattgagctatgaatatatgaagaactcttgcaggtcaataaaaataaaaataaatataaataatacaacagaaaaatgttcaatagacatcatcaaaacatttcaaaagaaaaggtaaacaaatagtgaatacttatatagtataacaaaatgccagacctcacgtataagaaaggaatccaaattaagcccgataccattttatactcaattatataggtataaaattaggaagcctgatactgtgaaatgttattgaggttgtttcttctatactactggtgggtataaccattttagaaaacaaactgacattattttataaagctgaacattatgacttagcaattttactcttagatatatataccatagagaaattattgtaaatgtccattgcccatagtagctttgtttctaaaaggaaaaagtaaaacatgatgtgagcacaatacaaatttatatcaacaggagaataaaaatataatttatggaatattcacataatagaataatatatagcattaaaaataaacatgaatgaatctttgaaacataaaatcaaatggaatcatgatgttgagcaagtcaaggaaaatgatatatggtatgataacacttttatgaaggtcaaaaagaagcacatttaaacaatatattaatattttggggtagatttgtatatatacactaaaaccatacaatgaaaaaaggagtgctaaaaaatttaggagagttgttaaatcataagagatacagagatacaagaatgaagcagaacccatacaagaatatttatcattcaggttttaaagttgatgttaatttcattactgtgcttcaagactttcccttacattacatgtattcttttgcatacatcaaacatatagtcaaaaaacataacattagggtttgttaagatagcaagtttttctttcaggcttaacccttaaaacaaaaatggaccttgtaagaattcctctcttcatttcactggagttacctgaaagtggacttgagttttactttaaagagatgacagacatgaaatgcagctctttcaaacaaagcagttgttcatagtgacatatcttctgcatctgtgacagcagatgcttttaaaagcaacagggagagggagcagtggtgggtggaattagaagaaaatgcttatattcatatgctgccatgtgaattagatcggccatgctactttcagatacacttaagaacaatcttatcttagctggaattgaaagatctgggaccactgaactgtcattgataggatctgccaccattgtgagtatttcaatgatgaaatgaagcataaaaatgacaaaatcatcaggttagaatagacctcaaaaggaagcttgaagttcttattactttcttttattgggtcagcataagcaaaaccatgaaattgacatttcttactcttgacagcatctgatattaggaagctcctttaggaaagattaaatagaatcaggaagacacctgacccttagctgaactacttactgcaacacctgtactaacctgcaaggataagattgtgtccagtctaaatcccactttctgccattctcattcaagactctttttgttcatcttgaccttatttgaacaggacatctagtctcataatttatgaaatagtcttttctatagtaggaagattgtaaagtcactcctcagttttttgctgctgtgattcattgatagacatatagatagagctatagatgttaatatatacaaatatacacaattttatgtctataactgtcccataatttattgtcaacatgtaattatggttatacttccttaattatagtattattattattattttggaaaacattgactcttttaacttaaaatacatgtatatatgtattttatatatatgtatgtatgtttattatatatgtatttatatgtatatatacgcatatacataatatatatgtattttaacttaatatatatgtattttaacttaaaagagttttccctaaatatatatatagtcctaatgctgtagtagttaggactttttagtagtaaaatacatatatattttaagttaaaatatatatatatattcgccaccttcaagatttgtataattttgatccctgcaattcaagtccctgataaacttaatgaatctttctaaagtataatttttattaccttgcctttctactcaagaacttatcctggttttcaagtatttattcattcaaattcagcttgtcagatagaattgaaagctatagttcgtctcacctaactttatcttgctagcctttctttcttatctgacaggcctgagtttaaatcatagtcctgccgctttctagtaggttccagttactttaactgagagctctaatttctttatttgtgaatatgaacactaaatcaatgttgatatttttaaaacagttttcccttttttctttcctttctttttttttttttttttttggtttttgagaccaagtctcactgtgtcgccaggctagagtgcaatgaggcaatctcggctgactgcaacctccgcctcccgggttcaagcgattctcctgcttcagcctcccaagtagctgggagtacaggcacatgccaccatgcccggctaatttttgtatttttagtacagatgggttttcaccatgttggccaggatggtcttgatctcttgatcttgtgatccgcccacctcggcctcccaaagtgctggaattacaggtgttaaattaacttttaaaaataattaatactcagatttttcttgaaattcagcatagattttgcatgagagacattataaagttggaatagtaatgtctatcatatgtttaaaattaaattaaatttgagaaatagcttagcagagttgtcccatagtttgtgcccaacaatttctttaaaatgactcttatcctctttccatgttcctttagggaaaatgaacatctgtatatatagtcgtaatgctggaggaataatcacaagaatgttttatagaggaaataaatatagtatatagtgataagattttcctttactaagaaaggcctggctggaatgaggaaaatgagagacagaaaaaccgactccactagacttccaaagatggaatgtcttttgtgttcatgtcataatttatatcataggtcaataaaggaaaattcctaactgaaaaaagactactgaacttctcataattattgtttgcctatgtggttcttcaattcgtcaaatatttgtaaaaggaaataaaataatgagttccaccataaaaaaagggagagcagctgtttaaccacaaatactggagtcattttgtgtaaagacagaatggctttttcgtgcttctctcaacagaagatctttcattaactggtgttagcacttctgaaaataccctctctactactgaaactctattagttgaacacagtattctgagtattctttacatttagactacctgatggtaaaaggaattttttatactttatcgtgtgtattttccaggcagcaggtaacaactgaatataaaagaagcgtctgaccccttagcaggcaactcctaaagtgaattgaagtgaatgatttatcttgcgtagggtaaggatgaaattgaaaccaaaatactatattcatgccaaaggaactataatgtccaaatagcttgctgttcctttccacgttttagtgtttcaatggggattctttcagtctttcaaaatacgaggagacagagctgaattagagtacagcagctgcttgctgccttttactcgcagctaggaggtgtgttgaattcttataggttgacctcttgaatgggctgctcactgggacccaaatcacacagagcctgtgaactgctttagtgcagtcttgtttaaatgtttccaccagaggaccaaagacagaggagggcaaacacacgtctcaagagttaatgtagtgtgtgtaagaggtaatgtagtttgagactaagactgtaagtacaagtcaaagagttagcaatttgtttggagactggttttatcttaaaaatccatgcaaattttacaggccaggccttagattatttatatttgttttaatatacattttctccatatcttaatcattatttatgatccaggaaaatgtctgaggcttgatgaaacccacagcatattactgcaaacccttggtatattccattaggtaatacacactttaatcgattactgaggattgaaagtgctcatactatttcctcatttaaatcagtagcccagttcctccccctgatttctagaagtctgccaacaagacatattctacaggatctcaaacttcacatgcacaaaacttgctcatcatcttttctctccttcccttatactcactttcatggtgagtggcaccttccaggcactcagctgctccaaccagaagtttgggagttatcccagacatctcattctccatcagcccccacattccaccagccaccaagtactgtcaagtatgcctccatctgttattctctctctgcattaacattgctttaatttagccctttatcattcctgcctaaattattcttataggaatccacttaactggtctgttcttctacctacttcctgcatacttccctagtttatggctgtccaatactttatgatgtactctaaactcctcagcatatcataaccttcattacttaagcaagttaagcatcatatccatatcccacagattcaccttgccaacctccccatattcttaccatattatagcaacatatacttaacatcctcacacgggtcattctttctcatgcttctgggtccttgcacatatattctgttcttgaaatgttctccctctcctcttttcactgcatgattaattactactaatctttcattatagtttagcaatggaactattgaaagtttttctttcctcttcagcaaaaaccacagtagtttttttactgcttctcacaggaaaccataaacttttggcactgtgtattattgagttttaaataaaagtgcaattggctaaggtcttattgaaaaactatatttttacaaaagaaaaatcatgaaccctttttgtactaccaaaggttaggattagttgtgtagaaaagaaagacacacacacacacacacacacacacacacacacgtgaataatgcaaggtgtattagttcatttttcatgctgctgataaagatatacccaaaactttgaacaaaaagaggtttaattggacttatagttccacatggctgaggaggcctcagaatcatggcgggaggcaaaaggcacttcttaaatggcagtggcaagagaaaaatgggaaagaagtaaaagtggaaatcccttataaacccatcagatttcatgagacttattcactatcacaagaataccttgggaaagaccggccaccatgattcaattacctccccctgggtgcctcccacaacatgtgggaattctgggagataaaattcaagttgagatttcggtagggtcacagccaagccatatcattctacccctggcccctcaaaatctcatgtcttcgcattccaaaaccagtcatggcttcccagcagtcccccaaagtcttaatttatttcagtgttaacccaaaagtccacggtccaaagtctcatctgagacaaggcaagtcccttctgcctatgagcctgtaaagtcaaaagcaagctagttagttcctagacacaatggcagtgcaggtattgggtaaatacagccattccaaatgggataaattggccaaaacaaaggggttacagggcccatgcaaatccaaaatccagtggggcagtcaaattttaaaactccaaaatgatctcctttgactccaggtctcacatccaggtcacactaatgcaagagatgggttcccatgctcttgggcagctctgcctctgtggctttgcagggtacaacctccatcctggctgctttcatggctggcattgagtgtctgaggctttttcaggtacacagtgcaagctgtcggtggatctaccattctggggtctggagcacagtggccctctttgcacagctccactaggcagtgccccagtagggactttgtatggggtggggggtctgatcccacatttccctttcataccaccctagcagtggttctctatgagggccccgtccatgcagcaaaattttgcccaggcatccagtcatttccatacatcttctgaaatctaggttgaggttctgaaacttcaattcttgacatctgtgcacccacaggctcaacaccacatggaaatttccaagacttggggctgccaccctctgaagccacagcctgtgtactacattggtccctttcaaccacagctggagtggaagggacacagggcaccaaatccctaggctgcacacagcacagggaccctgggcctggcccccaaaccactttttcctcctgggcctctgggcctgtgatgggagggggtgccatgaaggtctctgacatggccaggagacactttccttgtggtcttggggattaacattagggtcctgcatagttatgcaaatttctgcagccagcttgaatttttcctcaaaaaatggatttttcttttctactgtatcatcaggctgcaaattttctgaacttttatgctccgtttcacatggaatgcttttaacagcacccaaatcaacttttgaatgctttgctgcttaaaatttttttccgtcagataccctaaatcatctctctcaagttcaaagttccacaaatctctagggcaggagcaaaatgctgccagtctctgctaaaacatagcaacagttacctttactccagttccaaacaggttcctcatctccattgggaccacctcagcctggaccttattgtccatatatctatcagcattttgggcaaagccagtcaacaagtctccaggaagttccaaactttcccacattttcctgtcttcttctgagccctccaaactgttccaacctctgcctgttagccagctccaaagtggcttacacatttttgggtatcttttcagcaacatcccacttctgttaccaatttaccatattagttcattttcacacttttgataaagacataccccaaactgggaacaaaaagaggtttaattggacgtaccattccacatggctgggaagtcctcagaatcatggcgggaggcaaaaggcatttcttacatgtcagcagcaagagaaaaatgagaaagaagcaaaagccaaaacccctgataaacccgtcagatttcttgagactttactcactatcacagaatagcatgggaaagactggccccatgattcaattacctccccgagtccctcccacaacacacgggaattctgggagataaaattcaagttaagatttggatggagacacagccaaaccatatcacaaagtatatatgaaaactaataagaaaatatgggccataagtatatcagtgatagtaagcagctataacagtttttaatattgtagggaaatctacaagaattaagatactaaaaatccacatagattctttgtgtcatttgcagaaataaactacctaataaataaattatctaatttagccaaaaattatcaattcaaactttatcctcattacttgcacacctcacccatcccaaagagtttatgccttctctcatttttgtgcacttgctgttgcctctgcctgaattgtcttttggtgttaacaggaccttattaagtgactgcaatatgttgtactctgagcttggtgcttacctagacactttatttcaaaaacttaccctctttctctgtctagaaaatccttcaaggctcagcttgatcatcatctcctcagtgaagcattttctgattcctagaagcataattaatcagcttcacttctgcaggctttcaggacttcctaaacatctgtttctgctaaaaacagattataaatataattcattcattctttatagagaaagattgataaatagatacagataggtagaaaggtagataaacacatattatgtggcaggcattaatgctatattagcaaacaaaatagattatttctgcatgtagggaggcaaacagtaaacgataaccatattgaaaaagtgaattgtattatatggcagaatgatatatgatgttaattaaaggattggaaagcttgcaggaaaagtgctaataagtttaaatagagtgactagagtagacctttttgaaaaagcgacatctcaaacaaagacttaaagaaaggcgagtgagccatatagaaaagagattttcaggaagaggaaacagccaggttcaaagtcttaggcaaggaacatgtcttgctctacctctgagattctagttagattagagtgaagcttgagcactgggatgtagttttttaatttcccagtgattccactctttagctagagttgagaaatactataccagatgtggattgacagaaataatctcaagtctgaagaagcctacagtttgtgagaaagaggcacataaacactgatgagtatatagtatttgataggacaacaaagtgacaatagtcaataataataattatacattttaaaataatgaaaagagtataagtggattgtttgtaacacaaaggatacatacttgagatgttagataccccacttactatgatgtgattattatgcattgcatgcctgtatcaaaaatatcacatgtaccccataaatatatatactatgtacacacaaaattttcttaaaagatacatttaacatgaaaagtgctacaagggaactttgtacagaatcaaatgagaggactcattccactttacccagcctggaaatggaaggataataccaagctgcctagaaggatccatgttggaactaagtttgataaataggaggtaactaagaaaagaacagttgagggaggggtggagaatgtgtgaatgctccatggggggtgtgggggaggcatgcacaatcaggaggaactataagtaatttaatattaggaaaatggagagttacagaagattaagctagaaatgtggagaggtaagatctcagagaggtttgtaaggactgcttaggagctcagatttttatcctgaatgtatgggacactgaaggtgtttacaaagccggtgataagatctggttagctcaattagctaattttagtggcagtgagataaaatggattttaaaggaatccagcttagagcacggcagccaatcataggagtatatcagtacattagcagagagctgacgatgcttctagccagggaagttttatagacagagtcattgtgaggagggatgatctcaaagacatattgacagggtgtagttggataaacttgcatctacccagttggctgggtagatgctggttaatggcagaaaaacaagcaatgggaaaagtcagataatgcccaggtctctggcttgggcaagtgtggagatggtggttccagtcactgagataggcaacaaaggagcaagagcaccttttaagaaagaatggtaggatattctataattgaggtgccaagagcacacggagatgatgatcaatggtcagaaaatgtggaatgctatggacctctgaaactttcactgtgatagcaggcatagtaaagtatgtgctaacctgaattttcttctggatggatttatgagtgttaacatgtgtctaagatcattatagacaacattcaaagcacaggcaaagattttaaggagctttagcttggttctttaattttctacaaaatgtaaaactctaattgatatcaagatcccaaatagtgaaatttagaacatgtatagctaaagccttgtccaaaaaggaagagagtaaacaggtaaacattgacattaatgtgttggtttagcattactgtttaagaggtttttttttttttctgtttaagagaaatattagtttaggggaataatacgtgccctgtaacatcttgtatataacatcctgtaatatcttattttcaagatataaactctgtaacagtaagagtatagagacctttctcttctctttgctgaggaaaagcagttttgggaatgatatctgccttttcgtgaatcccagtttgtgtctctgtcagatactctgtttcacccagtgaaccacccagaggagtgggaacactgagtcatggaagaaagctgaatggaaagataggacatctggagtctcagttctgtcactactgatttgctgtgtgattctgaacaagttttgcccctccctagtccttacttcctttctgtgaaataaaggagttggttgaatagttaagtacctttcaggctaacatattctatgaatctctcaacacatctgtctttaagaagtcttcatagttcttctcagttattcataagttttgtgcatgactcagagtttgccagtctggagcatgaagatgaatgattgttatggactaacatttttactatgaagaaatgctaggagaaatgggcagtgtcataataacacctagagtcatggacagcttttcctccccatgacatctggttttcctctgatttaatagaaactgaatatttgcttctattttaaacatatttttcctattccaagagaatgcttgtatttccaatagcatttagttctttacctgaatggtggtatttgagaaagactatcataaatgtatgtggtttaaggtaggataacttttttttctcagcagtatctgaagtatagcatcattcaggatctgtcagcctaccttaatgttaaccttgcatcctttttggtatcctatttatttcaataagaagcaatattgatgtatacagtgattcctaataatcggtcatttatgttttgtcatcatagtctttgcattataaaaataatactttgaattatcattaatgctttcctttagattaattcactttttagtttaattttgtaagtgttataaatggaaaattgatatcacttgctacttaatagataactaaaaatagttaacattttagtaatagtaaaaattaaatgaaaaaaatttacttagctactaaaattatctcacacatttgtaaatcacttaccacatgttgaataccactagcagagaggttagactgcaggcatttttatcagttgtctattgctacccactaaaaatccagtggcttattaacaacaaccatttgtttactcacaaatatatgtcaagtagattttattgtatttgtaagctaaagagttagcttgtactatttcttagatttttggcaggagacacaagactcctgggtcagaaacaaagaacttcattaattatgacatggaaagcagcatgaacattagtatgttggtgtaggtttctcttggttcccaaatcccatggaggaaacacagaggaacccagatggatgctgcacatgtagtagttttgcatgacagtgatggaacactgagattggggaatttatttttacaaagcaagcctgttttttttttcttgtcctggaggggaataatattacctcattcctcaaggttgcttactacaaatataaccttgagaaacggctcaggcaaagtatggtcagggtgtcaccttgtttgcatattccagaagaacatgcagaatcttttagggcccctagtgaatttgcctctccctgtgttctaaaaggcaggatttaggtcaggcttaactgggtgggttctgcttacctaggccaggcttggttgatctcagtttaaagcctgtgggcctaaagtatctcagtaagatagctcatctctgctccacatattctcttgttcttcaggagtctagcccagacttctttacatgtctctgtcccaagaaggagagaagaagcaaggcttcttgaagtgtaggctgaagctactacaacatcacttttgctgcattccattggccaaagcaagtcattagccaggccattttcaagagatagataatagacaccacctcttaatagaaagtactataaagaattgtaatcatttttgtaatctacaacatcagattttaaaatatgtggatttaaatctagatgtacctaatgctaaatgacaagttaatgggtgcagcagaccaacatggcacatgtatacatatgtaacaaacctgcactttgtgcacatgtaccctaaaacttaaagtataataataataaaatttacaaaaataaaaaaaaaaaatctagaatccacttaaggactcagagcctcagttctctccatgtaaaatgagaatggaagtatttacctcaaagagttgttataagtacctaatcaaactgacaagaagcaaaagaagtatccagagttgtgcctgatacataaacagtatgcagtaagtgaaactggttattattaaaccccaaatgttctcattttaaaaactcagctgtggtttgccatgtctttcatgcttgttttctatctgttccctaaagttatgagcatgtttgaaaatcaaactttccatccatctcatatccacaccactcactctgttgttccagatctatactattaactataactagaatttggcaactttttacatctacatgtcaccactcttgaaactgtgtagaaaaaaagtgtgctgcttgttcatagggaaaaggcactaagaatgtacagaaaggagactgtacacattggcatttgatatctggtgagcaggaggaggggagggtgccatgtcaaaacaccaagaagaagacatagtagagaccaagcatggcattagtctcttcataaatagcagttcattttaagagttctgttgggatgctgcactgtgaaatgaatgtacttaggtgtcttctgaatacaagagaaggaaaagataaaggaggaggaggaggaagaagaggcaaagatgtggaaggagaaagaaaagaaagagaagtgaaaggagatagggatggagaaagagatggaaatgaagaggaagaaaaacaagaaaaggaaaaagaggagatgggaaaaaagaagagaaagaaaagaggaagaaaaggaggtaggggagtgagaggcagaaaacaactgttcaaaataagaaacagcatacctcttagcttaaactctgtatttatgaaaaaacagggtacctcctttctttttatttactcccttttatagtataggtatgtgtggtcagtaggaacacagagctagggtattttggatgttcataaatgtgtgtagactcatctcactattaaacagaagtgctaactgttctctaattttagcaaatacttttaaatgtcaaaagacagattttcctccaaccccctttcctaggcctcaagctttgagtcacaaagataacttcgctctctgaagaaattggcagaaatgaatagaataaaatgcagaggaaatttttttgacaaattaattttaagacacagttttagtccagcatctatgtagccaagtaggcaccaaaatatattttctaaactgagatgatgaagggaagggagaaaggaagatgtccttagagaaaagagtaatggaaatcaaggaactgtcttctgtgatgggcttcagggcagatctaggctctagaagttgacaaggggtggattttaggtctttcataaagtggaaggcaaaatcagtgatggtacatgattccaagtatgtcgttcttatgtgctatggactctataccagatggtacttactatgcaacacctactatgtgccaggcattgaaaataatagctgatgaatgcacactatcctatctttcaggcagctcacaatttagagaggagagacacataccataacaaaaaattataattaagtgagatcagatataagtcaaaagtgtgcactgagtgccgtaggtgaacaagagtgagatacctaacctgtgaaaggaagacaggaggaccttcctgtaggagattacacctgaactgattcttgaacaagaataagccagataaagaattgggcagaggacaacacaatcaatggcaaggaaatgtgaaactgcaagttgataggggagggtcttatgagtaactgaatatatttagagactgagagttatgtagggactagttctggaaggcctatatgccaaatcatagaatccatctttgttctacaaatatagattaacaggtccctagttatttttttggttattagttatttgaaacttcatcctttccaacattcagaattgcacccagctattcaccaccccacctcacccataactgagaacacaaatgtcaacacaggtaattagttagaattaggcattgctactaactgtcaggaaatcaaaatagaggtagcttaagtaaagtggatgttcatttatctctcacagcaaagcccaggtgtccagtcaagggctaaaatgcttcacagtgttaatgacccagtcttctcctttctttttgttctcccataattggcctcaatcttaagtgagtatggtaggacaaaaagaaattgggtaaaggacacgtgagtaacaacacttaagatttgttttaaatactaactgagcaatataacctctcttctcagaaccatcattctatattgtacactgaccttttcttcctcttgatcaagtctgctgttgagactttataatgaatttttcagtttagtcattatattcttcatctctaggatttctatctggttcttttttattattttattttttttcaaacttctcactttttatgtattgttttccaaattttattaaattttctatccatataatcttattgttcactgaactttgagtattaatctgaattctttgtcagtcatttatatatctccatttattttggttctgatcctggaactgtattagtttctttttgaggtgtcatgattccctgatttttcctaatccttttgttcttgtatgttgtccgtgcatttgaggatacagcccctgctatggcctttccaggggttctttggcagggctagatcttcactatttagtctagcttgtgattctggaaggaccagctggtgattaccccagacagttagagtttattgtgagttttcctgttgactgggtggctgcctttgctctgacactggtagggctgctggctgaactctgttgttcagtgagaccactggctgggcactacaaagctgatgactgggtactgctattacttctggtcaggctggtaataggatgtgttctctggctgggcaattttgctctttgtgatttgcagttgagcagggctgcaggctaggctataaagttagggggagataccgttcaagataggtgaaatacgttatgctccttagaattttacaattaaagattgcctcccagtcaggtggagccacgaggtaggcttttggctgagttgagtagctatttgaccttctgggccaagcttgtctagctcttctcttctttgaattgcatagaaatggaaatctccctgcctgggtaaggttgttggctgagtgacttcccaggttaagccaatctagcacctttgcttctctggaatgcacaactatgggagtctctttgcctgggcaggtttgttggggtaggatctaaggctgggcatagatactagccatctagatggctagtacagaagttaggttgagcctcccaacatgcttctgaaggtgaccagctcagctttacaggttggctgcctcttattatttatttatttattttgagatggtgtcttgctctgtctcccaggctacagtgcagtggcacgatcttggctcactgcaacctccacctccagggttcaagtagttctcatgcctcagcctcccaagtagctgggattacaggcacgcctctatgtctggctaatttttgtatttttagtagagacggggtttcgccacctagcacaggatagtctcgaactcctgtcctcaagtgatccatccgccttggcctcccaaaatgctgggattacaggcgtgagccaacgtactcagccagaggttggttggcgtttctgatctggtgtcacaggaacacagaagtaccaccaagatccatgcactggttacttatcacgtatggttcctttctttgtttctacctgactccaggtggtctagccatgccatttcctctagtgtttcctgtgaggtaaaaccaaagtggccttcctgagaagcatcttggaatgctagggatgctatatgactgcctccagttctcatttgcccatgtggaaactgggcccaggaagatattctcactctgaatttgtgctgacttgggggagtgggaggagcagcacagttagattaaggccagtcttcttaccctttttagattttcattcagttgtgtagagccacacaggtgtttcaggcttgttttcatgtattggggttttcaaaaggatgttcttgtctgtggatagttgcttgttgaactttccgtaaggaggaatagagcctaaaacttcctattctggcatctttctgacataattattgaccttttcctaaggacctgtgtgataccaattgttggggaattaaaaagtgattaagtaacagccgctactttcaaagagtttgtactttaacagtatggcagatatgcatacaactaattttaatagtttgtcaagtgctattcaaagctgaggaagtgaaaagaagatgtgttatttcagcctaattgttggaaaaggtattaaagaggatgttatacttgaactcagcctgaaacgatgattgaggatccatcaagggatcatcaaatatgtgagtaatttctttattgtcacacagaacttaatatttgttccaaattctggttaagcaatataacttcttcttccctagacacaattgattcgtcatccagtagcatacttttcagcttgctttcttactgcctacagtaatttgaattttcagatatacagaagaaatcctttgtcaccctttaggcattataataataaccatccataaaccagacattcaataccttccttttatgcattttttccattcttcctttctattctttcaataacgcttgtgtggctaagttaaaggctagcatttataccccatagcaagactttcaccctgtttatttttcgaggtgaagttggtttttcagctgtagtaagcataccactggaaatgtgtcactgctgctctcccctcaccagcaagtattttctatgtttttcatcacaaagtcgttatgtgtttcaagctttgagcaacatctgagtttccaccagctgtgttttgcattgtcctcattttgtataattaagaaaaacaggaagccaatcacttaaggaaagctgaccctcttcattctgcagactcgagaaaggactgcatcagggttttttatagtacagtttttaaaaaatttatcctgcaatccacttcaaagtggaacaaggttagaggaactgtagctgtatgatggccttcctcttgactacaaacagctgtgcttttctgaaaccacacagtccagtttaaacacacttctcttatataatcagttatcaattcagttagtcacattgtgacagaggatttcctctgatattttttacagtaactcaaatcttgggaagtcagggagccttttaaccttagtgcttaaatcttctatatattcaactttttacctataggtcctgcccatacagttagacaaacaaagctgtgttgcaagtcaccaggtagacagatgagagagagggacatttgtattcactgggcattatccactcttctaaggaaatgcaaactttttttaccctgatttatgtagatacttgtgaatgagtttctgctatttgattttactaaaagttaaaaccaatagtatgtatctgggaaagagcttctgactctacttgactagagtttcatttttctaagacataagataaaaataattacttcagaccagacacggtgtctcatgcctgtaatctcagcactttgggatgccgaggagggtggatcaattgaggtcaggagttcaaaaccagcctggccaacatggtgaaaccccatctctagtaaaaatacaaaaaaaaattagctgggcgtggttgagtgctgctttagtcccagctactccagaggctgaggcaggagaatttctttaacccaggaggcggaggttgcagtgagcagagataatgccactgcactacagcctgggcaacagagcaagactctgtctcaaaaaaaaaaaaaaaacttcatcatatgaaatttaacgtggaaatagtagttatgttggtgtcaataatactttatcgaatgatatatttattgcatatgtcacatttgatgatcattctagtgatcatcaaatcactagagatatagagatatttaaaatatagctcctgccttcaaggatttaataggcttgtaggggaagctcacgtgaatacaactaaatataatccatagcaatgtgttacatgatctgggtcctattctcataagcaccaattttgttatcagacccatctccaatataaatttgaggtagagcatcaaagcctgtcctggaagccttataatctgacatttgaacatgagtaataatcaatcatttatcaacaattatgtattgagcacatactatgttctaggtattgtgctgtttttctaagggttggaaaccttcattcaggggcatctatagtgctctgtatgactcacagagttttctaacatttattagacactattatgttctagttactttaactttgaaagttccatgaggtggaaattgttgtacctatgtgcaaatggaaactgactcagtaaaattaagtaatctttacagtattatacagcaaataactgacatatttagacccaaatccctatagtcatgatgccctattctactacttttgacatcccatgcttccagctaatagagacattttacaggtaatttgagtgcgcagtactgactgagacctattttctttgtcagaagcctctatttacacctgtgtatatggacaagctggtcacttacatgttcttttaattccactaaaatataaatgaaaatattttatttttatttttgagtttgaagggaatgctttatagtataatgatgaatatatcaggaaggagtaatatcaggaagaatttaaaatgtagtgatacacagaaatggtgacaaaagaatttagagaatctacctgtaggtgtctttaaaagtagaatgtaatttttatgtatcacacagtcatatagactagattatctgttgagaccatttcaccttataaagtcatcatgttgcactgtcatattattactaaattggacagaatgtgcaaacacaggaaagaattaacttctttggtaactgtagttcaggtagctgacaccaggtggcagcagccaggcactcacatctttttgagaaaatcactgaatcatactcttaggagacaccttaggtaatatttaacccaaaccattttacagttatggcaacttgagacccagagccatgattcagcatagttctgtaagaatagctttttgttaaagaaaaaccatatataaatattagttagacgacattatgtgcagaataaaaaagaaatggaggtgctattttgggcagtatttaaaaacaagcgatattttatgcttattcaagagttatctttcttattctttcccaagcaacccccctgccttgcagtctcacccaataagggaatagtacattctcggatgggatctttcaagggtttaaagccttgcttcagggatatgtgtagtgtctccaaggatactgtaaagtcagttccctgaggttgactctgatccaaatctccacagttcagtgctgacagggactttagacagcttcttgctcactcttctcagtattttttcctctgtaacaggcataagaggcaactcatgcctataagcatacccaagcttttataaaaacccccaataatactgcatagacgagcctttgcaaccacctgttattgtcacagcttcagttagggtcacttgcaataggcttaccctggataaaataggctgtgctttattgaagttgcattaactgacatctgacttctttcttttcctctaaagcaaacacacagaatataagcgagtgagactggagttgtctccttttaaatcttttatcctttatttttttgagtaaatgatttccaatcactatataattaatatcagtatctgaaatgtttttcacgatgaacatgacctttcagtgtgtctccacagcacaaaagagagccacttttctagcctagttctctaaacatgtttcagatgagaaatttgtctaccagaggaggtcacataactaataagatgtcacatagctgctaagatgtcacacagctacttcagagcctcacagagccaggaccaagatctgagtgttattgtaatgattctggtgtacatttaactgctttacttaaactttcttgaactcaaagccagctacgcatgagtgtaagaacaagaccgattttagagtctgccttttcactgcttcaacctaaaacacagacagcatctgaacctcacctggcagctgtgccattttgccctgtgctctgacacattttggctctttcagtgagctcccagtgctgctgcttgcagccaaaatgccaggttctgaaaaaaagcatgattccttccagccctggggattgttgtcaaaaggtcactcagtcattacttctcactaattatgttagaaggaggcctcaaaaatgccagggtttttgaaaaaaagaaatatcaacatttatggtaaacataaacaacataaatcacaatagtactatgcatagtgttccttgcaaatgtggatgtgttgtgggtgtagcatcactcattcatttactcaccatcatgttttgagatagctcaatatcagacgtggttgaaaagtccgcaggtgccaactggattcttccttcatttttatattcaacatatatgtatttatagcctattatatgctagcgacagtgctaggcacaaggaatgcagcccaatatgaatggattttagtagaaacgttactcaagataaacttacgtaaatggagttgaaatgtggttttataaaagttggtaatcacagcattttgggaggctgaggcgagaggatcacttgagcccagcagtttgagaacagcctgaacaacatgccaagaccccatgtctatgaaaaataaaaaattagccaggtacagtggcatatgcctgtagtcccaactattttggaggttgatgcaggagggtcacttgagcacagttggttgaggctgcagcagggagccatgttcgtaccactgcactccagcctgggcgacagagcaagaacctgtctcaaaagaaaaaaaaaaaaagaaagaaagaaagaaaaagaggtaaagagttggatatttatttattctaagaaatatattttaaagattttttgcattgttactgtaacacaagacacatctactatagcagttgcttggaggaatcagaaaatataagacgaaactgctgttaaaaatttagttttaagaagggactcatagatctcatagactgttatttaaacaaatgacacaaacaattccaaaatacagggtataattttcaagctaactattataagcatttagagataaaatgtcaagggagagagcacttgcagatgaggcaaacccagaagccttcatgtaggggctggaaatttgaattggactcctcctttgaatccacatgcaaagaaggaaatgagtgctcccaattttttttctttttaaaaaaattttacattttatattatcttagaagctagtattgggtagagacataggcagtcatagaaaatgctgcctttatcctgggagttagtaacttaaatggtagtcattatttagtctatgacagccatcagttctgaatagtgtttctcatagacaggggactgaaccaaaggatatcttggagttccttctagatcaagggtcattgattctattatacattgcttgatattgtaaacatgtaactttataaaagtatattctgtcacattactttttttttaacttttaaaaattcttatggttacataaggggtatgtatttatggattacatgaaattttgtcacattttgataagtataaatcaagattgagaaagcagtgcaaggctaaattatctaggtgaattctgtttggttgaaacccagttgcaatttcgtttgacatatatagtgttcatcagtacttaggaagttaaaaaaagaagtcaattttaaatcttcaaattaatatgtattgtgtacaaggttcatggtctattctagatacttattaactaacaatttgcctttcaaatattttcttagcatttcaaatgaaatgctatccttattttcccatttgtgttgcattcttgctatagattataagaacaaatttctttcactcaacaatgatttaataaatatttattgaggaattataaatgtcaagcactgagcttgctgggtgcaggaggtatgaaagtaaatgaaatacaattaaaacatagtctcctccttaagaagatgactgtctggtgggcaagtcagacttataagtagattaattacacttctaaatattagagtttaaagcaagagctttggaaagcacagaagagagaacattggctgctagaagggaggtttcacagaaaggtaacatttaatatgagtcttaaaagagaggtaacatttaatctgagtcttagaagatgagatggcaaaagggtgtaacaggctatggcttgatggcatctgccatcatgaaatctataggatcaggagttctcatctgtgacagaagtgtattttatttttgtaggataattataaaaattggaaataatgcaaaagagttagcataatgaccagaagaatatagatgctcagtaaagcacatctatcatttgcattatcacctaaacctattgaactatatgtcctactcactgcacatactccaaatgcccaatatactgtttcacagctaatattatggctataattaagtagtcagtagtcacttatgcatttaacatttgcctccccataccagaccaaacaccatgagaaaagggaatgaaattatttcattgattattgtattcctagtatctaccaaagtgcctagctgatgacagatgcccaataaatctgtgttgaaggagttatttaaaaatgcagtatcaagtcacattgtaaaagcgtgagtactctaactccaaaatatcaatttattagttttccttcatggcaaagggtggcactcagacctcttgaagtaatacctactccatcttcagcatacccctcattttcttgcctcaactctccattatgctcatacataaattaacttaaaagctcatagtagtctatggatggccagataaaataattttatgattttctgttgattttaacccaaaatgtacatttgttttattttacctttccacagcccagaatattttataagaagacccctctcctctctcaacaaatctgccatgtcttatagaaagtttattagaggcgcacattcagatcccctgagaattcattactttccaaagccatgatgaagcattattctgaataaaattaagttcttctacttccaattaacagcagatgataaaagtgcctgccagttctgttgcctttcagctgggtgtttttctcttgcttggtcatttgtaaaatgtgagccctcctaatggggactgagttattcacttgaattaatgagtttcagctgaattgatagtgcctagcacactgtaggtattcaataatagtcaacagcaatttttaagctgacttaagttgcttcatttgagaacattggctaaaatcaatacaatgtggctttcctactaaatttgacttaaagggaagatcagattcccaaatttggtatccagactatatacagtcctgtagctagtattatataaaagaatctaaaaagattatgcaaaacctgttaggctgaatttattcctgtgatttcccaacaagtacacaagatactccagcatacctatatacatttttgagccttagattcttcctcctagaggaatatctggcacagagtaggtcttcatcaaaataatagctaaaaacaaatgggataacatgtcatgtgccatatgttagagcatagcccattttcttgtatctcatagtcactcagtaactattgatttaatcaatttaaaattaaaatagaattaagatctagcataaactaacttaggaaaccttttagatctaaacccaagaagataaaatgcaaaaaatgtattgatcaggaaatagttatattcagaggaccgaagagacacagttagcaagttcagattatagtgcagcatatggtgcctaatgcctaatagcacatatttgcatgttgaagcttttaattagaagggattacaattcctctgagattctcgtagctctggatggagagcttttaaaagaaatcaatattatatgcttattatattataacctttgtggaaaatcaataatatgtttgctgaaaaaaatattttatgtgtcaactgaattatggaaacttctcgtgccaacagtgaaacctaatgatttatttaattacattaagtgaattactttattatatcagtatattatactaatttacatatgcacacattgtctgtgtctctaattgttccctaagttatgccatctccctaggtccccttggcttacctcttcatggcagaagctgtatcttctgtgtctggttaacaaccaactcagtgtttgtttacttttaaatgatttttgttataatgacaacagtaataatagataaaagttcaggcaatataagcactttgttgggtactctacatactgataggaaacatacatcactcaaaattaaatatttgccttcatacaatatctatttattcattcatttattcagcaagctactcaacatccattgagctgccaggcgtggaatggtcactgacagagtcaaagaaaaatctgtcatgactctctgttggtaacaagcttttggggagaaaaaagataaaaatgttataataaaatgtgacagctctaatgatggtataaaaaatgttttgaggggcttaggagaatcatagctaactgctggaggagaccctgaagtctttggaagagtactcttgaagctgagactcaaatttgcatttcaattgaatagatgcaaaaaaataaagaagataaggaatcaatagccttcaccaagtcatggaaatgtgaactatgagttatacacatctgaacggaatttggcgtaggtggactatgccctgagagctggaatgtttaggcagaggaataaaaagtggtgtgtgtatagggagctggggagcggtaggtatttgaagtataaagaaagtaaaggaaggtgaagttagaagcgaagatttaaggcagtttgtagagggtcttggatggcaggattaggagtctagaatgtgtgctgtgattaaagggagccaaaaggatgctagcagagccctgattggtttagagttttatttaagaaaaaaaggtttctgcttgtttccttatacaaggagacatacattgcaaagatgccacaatttttaggaaagaagcatgtgtgctatacccataagaattcactactggggaataagttcttgctttataaactttctaagaatagtcaagttcacccagaccagagttgagctttagatttaaggatgcttagcttgccaccttgtggctgacagtgaatgctgcacacaagggatgtaatctgggaaataaaccaactccaaaccacttagtgaagtttttttatttgttcaagttcatcacaagcgttagagataataataagaataataacacttagaataaatattaatgaatactagagttaaaaatctttgaatgatccttgactcctttatctttctcaccccttacatataatgtatctataaatcctgtcgatgagattttccaaatctgatatatagtcacgttataagtgtttttcttgataattccaggttttactgagagtatggaaaaatcatagttctcatatgttgctgatagtttgtaaattggtatatttctgacaaaaatacaactactttgtagtaagatcattggagaaagcacggaacagatatctagaaaaattgaagatgcatatagtctaagacccagaactcctctactctcctaggtatatatgttctaacaagagttttacatatgtgcaccaaaaaacacatgcaaggatttttagcagtattgttagttttgttattccggaaaggaaaataatagaaaaagcccaaatatctctctcagaaaaaaaaaaatggtacattgtgatatactaataataacatactgtaaaaaattaaaaagaaatgatctagttttgcacacatcaacataaataaatttctcaatgaaatgttgtagaaaaatagccacaatatgatactgcttacataaagttccaaaatagatataaactaagcatttttaaggaatactgtatcagtaaagatcatatcagagaaatggaaccagtatgtgtatatatattaatatgtgtatataaacaaatttattttaaggaatttgcttttgtcattgtgggagctaaaatcaatagggcagggcagcaggctggaaactcttcaataggcactaagcaagaaatccacagatgaaatctattctttctcatggaaaccctagttttgcttctaagacctttcaaatggtcagatgaggcccacccagaatatcaatgataatttcctttacttaaagtcaactgattgtagatgttaaccacaactacaaaattccttcatagcaacacctaaattaagtaattgaatactataatttagccaagttgacacataaaactaaccattacaattacctgtctatgtagtaagactattggggaaaacagggaattatacagataaaattccacaattacctcaggggagaggcagacagatatgacccgggatggatacccaggggcctccattctgctggtaatactttttaaagatggatggcagttatgaggaagtttgttacattattccttatagattgtatagctgatgtaaattactttgttatgtagggccattatccttagcaaactaacataggaacagaaaacgcaatactacatgttctcaattataagtgggagctaaatgataagaacacatgaatgattccataatgagtttgaaatataatttttaatcacaatacaaaataattgtttggtaagagtgtgggagtactacatgtgtaatctggggaacagaggctcttcaccctctaacccagcttgtccaacctgcggcctgtgggtcacatgtggcccaggacagcttcgaatgtgggccaacacaaatgcaaaaacatttgaataacatcgtgggactgttttgcaatttatttatttatttttagctcatcagctatcagtgtgttttatgtgtggcccaagacaattcttctcccattgtggcctagggaagccaaaagatcggagactggatactcttgctctaaccatttagggttgttgctatgagccaaaacagaaatacgagtcaggaagaaagactaaacacatgttaggtcagatgctcaagtttacaaaaaataactgggggtgcatttttgatgagaggctaacacagagtatctttatacccactgtccactaggccccaatctcaaagctggatatggttgcttaaagtccacctgctacctgaccatgtcctgtctcctatcaggcaaaagatgggcccagatgggagtgaacttagtcaccaagtgttacaaaattcattttttttgttacttcttatctcctctgagaaaagatgttggagggttgaaagaataaaagacatggacatttggaatgttgtgtgggtgggcaaaagaaaacttggagtttgtggcccctagatgcttcctactgtaggaaatgcagatgggcaggggctgagctcattggcctgcaggctctgccacttgcctgtctcaggcaccagcacaggttctctaaatgcctcccaactggtctccccaacttttgccctctccctttgaatccattctcctttggcagctagagtaagcttttaaaaaattgtagtaaaaaattcataaaattttagtctatgttaaccattttaaactgtacagttcagtagtgttaattatgttcactttgttgtacaacagatcccccgaacttcttcctcttgtaaatctgaaactttatatcctttaaacagctccctatttcttcctctctctagtccctgataactaccattttactttctgtttctgtgaatatcaccactgtaggcacttcatataaatggaatcatacaccatttgtctttttattaccaacctatttcacttagcataatgtccttaagatatgtccatattgtagcttgtgacaaaatgtcctttcttttttaaagctgaataacattttattgtgtgtgtgtgtgtatatatggatatttctaaccacattttgtttatttattcatcaacaaacatttgggttgcttctacctcttagctatcatgaatagtactactatgaacatgggtgtgtaaatatcttttcaagaccttgctttcaattctttgggatatatacccagaagtgggtttgctagataatattgtagttctattttcatatttttgaagaacctccatactgctttttattgcagttacatcctcttacaggctcactaagagttcaagagtgagcttttgaaaatatatatcaggtcatatcactctcctgctgaaattctttgttgacttcccatttttcttaggatggggacccaaatccttcccaaggctaacaaggccgtatgtaatcttattccaggttacctctccttcctcatgtttgcttcactcacccctcttcagaaagccgtgtcaattccttgaacctaccacactcttttccaacacaaagattctcatggttgttcttcctttcatttgaaaggcagcttacccacctcttcacatgggagatattctcattcctctgacttcagttaatatgtcattgtttcagaaagcatccttgacattctctaatgaatatggttccttcttgtgctctcttggagcatcttatttccttgactttatttccttcattattattattattattgagacagagtttcactctcgttgcccaggctggagtgcagtgactcagtctcagctcaccgcaacctccccatcctgtgttcaagtgattctcctgcctcagcttcccgagtggctgagattacaggcatgcgccaccatgcccggctaattttgtatatttagaagagacgggatttctccatgttggtcaggctggtcttgaactcccgacctcaggtgatctgcccacctcggcctcccaaagtgctgggattacaggcatgagctaccgcacccggcccattttctttatttttaaattatgttagtcaccaccactagaaggaaagctccacaagagaaataatactgcctatcttgcttgtacactgttgaatccctgcagctagtgcacctaataaaactggtagtcgttctgccctcaagattgagcaagtcctatccacattaaggaaagagtaatgatttttagggttaaaaactgccccatttgggaagcttcactgtgattgttaattttgcatatccaggtaaaacttaatagtttagataaaaggatgaattgatacaaggatgaagaagaaaataaaacacacagaactacaaatgaagccatgaactgaatggacgaagatatgcccaagcagagactagaagttgctcatgggttttagagaatttgaattgaattcaatttagaattggactttctgtgatgaatagagaatgtgcactaactcttctttatcagcctggccaagtctctagaagtgaaagtctaaactttatggcagtgcagtcattcaaatcatatcctcatggatgatactttatcatttatctttcaaattttaattgaatattccccccaagcactcattcttcaaggtttcctgacaccttagtttcatgttgccaattttaagaagaaattatcaaacttatctatattgtaacatgtgaatggtccacaatacattttaattttaatctaacacaaccgtttaagactgtaccaaccttctcaaggaaagaattgtaagaaactgcctttaagcatcttaaatctcaagagaggaagttaacctttatggttcctcctccgtgagttctagtctgctgttcctttgacagtattgttgctgtctcttggattcatacctttccgttctttaagagtagactgtgatatcttattctccaagaaactgctcctttatacggccaaagctaggttaaatgacctctgggggagcatgtgaatatgatattttatttgatattgtattgattctaacatgcactttttaaatatttgtatctctgaaatcagcatgcatcttaactatgacattttaggttgataacatttatcagtcttatcaactgaaaacagagctcactggtcattgcgttttctctaaatattaccagggtctattacagtgcatcagtgactcattttaagtgctcagtgaaatgagggatgaataaaaagattacaaactcaaggacaattttattgtaagaacaatacaaagtgacaaaggtaaaccacattttggggggaataagatagattaggagagactgtggaaaaggtgacatgaaaagaatcttaaaaagagcaaggtatttctcacctgtgatttgggaagcatcatttcaagacagaaggaaaagcatgagacaggaaggtgagaaaagattagaaagataaaatggctccaggaaagagctgctgagctagtttgaaaggaatgcaaatgagtgaaaaaaatcagtaagagatagtactttagcaagagattgagaatgttgtgaatttcacatcaaagtgcgtgcgttttattctggagcaggaggaaactactgaagggttttaaaggggtgagtgatatagccaaacttgtgtttaaggaagatgtatctgagggtgattagttaaaagaattggttgatggagagtatatagataaggaaaccagttactaggtggctaatattcacttaacaaacatttattaggacccactgaatacctggcacaggtcctacagccataaacaagactcaatccttgcattcaaagatcttatagtgtataaaaagtaaacaattaaataaacagacaaaaatgatagattaagtaaatgtcctgtgagtgcacaggtaactatgagttctgaccgcagtctgggggtgaggtgtagatgactgatggaggcagtgaataaattatggaggctcctggaaagattgtcatcttaactgaactttgacgttaaagacatggcaaaaggcatgtggaaggtaacaagtgcaaaacattggaggtgatccattcctcttactctgagttgcaaataattcagattggtgaaattctagattttggggaatgtggtgggaaaagatgaagaagcagagaaaggaaagttggtgtgttggggtagaaagaagcaagagatatgtttggaaagagaaattgaaggcaagtggaatattctagggagaagaaacaagggtgtgatgggggagtggacaatggagataaacaaaaacaaatatatctgctgatttagagtccattaaacttgtattagatccattcacttggtaaaatgtactaaacctcttctatgtgccagggggttactgagatagctacagctgtagtatcactgctttcatcagggagctctcagtctaatgtaaaccatcttggccttcactctgatattaggagtcatgttctggcaatttagttagatggaccccactctggaagacatgagagaggaaagatgctgagggatcatcttcatctgtgtaattttgtatttgggtgaccagagaaatggcagtgtcattaactaggttatttctatttatactttctcccaattgcattctatggcccagcaaggataaagggaagcttacagaccttagcttttaaaccaaaggaccaaagtatctaccatactcagaagaaacatctgagtcagagagtaagaaatgcataatacttgagagacaatatagtgtgtgaattaaaggtggaattacaaggataatgaggtataaatctcattctatccactagttgtgtgaacaagttacttatttaatttctttctccctgtattttctcatctgttaaatgagggaaataaaacagtaactactccataagtttgtttaaggattaaataaattaaggcttgtaaagcattaatacatatgcacgtcatgtcacaggcagtaatctgaaagatgacactgtcagttcccagcagggcagcaggacaagaaaattagaaaactttctgggttttcttgatttggggcttacatcttaagagtatagtaagcacaaaataacattctacaattgcacattaagttgcatattaagcatctagatcaagtataaatatgcttttattatttccaaaaggcattttattagacactattgtatttggagaatatttaaaccaccataagcaagcatggattataaagcaaccttatttgaggaaacattaatatttttattaaagtgtctgattgtgaaataaacctctttgattggaacacactagtaatagggccacactttctgccttatttttcaactttcccatgttccaatgccattgacaccagctcattatgaggtgctctaaaacaaaggcagctggatagatcaagcccatttgcaccaccaccagagacaattcacagtggttgcctacctggacccctgagtgtcttcccatagaaaggacagctgttcataactgcttcttggtacaggaagtatgttgaggaaaaagggagctcaaagagctggattacctaacgcaactagaatttaatttcgacagagtcacagatttttgctttttttaaactactgtatttctagcacttaaaatttagtgattagcatataacacgctagataaacattctgttggatgaatgaataatggtgcttcccactaggaaggaactttagtctttatagtgtcacagaggatatatatgccaatcgaccacccaggaagtcccaggaccaggaacaaagtctgctggagatcatccaggagatattctaggttcaggtgggtaactgatctcatccttggaagtcaaatataatgggaaggctaggcaagtgccaatttcacaggtaggttctgaagtccaaaaactcacatggttaggaagagtagcttgaatgagcagtgaaggcaatttcagcacctgtgtctgagactttttttttctctgcctgctggacagagatgatcatcataagtggaagataccaagagtaggagtgttgacctagctagaggtgtgagtagaatttgggtaagatggcctcacatacagaaaaggcactggatcaagagaagtggcagcaaggccttagcagctcattttaccaccttcagaaagtttgtgctgttctgtagggatgctacaatactctacaatactggtaatagcatggtggaagcctgttccctgtaatggtgataaggctgaattgagcatatacatgcatgtgtgtgtatgtgtgtgtgtgtgtgtgtgtgtgtgtgtgtgtgtataggctcgttttacaatacttggaaagatgactgcatgacactggtagagaaataggaatgctgggtgtggtgactcatgcctgtaatcccagcactttgggaatttgaagcagacagatcacttgaggccaggagttcgaggccagcctggcctacatggagaaacactgtctctacttaaaaatacaaaaaattatccaggcgtggtggtgcaagcctgtaatctcagctacttaggagtctgaggtgggagaatctcgtgagcccaggaggcggaggttgcagtgagctgagattgcgccactgcactccagcctaggtgacagagcgagactccatctcaaaaacaaacaaacaaaaaaagagaaataggaagaatcttatatttcctaagcacctgttaggaggcgggtcctggcccaaagagtttgggcatattatctcatcaatttcctatagtgacactgtcatacattattagtccaattttaaaatgaggagtctgagtttcagagagccttcatacttccctaaagtcgcactgctggttggtgcaggaacaggatttaaacccaggaactgagctgcagggaatttgcatcgcttgaggaagcattttgctgaaatgaacatttcctcttttctgggcaccaggtgcactgagcaaaacatgtttctagcttttagtagtgaatgattctcactcacagatgctgtagcagttgcacagctggtggattagtcagacagggactgcccacaagatcgtacagtgctcaatagaatccagtggcagttatccctggaaaattactcagaccatgtttgaagttttgcttcaaatggatgaactactgttgagtttgctcccaaatcattgctttgatttcttggtaccaaagcaatttgacttaaagcctggtcctctccagcaaatttattcccggcacatccctctttcatttgtcagctggaaaccccttcctttgcatccttcagccagttctcaaaattaactcaactgaacatggataaaccctttccaggactagagaatttttccttatcacaaaacttataccacactgaaccttctccagtacaacaaagcaaatacttgatcatgttttacatattctaattctttttattcctcaaagaaatatatgtagctccaaaaaatgaaagtaatagtcatccagaaataaccatggtcaacatattagtatattcttccagacctcttccctgccttgcatacactttaatctattttattgggcttatttgaggttggtacactcaaatgtgagtcaagctgctgacctggggtttagatgggctcgtgtaagaatacttagtgtggtctccgtatgtttattgtggcactattcacaatagcaaagacttggaaccaacccaaatgtccaataatgatagacgggattaagaaaatgtggcacatatacaccatggaatactatgcagccataaaaatgttgagttcatgtcctttgtagggacatggatgaagctggaaaccatcattctcagcaaactatcgcaaggacaaaaaaccaaacaccgcatgttcttactcataggtgggaattgatcaatgagaacacatggacacaggaaggggaacatcacacaccggggcctgttgtggggtggggggcgggtggggatggatagcattgggagatatacctaacgttaaatgatgagttactgggtgcagcacaccaacatggcacatgcatatatgtaacaaacctgcacgttgtgcacatgtaccctaaaacttaaagtataataaaaataaaaattaaaaaaaaaagaatacttagcgttgtctcatttgtgtgttatgcttccgtagctgctctgactcagtgctggcagtggagaaggaagaagggaactcagttcttctctgcatgttactgtttttctttctgtcaactcttttactccaggaagccaccagctaatacactttgtcagggatgtcatacccaaagctggaacaattctccctgctaaatgaaaactttcaaaggaactcactttattacctgtgctacacaacataaaccaatttttgattttattgttgaaaatcttacagggtactactgttcaataaccagctctactgtagaatagtgacaggcttcttgactatgcactacttctaggatgtgctagtcatggtggagtacacaggagtctaaggagcttacatctctaccaggggtagttccatttagtagcatttattaagcacctactgggtcccaagcagaatatttgcccctggtacaataatgaattgtgaactcttcccattccagtgagaatggcagagacatacatgctttgagaaaaaagagggattctcagggagtcagacatgggagcacagaataagaatgcttagccaaatttggatgtctagggaaagcatctggaaagatatcatttatcaactaagttttgaaggttgagcagtatgtgaaaaagagttgggaaagttatgagaggtagagaagacatcaagagcaaagggcaaggatgagctgtatcttctttattcactattacatctctagcacatggtacaatatctggcatagaagtggtgctcagtaaattctttttgcatacaaaagtgcaaagagaaggttttcaagcatttaagatggcgtaaagaaaggctaaagtgtactttgtgagactaggagggctgtgagatttgataaactgtctatgtgttatggagtagtgggagaagttgcagttagagaatttgaaaaattcaaaacagtaaaaggcaaaaatttttcctttagttttttctattcttccaattttttataatcaaataacatatctaatgttccagtaaaacaatcataacttctactaagtgactacttactagatcacagacactcactcttctaagtgccttccatgcatcatctcacttggctttctaaaaaatcttgtgaggtagttgctattccagttttgcagataagattaccatgtctcagagggtttaataagttgcccaaggtcatgtggttatcaaagtaggaattgatgcaggccgtctctccagaatctgcgcttttaggcgctgttctgaaactgaggttctagaaacttattctactgagatacatttgtcaccttactccttttggccctgggatgccacagaggaatcatcactaaagtctatcttcctactgccatcatgtctaagtcggagtctctgaaagagcccgaataactggaaggtcttcattggagggttgaggtttgaaacaacccatgagagtctgaagagccattgtgagcaattgggagcactcatggactgtgtggtaatgagatatccaaacaccaattgctccagggcctttgggtttgtcacatatgccactgtggaggaggtggatgcagccctaaatgccatgctacatgaggtatgagagagtcgtggaaccaaagacagttgtctcaagaggagattctcaaagactagttgcctacttaactgtgaaaaagatatttgttgatggctgtatcagctcatggttgcactgctatcaagaaatacccaagactgggtaatttataaggaaaagaggaaaagaggtttaattggctcatggttctttcagtctgtgccagaagcatgatgctggcctctgttgggcttccggggaggcctcaggaaactttcaatcatggcagaaggcaaacaggaagcagactgacatggccagagcaggaggaagagagagggcaggggagatgcttcacacttccaaacaatcagatctcgtgagaactctgtcatgagacagcaccagggagatgatgctaaaccattagaaaccacccctatgatccaatcacctcccaccaggccccacctccagcagtagggactacatttcaacttgagatttgggtgggaacacagatccaaaccatatgagtggcactaaagaagacactgaagaacatcacctaagagccaggcatggtgggtcactctcacaatcccagcacttcgggaggccgaggcggatggatcacttgagatcagaagttcaagaccagcctggccaacatggcgaaaccccatctctactaaaaataagaaaattatatgggcttggtagtgggcacctgtaatcccagctacttagggggctgaggtggaagaatcacttaaactcaggaggcagaggttgcagtgagcagagattgcaccacttcactccagcctgggctacagagcaagactccttctcaaaaaaaaaaaaaaaaaaaaaagaacatcacctaagacattactttgaagaatgtgggaaaattgaagtgactgaaatcatgaatgaccgaggcagtggcaagcaaagggattttgcctttgtaactcttaaggaccatgactctatgaataagattgaagtaccatattgtgaatggccacaactgtgaagttaggaaacttcaaagagtgttcagtaaattcatccctgtcaaagcaagagaaggctagtgcttcattgagccaaagaagccaaagtagttctggatgctttggtggtggttgtggaggtggttttggtatgaactatgattgtggaggaatcttcagtggtcgtagtagctttggtggcagccgtggtggttgtggatatggtggcagtgggatggctataatggatttgtaaatgatggaagcagttttagaggtgaaggaagctacagtgattttggcagctacaacaatcagtcttcaaattttggacccatgaggagagaaaccttaggaggcagaagctccagcccctctggtgatgaaggacaatcctttgccaaaccatgaaaccaaggaggctctcgtggttccagtagcagcattagccatggcagtggcaaaaattctaattactgcaaagaaacaaagcttagcgtgagagagagaagtgacagggaagctacaggttacaacagatttgtgaactcagccatgcacagtggtggcagcacctagctgctacaaagaaaacatgttttagacaatactcatgtgtatggacaaaaaattcaaggactgtatttgtgactaattgtataacaggttattattgtttctgttctgtggaagtgaagagcattccaccaaagactttttgctgtgtgaaaaattcacttttagcgaccactttttttggttgtggctgttgttgttacgacaaatctgcagagtaccaagttcttgagactccaagccaaagggagcattacatttgccaagcagccactgtatgccaggagtacagcatctcattcaatctttgtatttctatgagatatatattgtaattcctggttcataacttcagtcaaccaaagctcagttgtatccagcaatgtgatagatgtctcccagatagcaagtagtataaccaagatttgagatcatgtgtctaatgccagaattcatgcactttccactatgtgaggctgcctcttggaatcagaggactattttggtttgaaacacagctttactatttatttagcactttagaaactctctgaccctctgttttctcatttggaaatgagaatgatgatacctgtttaatctatccaattcttgagagaattactcaagacagtgttgctgaaagtgctttgtaaattataaagagcatcctcaatgtgtggcatcttacaaaatttcattttgcaattccatactcgttattttcccagttcataggtctgtggttccattctgacttagagagcttgaggtctgtttagaattaaacagttaactttagaattacagttacctctcctgtgtgagtctagccttccctagatcctgagcctagctcattttaggggagaaatggcatttctaccaggctacatttccaatatcttcagttaacagatggagggtggcactgagctagagtaagttctcccatagttatttaaatcatcagttccttaaaaaggatcttagaattcattaaatattcatgaagcatccttcctggcagctagtccatagtaggtaattacatagagtttaaaatatctgacgttgcttggaagcacacaaagctctgtcagctgcaagcagacagctgatttgtaatttaattaacatcctggcttgtcctgttctttgtggaaaaaaagcaggaaagtatttcctttcacttttgagttttgtttaaaaaaaattcaaatggagcacctgggagagctttttatttctcccatcagtgctgttacttacattcttctccaaactggaaaaattcctctttcaagggttctttgggcaagccatattgctaattgtgggtcattgtttttttaaagggtgattattttgaagatagatctggctgcaaagtacttacttattcaacaaacatttatcaagtaactcctatgtggcaggcactagaggtcagcagtaaaccaagcaggtggggcccttgaccccatggggagaggggcggggacggttagttcagtggaggagacaaacatccagcgaatcatcacagaaataaatgtaaaataaaaatgtgccaaggtttatgaagaataaggacagggtgccctgaaagcctatgaagcagggagcagtgtgcggtgtgcagaggcagggagagaacttcctaatctgggaagtcaggaggtcaccttgaggaagtgaaggggaaaattatgtagtctctcttgcctttcctcctcccatttttctcctatctgaaactacctacctccacccccagatttgcaacctatatgtaaccattctgaaagaatggattggaataacagaaataaaactgtgctccagtcaggatatcattcagagaattcatttcaaattaaagaaatgaatataaatattgatctgatcattgcactgaacattcctttatcttctcttgttttcttttttacccatgttttccctccagagaggaaggcagtgagtaggagtgaggatgcagtaggtatataaaagtgatgagacacaggtcatagataggctgaggcatcatggaaaaaggaagaagctggagaaaaggatttgctgggtacagactgcagaaatccctaaaagtaaatgtcaaagtgtttaaacaaatcattgttctcaaaataagaaggtggctggcagggcctagatgggaatactcaattatggaacttaaatttctacagccttgagatgaaatggaaattttttgttttcacgtggttcatcattgagctcgttttctttgtccttttggttttctgtttttttctgagattcacttacctcttccttagggatccctttgaaattctgttattattattattttgtttttaccaacttcttgcttctagaatatgtgcttcctttcagcccaagcacattttttaaattaagaggctttcttccagaagcagcactcaatcagtcaacacaggcctattggacacacactatgtatgtagcattctagcctgaccactctgcaggatacaaagatacatgtcagggttcttaccctcaaagaacttggattacagagggacagataaaacttgacacagagaacatggtttgtcagtatagttaacagagacagtgaaactaacaagttttttaatgtcaggctttgtgtaaggaactgtaattattacttaattttatacctgcttcataatgctactatcagccttaagtgggataatttctgtgacattcttagcaaagcgttcatggatagtattcactattaggtatgataatatgccacctattcatgtgcacacaaacatgttctagctctccagcttttgatttgttccttccccctctctctctttctctctctctctctctctctctcatcagtactgtgccaactcctgctacaagggggaagtagagcactttttatgaagcaacagaggtaaactcagatttttgtttatgaaaccttgaaatatttccaatttctggatcagttatcatgcactgtgccagcaaaatgccatcttccaaattgcaccagagaacctccagtgacagatcaggcacatgtaagattccgtttttaaattctgggaaactcaggatggtttgttctgactcacacaagcatcagcagaatgtactgagcagagcctggtcagacttccttagcctttttctgtctgtgtaggggggactgtggtagaaaatgagtatgagtataactgcgtgcaagctcagctgggagggctttctgattatgcggatcatgttattgctcagataattacagtttaattcagttaaacttacatttactgatctctttttatgtgtcatttgtcggttgggcattggagattcagagatgaacatgactctacctctgctcttgaggcatttgtgggctactaggggagataggcacatggagaggtcattacagtataaagttcttattcattgacaaaatcctgtgcagaacactatgggagcataaaagagatacagatttccaacctttgaagtcagagaatgcttctgaggaggcaacactaaatctgataatcaaggacctaaaaaagtttgcttgatgaaggaatctggggttgggggcagggttaagcttcagaacggggacggggatagaattccagaagtcaggggcaaaatgaactaagatagggagacataagtagtataccaggcatccctgtcttgagcacctatcctgcctctactccccttagagctgaaacaggaaatataatctgtttacaaagtttctttattattattattattattattattataatacttcaagttctagggtacatgtgcacaacatgcaggtttgttacatatgtatacatgtgccatgttggtgtgctacacccattaactcgtcatttacattaggtatatctcctaatgctatccctcccctctccctccaccacatgacaggtcccggtgtgtgatgttccccaccctgtgtccaagtgttctcattgttcaattcccacctatgagtgagaacatgcagtgtttggttttctgtccttgtgatagtttgctcagaatgatggtttccagcttcatccatgtccctacaaagtacatgaactcatccttttttatggctgcatagtattccatggtgtatatgtgccacattttcttaatccagtctatcattgatggatgtttgggttggttccaagtctttggtattgtgaatagtgcctcaataaacatacgtgtgcatgtgtctttatagcagcatgatttataatcctttgggtatgtacccagtaatgggatggctgggtcaaatggtatttctagttctagatccttgaggaatcgccacactgacttccacaatggtggaagtagtttacggtcccaccaacagtgtaaaagtgttcctatttctccacatcgtctccagcacctgttgtttcctgacttttaatgatcgccattctaactgagtgagatggtatctcattgtggttctgatttgcatttctctgatggccagtgatgatgagcattttttcatgtgtctgttggctgcataaatgtcttcttttgagaagtgtctgttcatatcctttgcccactttttgatggggtttttttttttttttcttgtaaatttgtttaagttctttgtggattctggatattagccctttgtcagatgggtagattgtaaaaattttctcccattctgtaggttgcctgttcactctgatggtagtttcttttgctgtgcaggagctgtttagtttaattagatcccatttgtcaattttggcttttgttgccattgcttatggtgttttagacatgaagttcttgcccatgcctatgtcctgagtggtattgcctaagttttcttctagggtttttatggttttaggtctaacatttaagtctttaatccatcttgaattaattttggtataagatgtaaggaaggattcccgtttcagctttctatatatggctagccagttttcccagcaccatttattaaatagggcatcctttccccatttcttgtttttgtcagatttgtcaaagatcagatggttgtagatgtgtggtattatttctgagggctctgttctgttccattggtctatacctaccatgctgttttggttactgtagccttgtagtatagtttgaagttaggtagcatgatgcctccagctttgttcttttggcttaggattgtcttggcaatgtgggctcctctttggttccaaatgaactttaacgtaccttccatgctcatggttaggaagaatcaatatcgtgaaaatggccatactgcccaaggtaatttatagattcagtgccatccccatcaagctaccgatgactttcctcacagaattacaaagtttcttttactcaagtccccttcaacagaccaagctgaggagagaaaaagaagaaagcacagactgcaatacagaggccttctgccaatggccctcattttgtaggcaatagagaaatcctcaaaggtgcccagaatgacattagtacctaccagacaagccttggaatgaaaagtttgactcagaattacccagaatgttagggttgattcttagtcagggtgtaagaatatttcctaaaaattttatttcctgaagataaagttgtcctctaaagacctttgagtcctaactaacttagaagactaagtgctctttctctagagtgaaattaacatgtatttgaaacctggtttgccactttccaggtatgtaagcttagaaaaatacctaattatctgagtctaagataaagagaataacacctatgtctcatatggtgatgatggatataaagcatttaatatggctccaggtacattaactgtagctggtattattattggttgtaatattgcattagtgttaggattagcattaatgttggtgttaatattaatcctagtgttataaatcagtacctttgttcagccaaaggaaataaagatttgaatacaagcagagaaattctgctatatcatatcagggtgattcctttggaagcttgagtttgagttaaagatgtgactttctcatcagttcttgtcatttcttgcttagtcataggctgaagactcaaagaaaaaaaaacacgggaatgtctggttggcactgggcagagtattatttaggtccacggtctcttggatgactccctattgtctacagtggacaccaatctgccttccagtctcctcctgccacactgtaccttacatcccaagcttcatccaagtcttacatcagctcactagaagcagacctaagatgagatttcatgtgtgcatgatttatggagggcagttccaagaaaaaaaaaaaacatagggagtaagggaagcacaaaggaactgtgcagaaatataggttcaggtacagtctaaatttaagctaatctcgctggatactttgtagtgtaattcacatcacgggatttgtctcaccgtgaggtatgagagttggggttcaaatatgactcctgtggacatccaagagaggaggcttcaatcacctaagggtaatgttcctgaaaagtatgcagatatgagccttcaatgggtaaaaaagatttccatgaatttggatggggacacaatagcatctgctacaatccactttaagacctcactgttccctcaaacatcatcccctcttaccacatgtctcttcacatgttgtgcctttggctggaatatcttttacctctttatggtattccagaccctgtttcaaactgagaagctgcagccagccagccacaaatgcttgcccatttctgctcccacagaactgagtttatcacgaggtatggtagcttatctgtgcacaagtataactcagtaatttatggtcttcttgaagtcaagggttgttcttttcagttcatattcttagcatatactgaaatgaatgatgaggagaaagatatgtagtacttaatagcctgatgtccttttagattgtgtcaagcaaatgatgtgattgtcctttttacttgaacctgagttcacagcattttatagtgaaaaagttttcatccagtagccaaaatagtattgtggcttaagcaagtgatatctatttcatccatttgtgtaatggtagctcatggctatattcaacaaacacttattgagcatatgtgttgtgcatatgactaaagactggagatgtgagaataaacaataccaatgtggtcccagtccttacaagattttacagttccgtggaaaaacacagaaaatacacaaccatatagcatgacaagagttgtaattggagactctagggagttatgggaacatgcacatgaagaagttctggagatctgttgcacaacaaagtgaatataagtaacactactgaaccgtatacttaaaaatggttaaaatggtcaaaattttatgtgtattttaccacaaattttaaaagaagcttaaaaatgagactcaatagtttgtttatatttattttataattattggagtgagaatgttgagaacaaaagtaattcagggctgggtgcggtggctcacgcctgtaatcctagcactttgggaggctgaggtggacggatcacctgcggtaagagttcgagaccagcctggctaagatggtgaaaccccggctctactaaaaataaaaaaaatagccaggcgtggtggtgcccgcctgtagtcccagctactcgggaggctgaggcaggagaattgctcgaactcgggaagcagaggttgcagtgagctgagatcgtgccactgcactccagcctggggtgacaagagctggagtccgtctcataaaaaaaaaagtaattcagaagtaatgggggttcagcatatatagtagtagggttatggcagtgtaagaaagcttgtattctgtcctgtgggcagtgtgagccattggaagttttcaaggaggactttatcagcatgtgattcacaaagtcccctggatcagtgtagagaatttatgggaaacgggcaaccccacagacaggctagccagctcagaggctgtttctatagcccagctgagaacttatgggatcctgaacatggacagtgttggtgggggtatgggaagaataaggagagtgtggactcaagtattatttaggatataaatcaagcagactcatcaacttattaaattggcagatggcagcaggcaaaagacaggatggagtctgattgactcctacttttctggctcagatgacaacatagatggtagtgcctttatgagagaatcaaaaatgtggagcagacgtgggagttaatgggttgaaagccagagaaactaaaatgggcgcaagtgtgacactattccactcataatgggcgtaactgatcaaaagtgaatgttaaatttgatccatgtttctgaggcagattacattcccaaattattcataaggttagataaacaaaagcatggtatttgcagttcacagaaatgttctaacctcattgtgtcgtgtattctcagtgatttttttttttctactaagcagccaattcagttttcagacttggacttcatctctttatggggtagaggagaggctgatgataactgaaagaggattcagactgcaatgatctggatagggtcttggcgcttatgcccgtcagttaaggtgactcttgacaagtaccttaacttcttggagtgttagttttctcataggtaaaatggccaagaatgattgcaatggaacaagtttgtgagagttctttggaaactgcagttatggcattgttatttttgttgagagagatattacttgggacattgaagaaagcctaccttgccccagaaagtataagtgtaagtattgataatctgcttctgaggaagagtgaacaacagattgaattaccatccctggagtggttcttgttacttttccactatgagtcagtctgagagctgatgtcctagaagttttatatatatatgtatatgaaaaaattaaccattgatgataacaataatgggacactgggaagaagttagacatcacaattaagcctgtgatggtgttatgacaatgtttagatccctgttcccaatatccctgtgttatgcacaaggaacataggcaaagtaaagcaaactaacactttattatctgattaagaggtcagatgtagagggttccctttcttctttcccaggtaggacaacagccttgaacaatggaactctaaagggacagatccaagggaaaaggggtacaaactagaaaaagacacagaaataggatggagacccaggctgaggccaaaaatggagatagaccccaagaagagggctgagttccctcagagcattcctaaccctgaacctttttttttctctgccaacttccttatatctgtttggaagactcaaacaataatctttactggtacagtcatgtgtaagcaagatggttaagaaaagaggaaaagggaacaagagagaagaagtatttacctctgtcccctcagggagccatacaatataggcagataacttgccttgatttttaaagttctttaaaagagctagctctgcttctaaaaattgtgatcttttgtcctggaatctgactaacccaaatcaatactccttctcctagcgggtgaagtaaagaaagataagcttgtcttctctttgagtctaatacaaataatgtgggtgacaaaattttttcctcatttcaaaaggaacttaaatcactcacaaattctgaaggaaaattaagttttctaaatgggatatattggaattctgttttcttcttgctcagtactttttttcttctccatccataacctagaatttttaacacatacttagctactctggtcaggagggttacctcctcacttacttgaataaagtaaatgttctgtctcatttgttatcacctttctgtagctcataaacaaagagagtatattatcaggcagaaacaagtctggacattggtcaatattcgtggttaactcagttctgcttgcatttgacctggtctatggtgaccgccagaagagtctgcagcaaagcccatttggtgaagtcaacagtaggtgcacactgtgtcctattgatgaagttagaatatgaagttcagtctatatcctttacaaacactgatatatacatacttgtcctttcttttcttttctcctagaagtatcgatatcaagatgaggacgctccacatgatcattccttacctcgactaacccacgaagtaagaggcccagaactcgtgcatgtatcagaaaagaacctctctcaaatagaaaatgtccatggatatgtcttgcagtctcatatttctcctctgaaggtcagttatattgctcttccgactttatagttggtgacagtagttggtcttaattgctaatggagatgtttgctggcccgattaaatgaggctcttttaaaacatgatagaggacacgggttgccaaagggtctttcttgtgcattggaggcccaccttgtatttttgggacatatttttattgcaattgtttgaatatctggaaaaatcattttagttgctgagaatggagtaaagaaagcgccaagagtgaaacactgaaagggaaaataagctaaccacatatttttaaaccccaagtacatcaaggttttgctcagatgctctctgtttgtcagtactcgtggtccaacaaagggaacaaatataacatgatcacatctaatgattgctttactgtctaaactataaaggaaaatgtgtgaattgtctaatcaattcctctattttatcctagagaaaattgtttactagatttatttcaattcattgtcatacttttcccaacactttctactttttaaaatttaattttaaacaattgcttgataaattatatttcgacaagaagaaggtataattaaatgagaaaaatacttttctatgccccttggctgtgcaaattactctgattttttttttttttttttttttttttttttttggctgaactggcgctactggattttgtgtttgggataaaaagcttataaaggttgattaaagtttaaaaagaaaaaatcagaatatggctgaaataacagaattgaaatggaaaaaataaaagcacctaccaattaactccttagtaattattgctaaacaaaaatttctttcatcaccgagaacattcattttgccagcacttctacacagctgtgctacaataaaaaataaagacataaaagtgtctcccgtgttctctggatcttattatacctgcaaaaacatctaagagaggttaacttatgcttaaccttacgtttcaaattttggaacatttcaaacatattggtatgctaaaaatgtattagcaaataaattagctatagctactaccaatacataaaaatattagaccaattatcaaattccagtaaatattatatagtaactaaaaatatgtaaatattaatattatgcttctgggattcattgtgcaaatctccgcaatttctttgcaagtatttggatgactggtggaaatgagtatgtttaacctggagaagaaaagattaagaattgggggacatgggactaaaccttttttacctccagagctgtcatctgaaaaacacgacatcgatgtcatgcggaaggcagaagcagatccactgtgcataactgacaggaatgtatattatatttgggaacattttaacaccacagctcctgacatttatagctactcagaaaaattatagactacttcatgagacagaagttccctatccctagaaatctttcagcaatggataatgactcgtcagaggttttgtagaaaagactccttcttccgcagaagggtaaacaaaattgtctttaaggtcctgtttaggaatcagaattctgtgttcagtatagaatcttgctgattcctagagttagacagtactctttaatattttctaacaattgctgatccttactctgtttacaaaccactgaaaattgagaaagggcagggccgagagactgaactgcattgaaggtacttacatttcagttttattctttcaaactggttgaaaaactccctataagaacctccatagatcaagcacagtggcccgcacctgtagtctcagcattttgggaagctgaggtgggaggaccgctgatcccaggacttcaagaccagcctgggtaacaaggcaagaccttgtctctgcaaaaaatttaacaaattagccaagcgaggtggcatgcaagtgtagttgcaggtatggaggagtctgaggtgagaggatcatttgagcccaggaagttgaggctggagtaagccatgatcacgccactgcactacagcctgggcaacaaagtgagaccctgtccatgccacaacccccaacacacagatacacaaaattcgccacctttctcccttcccaacctttcctccttaatcacctctagagcatacctcccaaagaactttaggctaagtaggtaggataatcaaggctagcattttatatccttctactagaattgataatatggtgattattagtattatatttaagtcaactaataatgatagatgaaatatttgaaataagtgcatcttttgtcttatgagtaggatcatgcctgaaagtagtgagattccttgtgttacttctgggattcaaaaatggaatagggagagtccaaattttataattagtgctattataattatgagggatgctagcccggttacagtaaaaaaaaaaaaaaaaaaaaaaaatgaacagaacaatgaaagcaccatgggagctttgttttgtatattaagtcttcagcatatacatgataatataattatctgaacatctgctgttttggtgattgcaccatcatttattatgctactcactgtctcatttggaaaatgtatatcagagttgaggggaaagtatgctttttctaaagctcagatctcatataaacaaaggaatttttcctatttttcctttatcctttgccttccaggaatcttaaaattaactgtattcaacttcaatgggtttctcttagcctagattttctgttatatttatgtcacttctaactaatttcctagccttttattgagggcacctcatgtcagttttaagaacagccaactatgaatagcaggcccctgggataaaacaccatggtcctaatagatttttctcctttttggaaccaccagttctgtggtatggccccaaggtattgtgaagaggagggaaagggaagctcatcaaggatttctacactggggctgtgaggtagctattttgggaccaggatttttttcatcatgaccttctcgaggtgttgtttatgctaaacaagatgtgtttgagtttttatttatttatttatttatcttaaacttgtattataggtacagtggtacatgtgcaggtttgttatataggtaaactgcatatcatggaggtttggtgtgcagattatttcatcactaggtaataagcatagtatcaaataggtagtttttcaatcctcaccctccttccacccatcattttcaagtaggtctcagtgtctgttgttcccttgtttgtatccatatgtactcattgtttaggtcccacctgtaagtgagaatatgcagtatttggttttctgttcctgtgttagtatgcttaggataatggccttcggctccatctatgttactgcaaagaatatgatctcattctttatcctttactttcttttttttcttttcttttttgaaacgaagtttccctctgtcacccaggctggagtgcagtggcacaatcttggctccctgcaacctctacctcccaggttcaagtgattctcctgcctcagcctcctgagtagctgggactacagatctcctgacctcgtgatcctcccgccttggcctcccgaagtttttatggctgtgcagtattttgtagtgtatatgtaccacattttcctgaacccagctactgttgatgggcatttaggttgattccttgcctttgctattgtgaatagtgctgcaaggaacatacctttgcgtgtgtcttaacggcagaacaatttatattcctttgagtatatgtccaataatgagattgcttggtcgaatgacagttctgttttaagttatttgagaaattgtcaaactgctttccacaatagctgaaataatggtattcctaccagcactgtataagcattcccttttcactgcaacctcaccaacatctgttattttttgacgttttataaaagccattctaactggtgtaagacggtatctctttgtggttttgatttgcattactcaaatgattagtgatgttgaacattttttcatatgcttcttggctgcatatatatcttcttttgaaaagtgtctgctcatgtccttttcccactttttttaaaggattgttttttggcttgttaatggattctgaatattagacccttattggatgcatagtttgcaaaaattttctccaattctgtaggttgtctatttactctgttgatagtttcttttgttgtgtagaagctcttaagtttaattaggtcccgtttgtcaaattttgtttttgtcagaattgtgtttgacatcttcatcatgaaatctttaccaggttctttccagaatagtatttcctaagttatctttctgggtgtttatagttttaggttttgtatttaagtctttaatccatcttgagttgatttttttgtacgtggtataaggaaggggttcagtttcaatcttctgtatgtgactagccagttgtcccagcaccatttattgactagggagtcctttccccattgccggtttttttccactttattgaagatcagataatcgtcggtgtgcagcattattgctgggctctctgttctgttcccttggtctttgtgtctgtttttctaccagtattaggctgttttggttactatagccctgtagtacagtttgaagtccaagaatgtgatactcacagctttgatatttttgcttaggattgccttggctctttgggctctgttttggttctatgtgaattttaattgttcttctctaattctttgaagaatgtcattggcagtttgataggaatagcactgactgtgtaaattgctttagggagtatggccattttaacaatgttgattcttcctatccatgagcacagaatgttttcaatttgtttgaatcatcttggatttccttgagcaatttttttgtcatccgtgttgtagagatcttttacctccatggttagctgtattcataggtattttattctttttgtggctattgtaaatgagattgagttctcgattttgctctcagcttggatgttgttggtagataggaatacttctgcttttggacactggttttgtatcctgaaactttgctgaagttgtttatcagatcatggagcttttgggtagagactaaggggttttctaggtatagcatcatatcatctgcaagcaggaatagtttgatcccttctcttcctatttggatgccttttacctctttctcttgcctgattgctttgtctaggatttccaggactgtgttgaaaaggaatggtgatagagggcatccttgtcttgttctggttttcaaggggaatgcttccaacttttgtccattcagtatgatctgggattttatagctcaagatatgcttttagattgtcttagtaaagacactctgtgtatctctccttcaacaccaatagtaataggaataaatgtgtaccatttttctaggggaaaaaaaaagtccgttttaaggttggccaattttgtgatgtaaatattcccagcctggctgatttcaggctaccaacctaaagctactttttaaatatgtggaaatggaggcacatgaggctctcatgagctagtacgagtgagctccagcacagtactgtgatatcagattcaagcactagcatttttatagcaataggatacatttcctaatcaagttgttattatcacagttcaactgttgaaaaacttgcaatgattaaaatctaatgggttattttctcataaaggaagcctgttagaatcagggaactgctaaaaaggtacaaggtctccattagaactgtcatattttcaacttctttgccttcttttatctgtctggtattcttgggtcaaacactaaaaggaagaaaaggaggcaaaacacataatcagatgcttcccccagaatcctactgagaaaacaatgtgactctagtattaatggagaatttacatatggcatgcctaaacagagtgtgagattgctggataacagtttaaatgtcacattgagtgggctctgaatcattagctgaataatctcactgtcacaggtttgagtatcattttctccatcgtcgtgtattacttgaagccttggttctaagattcatctgtctttggtgcacaccagctgcctaagtgataggatgggctttcttagcctgttttcattagagtgctttggccagtgtgaagtgtgggattggaaagagaaatgcaatttagtggtgaattcaagggaatttgttttcctttcctcaaggtggggatgcattctcttcagatgctacctagaatctttcataaaagaaattggcctataataaaccacaagaattttcttttcagtttaggtcttctcactttaggtcagttcaataaatattaactgagtgcctactatagcactaagtaatggggaaacaaagagcagtgaaatgattttcagtacctagattattctcttgattcataattaattatttgttacttattattattccgaaactgaaatttgaactcctcaaacttaaaactatggggcccaagcacctaccagagtgccctgtaggagtatttattagcgagagagagagagagagagagagagagagagagagagagagaaagggagggagttaactgctgtcctcttcttccttacctaatcatcacttatacaaaatttcataaattctaaacttcatattttatcacatattaacatatctgaaatctggatgtgtcttaagatcaatggcatcttgcagttaaaattggcagtatttcctagggtgtattaaaaaagaaatgtgtcttgcagtcaaaaccggcttagattcttaggttcagtaactaattacaaggaagattaaagcctccttttataaattggtgtgaattactttaatcagataaatattattgtgtgtcttcgaattttcacagggactggaataaacagttctgggaagctttgctggaaattaggagtatgtgaggtttgggtaaacttcaataccctgagacaactgggcacttgttgagtatatatagaagacatttgagaatctgtaggcaatgcacatttgagaaattataggaggagagctgaagcatgaagaagccaataaaaaaactatagacaaaggataacaatgtgtatttttatactattttcttactagagttgccagagcacaatcataggaaagtatgttttagccaaaagtacaataaaaaccctcttcctacataaagcctttcctgttaactcttggccaaccccgactggtcataagatcctatggcacaaggagttagtgcatcccacatagtcatcattttaaaatatgccttattctattgttctaaaaattatttgttgaactatacagtagtccccacttatctgtgggggatgcattttaagacccccagtggggccgggagcggtggctcacgcctgtaatcccagcactttgggaggccgaggcgggtggatcatgaggtcaggagatcgagatcatcccggctaaaacggtgaaaccccgtctctactaaaaatacaaaaaattagccgggcgtggtggcggatgcctgtagtcccagctactcgggaggctgaggcaggagaatggcgtgaacccgggaggcggagcttgcagtgagccgagattgcgccactgcactccagcctgggcgacagagcaagactccgtctcaaaaaaaaaaaaaaaaaaaaacacccccagtggatgcatgaaactgcagatagtaccaaatcctatttatactatgttttttcttatgttttcataagtatgttatcacataattaaatttataaattaggctcagtaagggattaaccacaataactaataaaatataattataacaatatactttaataaaagttatgtgaatgtgctctctctctgtctctcaaaatatcttgtagtgtactcacctgttttcaggtcatagttgacctctggtagctgaaactgcatgaaaagtgcaacctaagatcaggaaggactgctatataatgttctttcctctaggtttgctgtttttcttgctcttagtaaatgtgtaagctcccaagacctggactgcatcttatttttgttttgttttgcttttcattttactcccttattggaatctaaaatgaaactagactagcatctcccaaagtatgtttggtggaattttgtcagcattattaaaataaaggtatgaatgagtgcttaaacacatttgaggagttaaatccattaacttattgaaggatttctcagagcctttactataataatatgaaatataaacatctaagatggaaatatgattagtacaaagtatttcccagacatattttgtcatagaattatttctttaatataaaattatattttggttgggcacatatacttttggagcgtacaataaagaaagtgtgaaagaagaggtctctcaagacgtagaaaaactgtttaattttttggagctggagaggttaggatgggtgttgtcagagaaaaaaaattatacacgagatcattttttacttgaaggaagtatgaaataagggagaaaagtcaaggttgccctatactctagcagttgtgtaacagtatggaaaagttctgagaattgccaagtagttggctaggatactgacgcataatgtaagaattaaggaaaggggcatagagtgggcccaaacatcccataaagcaagagagatgggcatgaacaggtaatgaaggaccttatgtagagactggacttcaccttgtaggtaatgaggggtgactacagaatttttaaaaaggagaatgacatgacctgatatgcaaattagaccgttattcatgtcatgtggtacagtggaaggaataattggaaaggtatgacatcagattcaagagcatcaggtgaaatgtaaaagatagataagctttgatgtaaagcagaggtattggggttgaagggaaggatagattagaaggcttatttaaaaagagatatcatcaggacattgagacatattacatatagaaggtagaaaagagagagaaatagaagataatttacaatttttaaaatttgaccccagagtagaggatgtatcatgaaatgaaaccaagaatgccagaggaagagcagattttagaatggcaggggagggagtgggataatttctgagtttatgttggagtaactgattttgaagtatttatgttatacccaggtagaagtgtttaacagtcagtttgaaataaagatctgatctagaaaatggaaactttgacgttttcagtgtagttggagttgtgaaaatggatgggattgctcaggagaggggagaagaacacagaggactgaaacacaggtccaccaccaccatatatgggctttggggagagagaggtacctaccgaggataacatgaagcagtgagaaatttaccacaacatttagcccttagtagcttggagcttctattttcataactaagttatgaacttctactaaaagggagtcatgtcttttaaatacagaaatttgtagttcctctacaatgcctaagatggtgttgaccaaatagcagatgttttaaaatacgtatttgattaatttaaaaaaaaaaaaaaaagaaataccctatgagttacatttgaccccaacagtcatgaggccctgaccagcaactgaaaataatgtgtttatttttcctttctagacataatgtttttaataataccactgattagaaaactattctgattcttgatattttaggcaataatctttaaaagtgtaaaatcctttcatttctatctcttgccactagatggtggaagtagctgagatgatcatcctggaagcatctagtcttgaggaagaaacagatttgtgaagctaaattagaagctcttagttaataaaaacataaaggtttggcagagatttgtgacttgtgcacagcacattgtgttccaggactagtccctggtgagaggaaatggttgaaatatggccttgacagacgcattctgaatgtaggcacaaaatctcctgatcgaaattccatgcaaataaagcattcctttcctcaattatctttaactggaaagggtacaaacagcatacccccaataattctggctatttaggccagatattgaaaagcgggaagaaaggaatgttaggcataggactgaaccagcatctcaaaatataagaattctttttagaaccaaagtcatcaagggttaaggcaagcttgtctaacctgcagtgatgggccacctgtgactcaggacagctttgaatggacccagcacagattcgtaaactttcttaaagcattatgatattttttgcagtttttttttaagctcctcagctatcattagagttagtgtattttatgtgtggcccaagacaattcttcttcttccaatgtggcccaaggaagccaaaagactggacacccatggaaggggttctctctatgggttttgaaagatgagtttgtgtgatgaaattcaaattttctacttcttttatgtacatagtattaataacaataatgatgatgaattttttctaagaaatattaggttattaaaatcataataagttttaaaaataagtgtttatagaaaattctagataagtgttaatagtgattatatgtagctgcagatatttctagagttaacccagttacacagaaatttttctcaaaactaagatttcactattgccaaaactttctgtaacaattagaaataatgtactaacactcacagaggctgctcatcaatataaggcacttattgttactgtggttaaagatgatattgttagtggtaccctaaaatgatacgtaacttctacatccctcccatatttctaaacagtctggaattgtaaccttttggtgagcatgttttcaattcttttttcttagcaaagataatcggaaatttttccaaactctgcaaaaattaattctgagactgttagtgctgttgaatttttaactctttcccagctaatccagaaaagtaatagcatatagtggaaagcagatgggctttagaatcagacttacttgtgtttacaatgtagcttagttgctttctagctgtgtctattagtaaatctattaacttctaacctcttggaaataatagtatggaattcacattccatgctgtaaagattacttgagataatacgtggaaagtctgtagtacttggcgcctagtagttgctcagtaaatggtaattatttcacattaaaaaaatagaaagtgtgtatgtatctaagaacaaatctaaatttaagattagttaactctttgagctctcagtaatgattggaaattgttaaatcctcatccttgatgtccttcagagaatagttttacactgtagaacattcctatctcagctaagtaagggtgtgttattcaaattattatctcttctgcaaaagtgaatgtcatgttggttagctcaaattgtagcaaatgagttggggacattttgagtggtccaaacaagaatttactaaagcataaagaaatggctttcttttgaggctagtgatggaagatattggaacatatgcataacctttaaagataatcaggatgtgcaaggatcatttagtggacagaagctatacagcaaaacacttatttcatcttgtttaataagtataaaaatagtccagaaggcaatttttaaatgcgtctattggtatatacaaaggaaacttatgtaatcttatataagacagaatgttgtacaagaaaacatggtagagaaggttgaattgattttctccaactcagagaggaattgccagtgtctagcaatcagatttaatcctaatgcagctcccaggatacattcttccagtccagctgactcaccaaagtcactctgaaggcagatgatttgttccttctgaattggcagaacactgagtatgttagagtttgtggccaattttgggtcacaggtaagttcatttaaaatgcattcaagagacagttactgaagttcctttacatagaacagaacaactccccacctcccaccttgaccttaaggcccattaagcaatagggcacatacagaagtaatgagacaaagttaacttgaaattacagtaattgaagttactctagactggtgttccagagattttctggtttcaggactggtgctttagagattttctagtttcactgcttcatattacatgtgaataaattttttcttttcttttctttttttttttttgtttgttcgtttttgagacagagtctcgctctgtcgcccaggctggagtgcagtggcatgatctctgctcactgcagtctctgcctcctggattcaagtgattcgcctgcttcagcttcccaagtagctgggactacaggcatgtgccaccacgcccaactcatttttgtatttttagtagagactagagacggggtttcatcatgttggccaggctggtcttgaactcctgacctcaggtgatctgcccaccttggcctcccaaagtgctgggattgcaggcttgagccaccatgcccagcccaaagaaatttaatttaaaaacttgtttctgatggtagtttattttctcagtggactataagacatattacctgcttttaattataaacaagcaatttaaaactatttgaaatatcatttccaaaagtaggttttacttctcttataaacaattaaagctgagctgccgctactcattcaacatatttatatgaattagaaaatggagccccttctcatacaagatgataccttgctttagtttagataatgcgctgcacagacccaggcaagaggcttttaagttcagcaataaattccttaaataatcagataacgcaatatccaataggaagcctcatagaatcactagacttacatctcagcagaggcattaggaataacatattgtaattacttaattttacaaataaagcaactaagaatcacagctgttatgagactttcccaaggcagccacctagctaacactatagctgagacaggaatccgggtcttggattcctagacctgagtttatgtctctgtttcccaagaaaagtaaacaacaggtgttctcaactcagcagatcacagaggttcacttatttcaatttctaggggatgttattgaaaattgttatcactgagttattatttgtttatgccaattttcagctttagtaaagggccaaatctaggttgttgacgctagaccaacctctctcttcatcccaaatctctccaactaaactgtgtgcatcagattgattcagtaaaaataagtctcatcattatttaactcttctgtccatttgtgtacttgtgtaaattctgatgagatagttttgtaaaaagaaaatgtaaatgatttacatctcaaagactaatgtacatcgtagcaatgctattatttctctatgggatgctttcccagagctgcagggcagtgtgtgggataagagctaggcatggcatcagaaatgtgccatttgagaattcactgaatgctcctaaacctaatttccacatttatatactgatgataatagaagcacattgtgggaagtaattaagattaaggaggttatcctttgttggcttgaattttaccatctacgcttaaagaaccccttcttccacactcaaattcctgtgtggctacctccacctcaacttctatttccctagtccctattttccattccaccctctttttctcattcccactttctagaatggtcaatggaaaagtaagagaaacacatgataaagaaaaaggagctgggcagtgagggttgggtggtgggtgggggcgcagaggggaatgtcagcacacatttagttcaaggagttgtcagtatgtgggacttccaaacaaccaatgtaattttaggctacattaatggagttgcatgccaagaacaaagagatgacaattctacactatgctagaatgtatcattaggatctgaggaccatatttcagagagaatggcagcagattggggtgcttccagagaggggtaaataggctggcaaggctattaaaaccatgtcaaatgggaacatcaaaggctatgagtgatgtggtccttggagaatagactcagctcacaatgacatggtagttcatctttaaattgtttaaaacaaagaacttgtccatacaatttttgtagacatcaagacctttagagtaaacaatgaaagaaaaacagagtttatgtaagttaaaaaatttttgttttaaataacttggtccaaagagagaatgacctgcctcataaggtagtgagcttcctgtcattggaggtattcaagcaaaaggtagaaaatcttcaatgagatattgtagagatgattcaggaaagagaatgttgaatagtattttcaacctttttccacacataaattactttgagaaattgatttgaaaaactatgacccctttccctagataaaaactatacccacaaaactatacccacaaaaatattgcataaaacttcagaaatgatatgaattacttgaagggcatctatggacttcctatggaacatagacttaaggttaggaatttctggatggaatgaatttcaagttttctttcatttctgagaaactatgattcctatttttctgtcccacagttactggctggttaaggaatgcttgtccttgagaataaatcttttgtaaattttggaaaaaataggaggaggcctcccaatctattgtgtctgtgaggcctgcccaattccacagcagccctcagcaggaaagatcaacaggttcccctagatgagaaggattttagggtacatttgcttcaggagggttctctaaatgcagaactgcttctgattccattctcctcagtatttttgatgtattcttacaaggcagttttctgtttattagttagtgccataagctttcaccatctattcaagccaagagcaataatatcttgtctctttgaatttgggttttaactgtcataaggctgttttctttatgcttgatggaagttgcattctagcaaagaactgatttcaaattgccccatcaacttgctaaaatgatgatacactttccatagaattctatcacagggagtttccaatatgtggctagactcttcatagaaatatcagtcataaaatgtgcactgggtatttattttttcatcagggtcacagaaatgcacctgaactgaattcttcttcttgtctctgtaccgttaaggtattgacaggttcagaattgctgggtttgaaattttaagagtagctaactcataacatttcactttctgctccagggcagggtgagttgcttataaatcagcctgcaaatatgatgaattggatgtctccaactcaattagcttaatgtgggtaggaggatttccaggctttatggtctctgttttactaatctactgagcagactgttatataaaatgtgtctgagtattaatgtctgaacctcagagaaatgtggttggtatttttcacttcagcatccaatgtcattctgtatttcatagctttgatttggatccagagctactgagtgatggttcttaacatgatttatattgttgcacgccttagcttgttatctttctgccttctgaccaagtttaaaaagtagcctaataaaattgctgctgtcactgggtgatttaattggggggaaaaatctcagcaatttaaggaaaactgcaaaactggagctattcctctgtcaaataaatgatcaaatgaaatgggcctcagcaaagcagatgctgacagttttgagagcttccgaggcacgcatcatacttcagttgtgagatctgttagaggaattgatgaggaagtttgtttgctttttgttttcttaaggtgaatatattggggccctgggaaatgtttatattgaagagaacattttggatgtaaatatattttgtgtctaggtatatcattcggcattttctttatattaactgtctatgaacactcattagctaaattattttctatgtattttcttcttccctcttctcttttttagtttctctgtcaatcccagctctgtcttgcacgttgttaaaaatttggtaaaactcaaaaatcattcttcattgcaaaaagatcagtgtgtgatatctgtagtagcctattaaactctttgtaggttctgaaacctttccttaaaagactgggaccagttgttacgttggccactaatagttttgctcagctgaagtctaactgaagttagacatgttattgaatttttgtattttcaaccctcgtgagtgatgatgtctcttgaaattatttattctgagtaaaattttgtatcctttgacaacatctccacaactcctcctcccaccaaccaccccaactcctggtaaacacctttctactctctacttctatgagatcaaatttttagatttcacataggagtaagatcatgctatatttgtctttctgtgactggcttatttcacttaaccaaatgtctttcaggttcatccatgttgtggcaaatgacagtatttcctttttctttgtggctaaatagcatttcgttatgtacatataccacattttctttatccgttcatccattgatgaacatttaggttgattccatattttggctattttgaataaggctgcaacatacatgggagtgcagctatatcttcaacatactgactttatttactctggctatatacccaatagttgaattactgaattatatgatatagttctattttcagttttttgaagaagctctatatactctttttcataatggttgcattaatttatattcccatcaacagtgtgtaagtgctcccttttttccacatccttgccagcgtttattatctttgtctttttgatgatagccattctaataagtgtgagatgatatctcattgtttttttacttgcatttccctgatgattagtgatattgaaaatattttcatattcttcttggccatttgtatgtcttctcttcagaaatgtctgttcagatcctctgcccattttttaatttggtggttttctttccgttgagttatttgagtttcttatatattttgaatattaattccttaacagatatatagtttgaaaatattttctctcattcatgtaggttgcctcttccttgattatttcctttgctgtgctgaagctttttagtttgatgcagtcccatttttctatttttgcttttttttcctgtgcttttagggccatatccccaaattattgctcaaaccaatgttgcgaatctttttttttttttttaggatagaatatttatttatttatttatttatttattttttatttttttacttttatcctttttttttttatactttaagttttagggtacatgcgaatcttttcccctaggttttcttctagtagtttcatagttttaagtcatgatcacagtaataagtacatgatcaagaccagttgatcatagcaaataaactttttaatgtactgctgaatttacattgctaatattatgttgaggattattgcatctacgttcatcaggaatattgttctgtagtttctttttttcttttttttatatatcatgttcttgtttggctttggtatcagggtgatgctgtcctcatgaaatgaatttggaagtattatctcctcttcaattttttggaagtgtttgagaagaattggcattaattcttcaataaatatataatagaattagacactaaaggcatcagattctgggctttctttaatggaagactttatactgattcaatctccttgtttttgatctattcaggttttctctttcttcatggtttagtcttggtaggttgtatgtaggtaagaatttatccattccttctaggttatccaatttgtccatatataatagttcataatagtctcctatgatcctttgtatttatatcagttataatatcttctttttcatgtttgactttatctgagtcttctgtgtttttattatacttagtctagctaaaagtttgtcaattttatatatttttttcaaaaaacaacttagttttactgctcatttccagtgtttctctagactctattttatttatttctactctaatctttctatttccgtccttttattaactttgggcttagttttttcttcttttcttgttcattgaggtgtattaggttatttatttgagatctttttttttgatgtagacatttattgctataaacttgcctcttaaaaccaattttgcagtattctgtcggtttttgtatattgtgctctcattttcatttgtctcaacagatattttaatttttattttaattttttaattaactcattgttcaagaacacgtttgtttaattttcatgtttatttgtgaattttccaaagtttctcccattattgatttctagtttcattccattgttgttggaaaagacacttgatatgattttagtcttttaaaatcttttatgatttgttctgtaccctcacacatgatctattttggaaaatgctctatgtgcacttaaaaaagatgtatatcctgcagctgttagagaaaatattctgtatatgtcttttaggtccatttgatctagagtatagtttgagttcaatgttcccgtgctgattttctgtctgaataatctctccattgttaaaagtggggtgataaagtctcctactattattaattttagtctggctctccattcagatctatccatatttatgttatatgtttaggtgcttggatgtcagatgaatatgtatttataattgttgtatgttcttgctgaattgaaccccttatcattatataataacctttatctctttttatgatttttttacttaaagtctattttatctgatatatgtgtaattcttcctttcttttgattttcatatgcataaaatatctttttccattccttcacttttagtctatgtgtgttcttacaattacttaaagtggggtttcgtaggctgcatatatttggggtgtgtgtgtgtgtgtgtgtgtgtgtgtgtgtgtgtgtgtatttaagttcattcagccaatctacgtaatttggttggataatttaatctatttatatttaagtaataactggtagataaggactcctcactgccattgtatgaattattttcttgttgttttgtaggtatttggttcctttcttcctctctcgttgtcttgctttgtggctaagtgatttctgctagtggtatgttttgattccttattttttaatttttttgtgtgtctatcatgtttttgctttctaattaccatgagacttattttaaaatgttacagttataacagatctttaattaatttttttatttttagtttttctgggtacacagtaggtgtatatatttataaggtacatgaaatattttggtacaggcatgcaatgtgtaataatcacatcatggaaaattcagtattcatcccttcaaggatttatcctttgtgttacaaacagttaagctctttttgttatttagaaatgtacaattaaatgatcgttaattctagtacccctgatgtgctgtcaaacagtattcttattcactctaactatacaactttggcatactttaaacatccccacctctcctcctcacccccacccctgccccaactacctttctcaggctttggtaatcattctcctactccctaaatccatgagttcaattgttatgatttttagatcccaaaataagtgagaacatgtgatgtttatctttctgtgcctggcttgagatttcagttaacataatgacctccagttccagaatgacctctattgtatataagtactacattttctttatccatccatgtgttgatggacacttaggttgcttccaaatcttagctattgtaaacagtgctgcaacaatatgggagtgcagatgttcctttgatatactgatttcctttcttttaggtatatacccaggagtgggattgctagatcgtgtggtagctgtatttttagtttttaaaggaacttccaaactgctctccatagtggttgtactaatttacattcccaacagcagtttacaacagtttccttttctccacatccccaccagcattcgttattacctgacttttggataaaagccattttaacttgagtgagataatatctctttgtagttttgacttgcatttctctgatgatcggtgatgttgagcacgtttccataggcctgtttgtcatgtgcatggcttcttttgagaaatgtctattcgtatattttgccaatttttaaataagattattagattttttttctatagagttgtttgagctccctatatattatggctataatcccttgtcagacaggtaactggcaaatgatttctcccattttgtggtttatctcttcacttttttgattgtttcctttgctgtgttgctttttaactagatgtgattcccatttgtgcatttttgctttggttgcttgtgcttgaggggtattattcaagatttttttttttggggggcctggaccaatgtcctggatggtttttttcaatgttttcttgtgatgctttcatagtatcaggtcttagatttaagtctttagttcattttcatttgatttttgtatgaagcaagagatgggtcaagtttcattcttctgcatatggatatccagttttcccaacacctttattgaagaaatccttttcctcaatgtatgttcttggcacctttgtcaaaaatgagtttactgtatatgtgtggatttgtttctgggttctctgtactgttccattggtctatttctctgtttttatgccaataccatgcttttttggttacaatagccctgtagtataatttgaagtcgggtaatgtgattcctccagttatttttctttatactcaggatagttttggctattctgggtcttttgtgattctgtttaaattttaggattgtcttttttctatttctgtgaagaatgtcattggtatttttataggaatttcactgaatttgtagattgctttgggtagtatggacattttaacaatattggttcttctaatccatacacatggaatatttttcattttttgtgtcctcttcaatttcttttaatttatttattttattattattttactttaagttctgggatacatgtgcagaatgtgcaggtttgtgcaggtatacatgtgccatggtgatttgctgcacctgttaacctgtaatctaggttttaagccccgcatgagttaggtatttgtcctaatcctctccctcccctagtcccccaaccccaacaggccccagtgtgtattgttcccctccctgtgtccatgtgttctcatcattcaactcccacttatgagtaggaacatgaggtgtttggttttctgttcctgtgtcagtttgctgagaatgatggcttccagctttatccatgtccctgcaaaggacgtgatctcattcttttttatggctgtgtagtattccatggtgtatacgtgccacattttctttacccattattcttggttgtcttttttttttactcagcactttgctatattatctgattttctcttggcctataaagtttctactaagaagtctgctggtagctgtattgaaactcctttatatgttatttgtgtattttctcttttgctttcaggatcctgtcttttttatgttttatagtttgattataatatatcttgtggtagtcatttgaatttttcaaagtcctagaaatccaaagatggttgagaaacaactcttgttcaaaaggagcttcaagtcagttgcagaataaatacaaataagtaagataagaaagtggaaacacacaggacagagttatagtagcctttaatttcctcagattctttcaaatctgatttttttaaaggtactgtcagttctattttgcctgaagtgctctctatgttcctagaagttcttggtaaatatttacattgtttactcagaaatctgtggacaggcagagacttgcatgcagaaaagctgaagaaagctcagcatgccacaaaaggtgctcaggtgtccttattgggaggggacaagttgttatattttcatggctttactgagaaatgcctattgcttttggaaatgccatgtggtctgttgcttatatgtaaaaaggaggagaaataatcctaaactttgctcgccttggctgagcaaaaacaaaatagggtagtagacttgtagcctttgaggaattcaaaactaagtttaagtcccagctctgttgtttgctaggtatgtgacctcgagcgtgttacctaattgttcttagtctcaacaaattcaccctacctcaaagggttgttgtgaggattaatacagtttgtaccaaattttaccaaatcagatatattgttttaaatctacattctaaggcccttttagttgtattgaatcagaagctccaagcagggccctgagaaccagcattttaacatatatgccaaatgagttttatcatcaagcaagtcttgaaagcactgaggcagagtatataaagaaccagccagttatccagcactcaggagcaccattagactcctcagtggttactttatcatttaagattgtttttgatgttagcattcaaataagcagtggattatttaggccctaatattgttgacaattagtatagtactcagcacttaagtggttattaatatattaagttgaatcacttaatggaaatttttgtggaacctaagtataggcattatttcagatgctgtagaagagtcaaaatatatatgaactctgatataacctgaagtataaatattatcattaattttcagtagtgcctgaagaagatattcattcaatttgtggtccaaagaaaagttgccatttcaactgaattaagagtaagtggggttatcaaatattgtgttcatttttattattcatacatgcattcatatttgattagtcctatattaaattgaagtaagaatagaataacattttactgtaccttaagaataaaatattatgaaagacaaaattagaaaaaaaaattccacacttggtgtcaagaaacttgatgtaagctgagcactataatcctctctttatgcattatcattttcccagcactctcatcaaactcattttatatattattattatctatttttctcatccagaggaaaccttctcaggaacagatatattttctccttctggagtctagttgatatttccttatccctaaaattccaaacattagggaaggatatgttccatgtaagaagttatcctggtaggggtctcctctttcggctttggagccctcctccctctgtccctgtatgggggagtttcttccttctcccttctcccttcatttgagcctattaaactctctgctcctccactcctaaaacaaacaaacaaacaaacaaacaaacaaaaaacagttatcctggtaacttaataataatttactcaatacaattcccattatgtaaggccatagagaataaaagatgaataaaacattgtcttccttcaacgaatgactgttaaatatcataattaattgtaaataacacaaccaattagcatttaaaaaatactaaatatgttccaagttgtattatatattacatacatttggatactattcctcacaacaattctatgaggttagtactattgttattctcattttacaaatgaaaaaaataaactatattacttatttaaaatcatacaaggttagtagtacaactatgttgttctgttctgtcttgttttgagttcttatatctatttagtgtaatttggagccaaacccttaggaatttctggcgctttcatttattgatagcatgattgggcaagattattgtttctaaactcacttttacttgtataaaatgtggtgaatatgatcttgagaattcttgggtaataaatgacatatgttaggaataaaaatttaaaatcatctagctcagtaactggcacatagttactcatcaaatgttatattttcctttccaattttgataatataataactaatacttcttttgacttccagaatggcaactttaccttattctaatttactgtttttaattattttctgattaacataataataataataataataataataataagtgaactcttactactttctgattgtttttaagatttcatttttatttttggctgtctgcagttttgctaaaaggcacctaggagtgaatttatttttgtttttgttgctttgaatttggtgtgcttcttcatatataaggtttaatttattttcttaatttttaaatttttcaaccattgaagtttttaataatatctctttccctttctcaattatctccttctgattagatataaattgggcttcttattctgtcttggaaatcacaatatttttcatatattagatcacattttgtttgtattttgtattctgcacaatttttaatttaccaattctctttcagatgtgaaaaaaattgcttctcaattcacccactattttgtcattttaaacatatagattttgtacttagtgtcaaattattccatttttattttcaaattctttgtaatttagtctttctatttgttgggtgggctgactcttcctcctggtggagcactttatcatgtagtttatgacttcttattgtgagttcaactttgatagaaactgttttatcagtggtaatttcacttgccatgggttggagaaatatcactagggaataattgcataattgcttcagctgaacattccaaaggtttcacttgtccagaaaagtagttttttacattaatttatcaatataagagatctcatactaaatgggaacagtaagtttggaatacatattcacaggagaaatttgcttgaggattgtaatttccttgaaagactttttaaatttaaagtagaggccatcttatttgttgcttcttaggacaaggtcacaggttttctaattccctttatctaaaggagacattttccagaattcagactttatgcaaggtcacagtttcaaatgtatgatatatctcttatcctcaggtgagcattaaaactccagttttgagttattacggtttatttagttcatatatattagcactagcttataagttgattgatctgccttcaggtgtctgctacatttctttcacccagagatttccaattcttgtgtttgcgctcagctatgtatttaaaatatttatttccacattttgtgcctaatttttatacattggtagtaagacggtcagtcatttatagaagtccatatagtccatattcctgtgttcagtcaacaataaccatttactgagcatctacttcacaaaggtactgaaggtacaatgatgaataaaacagaacaatttcctgtcttaacaaagtttacattcaagtgagagtagacagacaataaacaaataaagaaataatataaatgtcagatgatggtaagtgctattaaataagtaaataaataaaaaagcaatataatggccaggcacggtgtctcatgcttgtaatcccagcactttgggaggccgaggcgagtggatcacctgaggtcaggagtccgagaccagcctggccaacacggtgaaaccctgtctctactaatacaaaaattagccaggcatggtggggggcacctgtagtcccagctacttgggaggctgaggcaggagaatggcttgaacccgggagacggaggttgcagtgagctgagattgcgccactgcactccagcctggcaacagcgagactctgtctaaaaaagagaaaaaaaaaaaaaaaggtaaagaaagaaaagatagcatttgagcaaaggcttaaaaatgtgttaatcatgcacaatatattggagagagaatataccaatgaaagacaacaggtaataaaaacgccttgaggccaaactatgcttattatgttcaagaaacagcaaaaaagatcagtgtggcatatgaagaagacaaagtagtaggaagtgaggttataaaggtactgtggaagttaaaataggtagagcaggcagcacatgtgtgtatcataagacaaagtaagaactggtggtttcattcagaatgagatgagaacccagtggaaaactttgatcaggggaggaaaatgatgtgatttatattttgaaaaggattattttgactgctatataaaaagtacactgtgtctctatcaaagaaatcaaatattgtcaccttgtttgctaagcataaactagagcagaaaaagaatcacttaataaagtttcacatttttagatctgagattattttaaaggatgcaacaatcctcaacaaactagcaaactgaatccagcagcacatcaaaaagttaatacaccgtgataaagcaggctttattcctgggattcaaggctggttcaacatatgcaagtcaataaatgtattcaccacataaacggaattaaatgcaaaaagcttatgatcatctcaatagacatagaaaaaactttgaataaaatccagcatcccttcgtgatgaaaaactctcaacggactaggcatcaaaggaatataactcaaaataataaggttcatatatgataaacctgcagccaacatcatactgaatgggcaaaagctgaaagcattccccttgtgaattggaacaagacaaggatgcccagtttttatttatcagcatctagtactcagttttacaaaagtaagggctcaattttatctgtatatccagaagtcatcatgtttaaagtagcacttcatgttaaactgtttaataagtttttaaatctcagtaaatctcatcacttctcttcaaagccttcccagattcccacaaatattagttagctactctcctggcactttggtcacacattatttatttatattttagcatttaccatgctgaactgtgactgctaatttatgactcttttaactgtttctcccttaaactgtgaactccttgaaggtaggaattatatttgatttatttctgtatctgtaatagcactgtacctgacagtgctctatgaatattcattgacgatatgagtgaatgagtatatagaaacttgatgccaactaattaatctgcagtgagaaatagaggtgctaagctggaagaaaattttattggcaaatttatcttttcagtagaaatgtctactttggaaactaagctataataaaaggattatacaatgagcagaaaattagagcaagggaagtagaatgaccttagccaactaatacctttaagccatggttgccccatggttgtctgtccccactgaagatagactggctgaggaagcagagtcattgccagtagtctgctgacttatcatctcttctgggcagttcttgaggttccaacaaattcttacattttcctcttctttttttcagatactacacatataaatattattcgctctataatacccaccactcctttattggttttgtattgttactttaaaaagttaccacaagcttcatggtataaagcaacacaaatttattatcttacagtttgggatgtcagagtccaaaatggcccttactggactaaaatcaaggtatctgaagggctatgttctgaagccttgagggaagaatcagtttccttgccttttccagcttttagatgaagtttctagaatgttccttggcttatggcctctttgtccatctttaaaaccagaagcatagcatctttaaatttctctccgaagcatagcatccttaaatttctctccgactgtgcttccgtcctcacatatcttttactgactcttttaagaactgagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgcagtggcgggcgcctgtagtcccagctacttgggaggctgaggcaggagaatggcttgaacccgggaggcggagcttgcagtgagccgagatcccgccactgcactccagcctgggcgacagagctagactccgtctcaaaaaaaaaaaaaagaactgagcctctgtcataacattagagcaaactgtgtaacccagcgtaaactcgccatctcaaggtccttaatttaatcacatctgcaaagccacttctgtcatataaggtaacacagttacaggtttcaggaatttataaccttcaggaatgtggacatttttaggggaactttcttcggcctactacaacccagaaagttaagctaagatgtatgagattgaactataaaatacatcttacatttttttgtttttcattctaatcttgaaaatatacccaagagatttcttgttccccatatgtccttgataaatgcaagctgtattctaaggtgtatgaagatgtcacatttctttttactattgctactattaaataatggtaataatgattaccatttttattgctgaacatattaattctagcctagaaacatcttatcacatttaattccttcaataattctataaggcagatgttggcatccttattttgcaaattaggaacctgatgttgttgagagacatttaaacacttgctcaaagccatttaactagtaaattatagaactggaattaaaattaagtgtctctcattcaatacttgcagtgatttttactaggtctgtagtcccaaatatattacttaaccttgttaagtctcagattgcctaactacaaaaatggagaaagcacttatctcttaggattcttgtgaagacaaatgagatgttacatataatatatgtaagtacttgatgcaatagctagtatacagtatacgctcatagaatgctacttttaatttaaaagctaaaatttacatttcacttattatattatgataccttataccaaatttgtgggaagggtcgcctaccattgttgcattgctacagaactactgattgtttgaaataaataggatacattttaatactactatatcaccagggtcataactgaggtatagaaagattaagtatcatttagaaaggcaccaacgaagctagttctcatgaatccaagtccagtgctcctatccattggcaatttgaactaatttgacgtaaaagaatataaaagagtgaatggaaaacacactattcataatattacatagcaatacgagcaaatatttgtgttatatatagttgtatgcaagtttctgttgggggaagggtatatttgaacttatttgcaaatagatgattcagtcaaagagccatcaagttttagagtcaattatagatgttgctgctaaaacatggagtcaacacattgactttttatcagctaaaggtcaaactgtcagcttccattgtctatatataatcctctgggtcattacttgtatttctaacaagcactggtgccacatgaaggtttcaatgttaaaaatggctttttaagaaggttagtttaaatgcctagaaaaaaaaattacacaatttcttactttacttattaatcaactttaggttttagggaaaaaactctgaagatgaaaaagaatgttggcaattaggtcagcacaatctcaggttttatctttgaagtagggcttaaattgtatctttgataaataagtaataaggttttacatgctgaactaaaatatctagtggtaacagcgtttgataataaaagggatgccattaataattgagaattagtaatacccagaatgggttctaataagccaaacacttagtagttaggtaggatttggcattattaatacaaataatcatgtatgtgatttatctgatggaagttaatgtttaagtaagttgttgaaacatttcacccctttgtagaagaggatagtagaaagacaggggcttaaatgtcaaaaaaaatgagtttaaaacttgggctttggtgtacatctctgagctttagttttcttaggtgtaaaattagagtaatattacttcttcatagttcctaaatgagataacacatgtacagtttggtctatagtaattgctcagcaaatggtaacagctatttttgttattattttcaacaataatattaaagctgtgttgggaaaaatatctacatccgtatttcagtgatggacatgacagattttcaaagtcacactccaattcatcagagtgcagtgtagggaaaagaacatagaaatctctgtacacagtgcttgtgaagctaagaaggaataaacattgagaagccacaaaatgtaaagtcgtcattcaaatctgttatgaagttaagaatgatgcagtgatgcttacagggtaatatttcactttcttcactgaggtctagtttttgagtaggtctgggtttttattaaaattctaagacaaatgcatatactgttgaacttgctgactcagacttttcttaaggaccatctatcattttaacttaccaggcaatctagccctggagctggaacatgtggcaagaacagattgccttgttggaaatgagggtagcttggccacagaggtctctcaactcacctgttcctatgaaaatgtctgtggcacactctatggaaagccaagaagcttggtcctaagaaacatgcagcagactacccttccactggaggactgaggggtcctggttagcaggctgtgttagaaacagtttaattttgacattgaattcacctgcttcaaatcatcttcactcatttgttctgatctttatgcatcaacctttccccaaaatgtaatctagggacatttattatgtgtctactctgccaagctcactattaggtctttcacacatagtaactaatttgacccccagacaaccctatgaaatagtattgggtattcagacatgaataaagcagttttcttatcttcgagcgttttcttagtctaccaaaagagaccaatgcaaaggtttattccataagaaattgtattacctcttgctctcacttttccaacagattacacctctgttctataccactaacatttactgctatccttcaaatcattattagaaacaccacttccaggaagatttttagaatgtattacaagagaatctcttcagtcccacttagcatagtcagtttttgttagttctctatttttcttttcctttctgtctattctaattaggcacttatccctgaccttcttctccatgtagcatttcctctggaaatatgagtgatgatgcatttactttattgtccagatttttattagttttgatttttgttttctttttctccccttgcatatttgcctacttctatgccttccattttaaaaagtaagatccttaaagggctggataatctgtagacctacatagtgaaataagtaaacactcactagaaagtgttcagagaattttaagaaaataacctgggctgtcgtgaaatggttctcctgtaatgccagcactttgggaggctgaggcaggtggatcatgtcaggccaggagttcgaaattagcctggtcaacatggtgaaacaccatctctactaaaaaatacaaaaaattagccaggtatggtggcgggaccctgtagtcccagctacttgggaagctgaataacgagaatcgcttgtacctgggagatggaggctgcagtgagccgagattgagacactgcacttagcctgggtgacagcatgagactctgtatagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaggaaggaaggaaggaaggaaggaaggaaggaaggaaggaaggaaggaaggaaggaaggaaggaaggaaggaaggaaggagagagagagagagaaagagagagaaagagagagagagagaaaggaaggaaggaaggaaagaaaggagaaagagagaaagagagaaagacagagagagtgagaaagaaaggaaggaaggaaggaaggaaaaagaaaagaaaaaaagaaaagaaaagaaaggcaaagaaaaggaatctgaaatggagtaattgtatgtcctcattttacagatgaaactgcaaagtggggtgtacagcccaaggttcacagcattgcttgggggaaaaagcaggatgtgaaactagaagtcttctgggcatcagtatatttaaagcttaaaaaaaaatcctctacccttattcacatggtttttctactatatcatttattttcctttaacaaattactcttttggtggcttgatcagataattatatcataccattgaagataattttggaactaaaatgtaatttagagaacattaatccattttttttcattatagagaataatctactttatatttgcattgtactggaaagtttacagtaagctgcatatacctgactgtttctcacaaaatctcaacgatgtaagcaaagtatttgtattctaattccataatgggtaataaattttttcttcttttttttagacggagtctcggctctgtcacccaggctggagtgcattagcacgatctcagctcactccaccgtccatcttcccgggttcaagcaattttcctgcctcagcctctggagtatctaggactacaggcatgcaccactatgcctggctaatatttgtatttttagtcaagacgggttttcgccatgttggccaggctggtctcgaactactgacctcaggtgatccacctgccttggcctcccaaagtgctgggattacaggcatgagccactgagcctggcctactatttcttatgtaaacatttcagaatctacttaggaaataagtgaccgtttgtataatttgaagttcttcataattaaaagcttaaaatataagttttatatttggaagcttatattccccatattggagtagttgggtgggaagaagtataagagtagaaaaatccacatccttctattactaccttctgtttgacaacctattatgagtcaaacaacaaaggaaactgagttcaggggatggggtatgtgcacttgtcaaaaaccatattgtttaaagtcaggtgagccaaattcaacatataatcaactttttttcatataagtgagaattattgtagggtccttgacaatatatttgtgaattgccatataaaatatcacctggataaggaaataagaatttttgaactgttttagggtgagtttctctctgcatagaaaaattggttagcatgagacatgatctcaatatttatactacactgtgttgggatccattactttttaaattatctatctggtttctgatcccagtgtaccttggaccttgagatttgagggcattgatgccttcacatatcttctacttttttgtctccaattcaaaacagggacacttcctagatgctctggagctctgaaatgctggtgtcctatcctgccttaggcaaagtgaatttaggtgacgaaagctagattacacttcctagccagattatagagaatgcaaggatgagaaaatgctctgaatagatagatgttaggcagtttcttctatcaagaccccaggtgatttacttgcctgtggttgaacctagttttataatgttttcattgattctttaagctatcaaattctccagcagtagatttattttttccttaatttagtcaaagccatttgttgtttgctttttttttttttttcttgcaaccaaataaccttggctgagacatcatctgtgtgtaaatagagtctgtagcatgcctgggtgacaactgtcatttatcccttccagctatctaatcaggagagaattgagctcacaggagaatgttcttcctccaacatgttttttataaccaccctgtctaatggtacctttccaactcgctctatcatacgaccatgtttattttattttctttatcacaacctgatattgctttgtttgtttatttttacttgtgtctttccttcctgaatgtattctccttgagagcatggatcttgtctatttttttcatctccgtatctccagaaaaataatacaattcttgacatgtagatcatcagtaattattttaaataaatgaatagataaatgaatgagtgaatggataatcttgcccatgatcagacaacttctcaggggcatagaatggatttagacggaagtaacctgactctagtgtctacaatcttacctcctatgccagacaagcagatataatttaaaattaagtgcttaatctatgtgtgagcatatatgcatgtgtgtgcatgtgagagagagagagagagaggaaggaatatatagagagagaaacagagagagacagaaagagagaacagtgaaaaaaatgtaagtatctgctttgatctgctaacctggcaaatatttatatttagtgtcaagctaagacttttaagtaaagtaaaaactgttaatctttgcattatatttgagccagtaaagcattttcatccaagatatccattaagatggcaagtatcttttagtttagtatagcagttttggcattgttatgaatctgtagattatgcagagcttcccacttgtaatatatatagcacaatacttatgtgttagcacctctttagagtaaaggtcatgggatagggttgtaaaaagtgtgaagtttctgagtcctgtgcaaatttgagctactaaattgttactaccatgttgtttattaaatagctcttcaatctgaaatctgccattatcagggattatgttaggcacttaatatctcatctaatccttgtaacagccctatgaagcagacattacaattcagttttatagaggagaaaagtgagtttcaaaaagtttaagtaaattatctaggtagtgtctcagagctggaatttcacatcagatttgatattccctacttcagctcttaaccacttaattatgtttggaagatgttaaaattattgcaaaagaacatcctttatgtttaaacaagttactaagaattaaacaataggtaagaatccagcagcctggggctaagaagcataaactgtaggttctaggtgcagctttgaccctatgtgtctaagcaactcatccttcagtgtattggacaaaagcactgtacctggccctcacacctcacatacctgcatccaaccccagtctcagtatttactttctctgttaccttgtacaaatcagtttatttgtaattgattttgttacaaataagttttttgatattgtaaagaaaataatacctgacatgtggggattaagaaagataatatataagagagtgttttgaaaactctgtaatgctctaagaatgctaggaagtaagatttgtaggcaatggctgcctcagcacttcatagatatcatttttttaaagtagggtttcttttggcacaagattactgctttgctgtttcagccaaaacttctatttacacccagtgtttttgttttgtttttattttttggttttgagttgtagttttagcatattatttaggtgattataattgatgatatttgtatctgtggctgttttcttaagagaaccttagaatgtggtaagaattttgttgttggtggtgggggtggtggtgacatctcagttagaagatgggttccattaggacggtgattgtgacttattcatctgcttcccctgaacccacatgcttcgcctggcatccagtcagctccctgtcattggattgactgaataagtaagtacttattacatagtgtctttgcatctcagtttcttactcatcatggattaaaatagaaacacaatgtaggcatttctgagaatttagcccaaacctaggaaatgttgactatcatgccaaaatactttataaactactcattgttgcctatcactagttatctcttttcgtttttgtgccagaaaacacactacatggatagataggcggtgactatcccagtttccactccaatgagcaagtctccctttggaaacaatctgtggaaagctgtcatgtagaaaattattgccctttcatgtgtacttggtagtcatttgctttcttaccatgagtgcctgggttctgtcctctagtgtatcgtgtatcttgattgccagttggttacaagccatagctcaatcagtggataccttttaatgtctccttccttgaaacctatgtggctgcctactgtcagatcaaggtaatgcggatctgtgccaggcatgaaaagaactgacattcagtggaggtataacggcatgtgaatgtcattgataagagatgattagttattttaatttccatggaggttgacatacttcattatgcaaaataataaacatgttttatatgaattccatggttcccaaactcatgacatgagaattctaatttgtattatgtgagccatgcagaggacaaataagcttataattttgcttgaattaatatttcagaggtttccgcagggatctcctttggaggtaacagtatgttcccaggagagtctaatggccttatgaatctctaatcctcatcccctatctctcttagaaaaaagattgtctttctgattggatagtgggatatatactcacatttaggatgcttcaagtagagtcccaactctgggactatagggtccatagggtacagttgtagtagcaataatctaatattgggagagctcagaacaagctccagctctcctacttacttagctaagtgacttcaggcaaattatttaatgtcttaacaacctcagatttcatataataaaattgaatatctaaattcctctgaaatcccataacaatttatttgtatctctcctatgggaagagggaggaagggacactaatattaattgaacatcttatatgtgcaaaccttgtgctaaacattttccatgtttgttaatctacatgacagagttaaacgccattatctatttgtttaattagtgaggccagtgggagtcagagtttaagttcttatgcgagaccagagaattggtcagataatgaagggaaaaggcaaacctaaattcctggctacctcttaacctattattctctgtaatttcctgattatggcatatttcacttcctacttcatattaagtaaatagaatgaagtatattccttcattcaaaaattgtcagttttttaccatgtccagatactgctctgaaaatttaaaatacagtatgaggctaattaaagtcacatttcacatggggcttcctttttattccagtgaaccgtgaaccgtgaggaaacaaaataagataacataaataaaaatgctttggaaatcatgtaatactaaataaattttaaggattattttttatatatataaaagttttcccctggatgggctttggacatttttcaataaaaagtcttttactttctccttatattacaataatgcagttgctgaataaaaatgttcttgttggaaaaagcaacaatcagttcaacaatcttgcctccattaatcagattctaaggaatttagtacagtgcctggcatgacatatgcacaccataaaagttatgatcattgatttctaaggttaaagccatctatctgtagtccattcatgtagcaggcacaaaatataacaaccagtagcagtggttgggaactaagcactctaactcagatgctttgtctctctgaaaacacacagagctcaccccaagctatatgataacacatttctcagaatgcagtagtcattgttcatcagcgagttctgaacctcattcaaagcaggtttctttcctggcaattaagtaaacatgaaactggatgaaaagataattaactttgaggttcacgatggtggtacattctgaactttgatgccttcatccacccaggaacttttagtgaacttattgcctatgatgaaccagaatattctctccacctacacacagctgctcagttcagcttagctcactccagcttagatgcctggtggtactcaagaagacaggatataatgaccttcttggtcccatcttttacctgagtcccacgtggaaactcagccctgctctggacctgaaagccaccacaagtggggagaaattgagaagcattcattctgtggttcagtggaatcaacatgttcctctgacattgtgcccgtttaccgcccttcatttattcttcaaacatacgtggatcacctattgtgtaccacatttgcttcagtgagcaaagctgaatccatgacttcacagagcttggagaatagtagggaggccacataattagaggtcatttctgcccagtgttcatatggttagtgttaatgcagggataagcataagttattatggaagcacagagaagagaatgatatacagtttgagggcaaccagagttttcccaaaatagatgataactgaggtgacatcatttattcttttgtttattcaacaaatatttattgaaggcatagcagtggctgttcaggtaactaatgacctggtgataaaatgaataagacccagtcctttttcttatgaagaggagacatacatgtaaaatgttataaatttgaaggtagttttgaatgtcttgaaggaaaataaggcaaaaaaaggggaaatgatggtttatacttgtgctctgaatagtatgacacatttatgtcagagcagtcagatcgtgcttccctaactcttaggtgatatgttgagctgagacttgaggaaaatgagagagcaggttaatcaaatatctaggcacaggaaccccaaagcacaaggactttgaggcagtagtagttcctgtgtcagagaaatagcaagaatgaccaagatgagagcaagtagtaggaaatgaggtcacagatggttttagggacagattatataagtacgatggtaattcaaatgaaaaatgttagaaattttgagcaaatgagcgacacaactggtttatgtttaaatgggtgtgtgtatgtgggtgagcttgtgtgtaggtgtgagcatgtgtgtatgcttctgtctctatgtcatttcccatggtgtttgaagcacaggaaagtgataagagaaaaatgtgaaaagctaaataatttgagaatgattcttgggacaatgcaaagtcactgatgggttttaaaacgagaaactgaaaattggtaaaattggggcagggaggctccttttggaagatgttgcagcaagtcaacttggctcccaggtattttcagggattcctctgtacacctcatccaacacttagatcctgtggctttgcatagctcttgcttcttctagtcatgctttagggtctgctactcactgcctagtacagctgaagctcacccctggctataataaatgctttcctctggtcctctttcctgaaaccatgtttatctatcagtcattactacttccggaccccttggaattttgctcacacagatcaccagcccaggctacagcccactacctgacatagtcctgactctatcttctccatctgcctgggtcagttttcatgaacatgctcctctctgctgggagtggcccaaggccctgggtctctggccagtctctaagcagctactctcaggggaagaaagtcttagattttaacattctactttcaggtaaaaagtatgtcctagacaaaagtagtatttgttttcaccctcatgttgagagcacttttcacctcctttctttctcttcccccagtcagcaggtgcacagtggttcaagccaaaggcatgggcagcatattctttccgattaagagctaagaagcacatgtattatctttgctttttcttgaccacacacaagaaatgtttgccttttgtaaagggatcctgcaaagagattgaagggagaatatacagataagttgtcagtctttaatgatgggtattgaaacatataagaggcagataattttgagcatataagtcttctctgtcttttatgtgccatgacacttgtccctactgcctaccctgtctgcttttaaaccacctcacttacatcaactgaatccattcatggatctatctatgttacactatgacaaagctcttaaaaattcctcattaattctacctggggccaagatacttacctcagcaaaaatgaacctttcagatggcatgttcctgataaaattattgaagagatgtgaagtatcactagtttttttaacatcctttttttgagtgcctattatatgccagccattgttctaagcactttgtatacattatcagggacctataaaagtagagattattatcctcattttacagttgaaagccccatcacatcctaaatgagcctgtgtaatcttgctcaccaggccatctcagagctatgtgagtggtggagttgggatttgaatcaagtttgagtgactccagtgcctgctcactgtttatgtagagatgaacaccttgaggggtcatttttctgactactacagtatccaaggacctgagcaatgtgtgatgcataaaaatgctcccaaaataggagctattattatgattcaggcaggggctggttggagaggatgggaagggggtggaatgggtggagagagtttatgggtgactaggaggagagttgccaaacacaccaattacaaaacccaccactacttatatttagataagcagagactgatcattgtctttgttctgcttagcaaaactaatttcactgcttggtgatggcaaattattttcaagcaggtggtaaaatttatcaagaatctgagcctctgccaaaagtaaaactacccaatgagtcagtagtaatcagctggatgatatttgaatctgacctgataaatccaccatcacaccatgtccccaagctgatggacatacaccatgtccccaagctgatggacacttcaggtagaaaaggaaacgtgactgtaaatcatgtcttgtcatcccatcttatctcatattgtccaccattattctacactcttctttcccatacccaatggccatttcattttaagatcatagaaaaactgttccttttatcaaaacatcaggaacctgaccattagaaatatgatattattatataagcatgcctttaaaaagttggtatcccctgggaattatatataattcctttggtctgatggttaaaactgtctattggaacttaagtgcaaaatcacaagacactccatttaaaacagtacttctcaacctaaagtttccaagcctgctacacttcttgaatccagtaatcataaagatgacataataataatgatggtgattgtggttaggatgatgatgaggatgacaaaaacagcaactaacacttactaaatatgctaggtgttgcactacgcattttacattcattattctactcttcacattacttctgtgagttatatgtgattattttctttattatacagctgaggaacctgaggtttagagaagctaaatatattgtgtaaggtctcacagacattagatgatagaatcagtattcaaactctaatttacctgctacaaagcctcagtccttaattgtgctactttaaatatatcagaaagcctaatccagtagaacattggctctacaaaagcctgtgcattctaaagaaagaaagctggagttatatcacccactctactgacaatgatttgcttggactgattagaagcttgtcttgattattccacatatacttgaatgtagttaaacaaatcaaatcatcactgattatatgcagttagcttggcagaaaaattcttcagaacatagattctatggggtaaaataattttaaaaacccttttattcatactagaacagttggtgcctctcttcttaagtgtaacatatttcagcctgaaaagtcttaaatttatatctctcatgtataaaattaaatcaacactctattttataaattctgttcggtcataattttttacctcatgtttacttaaaatgtctttttaaaagcctctagaatgtaacaatccttgttatttttagcaacaatctctacaatgcaatgggaaagtaacacactttccttttataggagataaagtcaaaagattgaaatgtgaatgtggatcttgggaaaggagcttaatcaatgaccgggccacaccaccagggaaagtgtattaggtaaaacacatgtttaacattcacagtgtgagcattttagagaggaatgtagcaagaaaaaagatttctgtaatttttaaaaaccatggaacttgactgcaagtggaagttggaaatgtgtttagaactttgaggtaggcactatcagctatgagcagaactgccacttgctttgaccatctaaaatggtctatagaatacttcttaaaattggtttcttaatggcagctgtgttcaccatattagaaacccagttagaacaaacaaggatgtggtcatacaattatcttccttctctgtcctagaaaatgcgtccatcttggtaactgtatgtattagtctgtttgcacgttgctgataaagacatacccaagactgggcaatttacagaaggaagaggtttaatttgacttacagttctacctggctggcgaggccccacaatcatggcagaaggcaaggaggagcaagtcacatcttacgtggatggcggcaggcaaatagagtttgtgcaggaaaactcccccttataataaccatcagatcttatgagacttactcactgtcaagagaacagcacgagaaagacctgcccctgattcacttatctcccaccaggtccgtcccacaatacgtgggaattcaagatgaaatttgggtggggacacagccaaaccatatcaccatacctggcttccgatttcccctgactttggcaatgtgctctgacattctacctcttcctattatttagattttatgttggggagtggttctggcatccttcttgatttcatactctagctctaccactaactctgagatgacctaggtaaatgtcttaacctctttatcctcaatttcacaatatcccatatgaagataatgcactggagagctagtgagaattaaatatggtaacacacatatgcacacacacacacacacacacacgcaaccattcagatctgttagaatgggattttttagttgtcattattcctactctccagaactctagaaaatagaggatgtcaaaacaagaaaactgggcaccatttggttccattgggttttgatgtactcataggttcatatgtttcttatccttctcaggcaattctcattgcttttaccaaaacacatttagatctaattattaaatctgtcgggttttttttttttttttttgctcatatatgtgtgtgtgtgtattcctgttgaccaacagctagttgttattctgcttgtttctgtcaagacatcaatagcctatttccagggaccaaaaattaaatctccgctgagagtcatcaagacctatgattaaacagaggccagtaagttattaaaccagggctcagttttcctgagcttttcacataaggatattgttcaatcagccctgccagctgtccagaccttggtacttttacaataatggaatttagaagctgggaatttcatcttttctactgaatccaagctaaaacctttctggtttaaaggaacttgtaaaagcatacctccaactgtattaaagcatttccatttgtggaacttgaaactattaaccagatgtcttaggcactttagtaatacaatcttacttaatcctcacaacagtgctgtaagatagctgctattatttccattttacagatgagaaagctgagggctaaggaactttcctttcccagcatcaaagatctgttaaatcatagagctgggaatgagcttgtgttcttgctaaccactgaatgtcctgatttctcgatatttgttaatgattaccttttaaataatcattcttaatagcattcattcaaacacttctgaaaatatcttctttttttctatttttcttttggtacttcctcttcctcctcttcctctctttttaactttttctgcctcttttttctcctttttcttccctatttctcctctaccatatcatcttctttcttatagtcctccggcaaaaataattccaagacatgatagaatatatgaaattttacatagaaaagatactttgaatatggatgattaggaagggtttcatggaggaattaaattttgaggtgaacattaaaggtcatgttgcatttggatgcatggaaaagtccatgtaaatcaatctagaaagaaggaataatacgaatacaagcatcataaaggcatataatgtgagatcctggagccagcgttttgctttggttgaaatgaaggccaactgacataaattattaggagctaggtttgtataataaaatggggacaggttgaggagaacatggtatatcaatgggaagggtataacctttactttgtagactatggagagctataggatatttttgagtcctaagggactgtgtgttcctttcactggaagcagggaatggagtgtttagtgggatatatttcagaaacacatttttaaataggaatagtagatggtttaggaagaaaaataagtgataatggtcaaaaagcagttagtgtacaaataaagttgcctatactaaaatgtagaagaaagatgaaccaccattatccttcggaacataaataatcagtgctgagactaaagacagataatacctaataaaaggaaaaatactgcagtgccgtttgttttatactatcataaactttgaagtgactttatcccttaagtcccaaacataaagccatgcaggggatgaatctgtattatagaaagaaaaaaaagagagacagaacaactaatttgagtcctctctattatctattaggtttacaatattatgtgaaattattcagtatttctgagccttaagcactgatactattatgaacacttgagcagttgtggtgagttagatctcatctttgaatattccagtgaatataccttacctgaatactcttgaagagaggcagcacatctttatgccccaggtgacatttagtttattggatcaattctacaaatatttaacatttatttaggtgtacagtcacagacctttaaaagttacagataaactacagtatttattagttttaccaggtcttttgaaaatctgcagtcatctttcttcacctcgtataggaatctagtccctttaagcttacttggtgtgaaaggcatcttttacatagccaccactcctttggattctagcccattttctggctcagaagcagtgaggtggtgatggggaagcagagtaagctgtcttgcaagtgtccttaactatggaaaatgcagggtgctggtcacacataagagagcagtttaaataggaatacatacaaatctcagggctaaggaaggggatccttctgttggatgagtcacagcttggaaaacctatacccaacagcaaagaggctaacttggctcagttggcaaagctcccatgcagcaagatgactttgaccatggccatcaactaaggccttccccaattccaacaagatctggaggtcatcttaccatccttacccgaactttattctcctaccacctcccaggattcctttccagtgaagtcactgggcacttggggcctcctgtttctctattgtctttccacgtctattggtatgatacaactcttttttctctgatcttctctttgactttcaacaggttgttttctaattctaaaaactaaactgcctctttctcccaatttgagtttcctttggttgttatcaacacctaaagcaggattctgaggggcaatgctggaagtttctttcagtaaagtgagagaaagagaacacaaagattaaagatagtatgtcttgagctttacaattattttttactctgtcattcaaattcatctctaatttgatccaattctacctctgatccatgaatactttgtctccaataaaatgggattatcttcctgaaatacattaggtgctttttccttccgtatttgttcacatggaatgtactcccactttcgccccaactggttcttcacctttttcttcacctgttgaaatcctcctgtttttcaatgccattttagtggtacttccttggtgaagccttcctcatttttcccagctgtgtcctttacacaatccccatggtttttcttaattatcttctggctgaacctcagtatagttatctctgtatttctcttaacattcttactagcttttgagcatcctaaaggctggagtagtatgttactgtatcttacagaacttacagtatctttcacaatacctttatttagaaaggattgaattaaaaagttttcataaaatacctaagttattaggacattctgaagtgagtaaactttatattattttagaactttggcaacaaaaatacatctgactctttccccttgatgaccatcagctatatacccagagagatttttctgttactctattctttttgagatttttatgccaataaatattaattcttatgaaacaatatttatagtggctaaattttatcaagcattttatttaagctaggcactgtgttaagtatttttacattaatgataattttataaacactgagtttatggtttatcttgaattacaagatgagtttgtcatcggtactcatatatttagaaccaagtaaacaaattataactttcagataaacacagactctgaaaaaaagactaataattgttgattaatcattctgtaccttttcccatagtttttcttttggtttttggttgcctaagcaactaggtaaaataagttaactatgaccgctagacatttctcctgaaaacaaagtttctatgtaagttttcctattacactcacttccaattttgggtagtagatgtcttaccattatttttgttggccttctcaggtcagagtaagaagaatctatatcctccttctagaatgtcttatacatgcattatatcttcaatttatcaagaggcacatttttttgctagcaacatactcagagccagggtcttgaatatctttatatgttcaatgtttgatacaggagtatcaaataactattgagctattgaatgcatgtataattagaaagatatttcactcccttgtcttggggtagctgattttttaagccaatgatgaggaaatttattagtggctgatacatacattactccaagaacattcataggactttttcctgcatttgctcgaaagacttttcaccttcttttctgtttctgagagtaaaaagtgtcatttgaggcagattttcacacctatttccaatagaaggaaatcatcttgtcactcgcataaacatgtaaataattaatatgtggttcacatcaccctgcaactttgggacttaaacttgtactactaggaagaacctaaagaaaaagcagaatcagtaacttcatttggcctaggtggtcagctcaaagagggctccaactttggataatttaatcagaggagaaaaatgatgatttattccaaccaagtctaaccaaaacctaacccactctgtgttaaatctgtttgggacagatgaacttatggatcataatcttcaaaaatttaaggtgcttgagccttgctaaaggtctcttagagggcctactcacagataatacttttgtcactcaaccctttattgagatctacctcatttatagagatagggaaggcatgacaaagacaatgaggctatccccatctgccactccacattactaggtccccttataggtgacaggggtatataattagttctgaccaatagattgtggaaaaaggcatatgtgtctctcccagatcgaagcacagaaatgtcaggttgccttccctctaccattctctttcctgacaccgggatcaaggagacctcatgttttagatggtatagctacaaaatgtggtgtgttagtctagatccttgaatgactatatagatcagagtgccctaacctgcaatgagtgagaactagcctttgtattattaagctactgagatttcaggtttactgcattcttacaacaaacctaacctaaccagattaacacaaaataataaaagaaacaggaagagaattaacatttaatgagtacccaattatatgcctacactacagtaggaccttcatatggtctgctgtttctgctgttgatgtatttacttctcacaaaacctttatcaagtttggaggaaccagatggcaccgaaaaacacaggcaaatgatgtggaatctatattcacaattgctttgatcctgtctcttctgtagtgccatatctgtcttaaagcagaaatattatagacctgtcttctgagagccatacatattgactacttatttaagcaagattatattgattagttcaatgaccacagagtcagggaaaaccattttggaatgagttcagtaaatttgtgtcaaatgcttattcaattatcatcctttagagttatttgggggtttcttataaattgttacacatgactcactttggctctgtaggaattatgttatttagtctcattattgggtattgtttgttattgctaatgaataaaatcaaaaatagaaatattatatattcaaagtatatcaaactaagtaccatagagaaggggtaaatagggacatttttaccaaatcattgcatacaggaggctcttttagctgatttaggaacatccaattaaattctttactgtgtaaagacctctggacctagaatacctgaattgaaattctggctccatgttagctgtgcaatcaattacttaagcaagccacaggtgtatcatctctaaattgaggatggattaaatttaccttacatggcttttatgaaaattatgaagttgtatttgtataaaagcatttgtggtctggtgtatagtagatgtacaataaagtgttagagactcagtttgccatttaaaatgcatagaatattaagaccccagtaggttattcaaatttaaaacatcagtgactactgttaactcttctaataaacagatgtggacatgggttagatgtggtcagaaagagccacgtgacttgaaagattattcaaatgggagagtttcctttttgaacttatcaagctccaggatcaagctttttattttgcaagttcaaaaactcttaatttgccaacatcccagagccagtcgaaattggggatattgcttcataatagtaaagcttacaagatactgctggagatgaatagatacttactagagtttattaattttaatgcaaaaaagtttctaagctgactaaatgtccatatactctaaccagttcattatcccttagtacagaaattataaagggagccaaatgataaccctcagcttacctgtgtctgagtaggctagcttaatccagttcagataaccacaaaatctcagtatccttaaattctaagatggatttatctctcaaacgttgtgtccacagtgagtggtgagtatctggctctaagacatcttcacttaggagctcaagatgatagagggtgtacttcatgaaattgtttcagcaaggggaaaggaataatgaaggatcttacactagcttttacaatcatccaccaagaagtgacatatgttgcttaaactcacattcattggctaaagtaaatatctatttacttgctatacctaaattgctatacctaagtttaaggaggtgaggtgcaaccatctcttgtaccccacagtagagaggaagtggatattggtgaatatacctggtgaccatacttggtctgaagtctaatgacctcatggtctgactcctgctgtccctctagcaacataaagaatgtaattgccagatgcctatactctcataaagatctattggtaaggccaatagaatagagggaatagagctatgacatgcactgccagacactgtctcagagactccttgcctctggcaagagttggttgcctcactggccaacgaactctccattgcataggtatattctttccttagatccattaatgaactcaattaggcggcattcaggtcttgttgacctggaaacccttctacctctttcagatgatttacataattctgaaggtaatattattttcttcattttgcaattcaaaagtacctaactgcttttcctcccctccatccaccctcttcctacagatttaaaaaggtttttggataaactcgtaacgataccttatttcaattaagagtgtttggaggagctcaggtcctcttcttacttaatgtgtggttttttatgctattaattgtatcagaacgacagtgcaaaaagtagtttcagcttcctcatttgtccagcattaagtttctttctgcttacagagactaatgtaagcagggtttaattttttttttttttttttttgaggcggagtctggctctgttgcacaggctggagtgcaatggcatgatccaggctcactgcaaccccatctcccgggctcaagggattcttctgccttagcctcccaagtagctgggattacaggcacccgccatcatgcctgcctaatttttgtatttttgtagagacggggtttcactaggttggccaggctggtcttgaactcctgacctcaggtgatgagcccgcctcggcctcccaaagtgctgggattacaggtgtgagccaccgtgcccaggcagtttaattgtaatttaatcatcacatgcagatgtcgttctttatgtattccttaatgaataatgaccatttgtttccaggttatatgagtccaaagaattgagtgagttttacattgaatgcttttgtctctataagtttattatatattctctggcctaatgtttgaacagttctctatttgacaaccatagtcaacatttttctcctccactaaaatattttggcaaatattttccccaaatcagagaaggaatttactcatttaattttttgttacccattgttcattcattccattcatcttcatttattcagacattcagcagtcttaaaacacctattattttcacttactaagtcataaactttgggaagcaaactaggaataagataatatttgggctctcaaaggacttcatctttggggaaaaatagaaagacatgggcccaaataatatgaagcagtgtgctgttgtttggaactaccaaaattcagggttttaccatgcttaggcattatattagatttattcttcaacatttacaaagtactttctcattaatgatcttgtgtaacctctcaacagttctgtgggagatcgtgttaccacccttttacagatgaggcaatacaaagttaaggagcttgctcaaggttttattattattaactgacataatcaatgttttcaaaaatgttctcatactataggccctttttaagtcctgcacctgcaacatttttgatcatggatttctaactagttgttttgcctggatcctttgacactaacaagttatgagaataccaagacattcttggtgaaagattacttccatgaggctatattatagaaataaagaaccaatgtttgcttggcaagcagctgctttaaagaattcttatctgggttacctatgcatttattcttttttgcttatttagctttttaaaaagaagattcttgttttgttttgttttgttgcaattctcttttcaggagaatagatagcttgcattacctgcagaaatgtatttatctatattttgttgctcagcttaaagagaaaatattagaagtatgctggaaatagatatcttttataaataaaggtaaagaaaaatagataatttaatgcaatgtaatagaaaagtttgctgaagtaaagatatcggagaaagggactgctgaatatgcacataaaactttgaggacagacctagatgagtttgttgaagtccctgtctgatcctgagttttgtaaaaacaattcaatgcatttgggtggagcattcatgttactacacactgaggcaaggaagttgcagtacgacattttactggctctcaaagttgttgcagtttcatgggggaaagagaaacataagcaattttgatagaatgcagaaaatgctatatttgacttattgggtgttttgggagcagagggcacagagctagaaacaaagccagagttggaagggtggactgaggtttagggatagtttggagaaaaatgagagaaggctttttagtagaagccacttctgaagacattgtgggtaaaaatgatgttgactaccatccactgggtaattatatgtgtgatactacgtatggcccttcacatgaattacctcatataattctcttcagtgttctgtgagataagtactactattttctcattttacaggtgataaggccaagcaagacaagagaggaaatagcaacatttacctcagatggcctctgatagaactctgggcaagaggcctctgggtaaaagaagactcagcagaagagatctaatgatgcagagttgaaagataatcagggataaagcaaaaaatagggcaagataaacatgatatggtgtttgaaaataatctgttaaggaataaaataccaaataaaaaaagacaactagaaaccacaggaatagtaaacatccatatgatagacaaaatattaataatagcaggtactgttcattgagcgctaacagtatcctaggccttgttctatgtattttcctatattatctcttttgagtctcaattctagagggagttattattatccttatttataaatgagattactgggccaggcacagtggctcacacctgtaatcccagcactttgggaggccgaggtgggcagaccacctgaggtaaggagttccagatcagcctggccaacatcgtgaaatcccgtctctactaaaaatacaaaaatcaaccaggcatagtggcgtatgcctgtagtcccagctactcaggaggctgagacaggagaatcgcttgaacccgggaggtgagatcatgcgattgcactccagcctgagcagcagagtgagaccccatctcaaaaaaaaaaaaaaaaagaaaacccccaagaaacaaaaaccaaacaagcaaacaaacaaacaaaaaacgaatactgatgggccaaagagactagataaatatttcagtctcacagtaagaagaagagctggattttgagcccagaaattctgactccaaaacccaggcatttcttcataccaataatgggattagcacagtgtataccatttttttctttctttttttctttttttgtaaaacttatgttttagttatatctttctgaaactagattccatattctgtgaaggaattatctacagggccagctcttcttatctgatttgggaagtatattttcttctacataaagatggctaatctcattcactgcctgtttcgctgatgcaactctcaaggattaaacagtcttatccctaaaacgtgggggattactgcagctccatacatactgacacctctcatgagcctcagaaagtcactcactcgtttgcctttttagataaggcaaaacagtataatgatggctaacgactcatgggtaaaggaaacaacttaaagattttggggttctcaagattaaaagaaattaaaataatagatttccatattgttttcaggttgctaaggagtgtaatgaaggcctatttaaaatcactgtcattctgcacagcatgaccatgaaataatatgacgagaagaatgtaagcaaaacatttcttaagagtctgagtttttatgaaatatacatatttaagaaacaagggaaataaagttctaagatactagtaaaggaatgagaaaaggaggatacattttaacagcaaactaatgtttgctatttttgtcccttaagtgccaatatcttgcttctccctgagataaataattgcttctctttatggcaattatggaacaacatttcagtttattatattttttagtaggttgaatggtcataatgtagtttcctttaaactaagtcttcctacctattatactgaagctccaaataattgtaaattttaaatttttcatggcatcaattaaaaatatatttttttctaatgcctgtctttggttaacatatgttcctactgttccttttgcatgtgttctacttttccattataatatatggctatctacttaagcctagtttaaatttgtaagggattatatttcaaaaataatttaaggacaaatcatctgttggattaagaatttcttgcaggaaggaaacatattgtcttaaagttttatttttaggccttggtaggccctcagaatatatattagaggaataagaaaattaattgattagaaataatatgattttattgaattatatctgaacaagagtaagatggaataaaggaaagaagaaatccaactcagaaaaggtatattagacagagccttcacgtcaccatctgaggactcattttggcttctcttgactcaaacctaagagaaatagtttgtaccagttaagggtatttatctaattttactggtagtgaaacaaattactgcaaaaatgaaagaattatttccaagaacaatccaagttttatagtgttcctaaaatattgatgaagggcaaagagtaatgggtgtttaaatgatgtatgaggcttagaaatatatgtcatcattattaaagaagtcacttttcctctgttatgagcaaacagtacagtgaagattttccagcaagattgtcattttatgtaccatggttcttatttcttagaattataatggactaaaggagtagtattttaccaggtcacaaataatgtaacacctatgcctattaaaactcttcatttatgtggcaaagcacctaagccagttattctgattttattgttatgcaaagaagatgccttacacaaatcatcttttatacgtcaaagattctagttttgggattcaggaaatctgggttcagcttaagcctagatttttactagctgacaggccttaatctcttttgacactttgtgttgaaaaaaatatacatagttatataactgtgttttaaagaccattctttctagtcccggcattaactctggttctgtaagattttgagtagatcatttactctacagggtttccttctgttatcaaaattagattattatcttctcatccagaagttctactctcagggatttatccaaaggtaaactatgaagagatttatgcataaggatgttcatatgtagtattatttacactagaaaaaatgtaaacaacctgcatccctacaaatagggattggtttaattatagtataatcatgcattagaattatatgctgccgatgaaattgatggatacattttaattaacatggattatcatagggcataaaagaaggctacaaagaaaatgtatagtatgattttattttttaaaactatatttgagcaatgtggatagaaaaataattgtttattgtgtactgtgtttcaaacactactgtaaacacattataagtatcatctcatttatataagactctaacaggcattgctattaagcttttttatattaaacaaattgagccactgtgacatgctgcctcctaagaaatttgtaataatgaacaatgcactgttaacagtgtgcatctattaacctcttttattaagtacatagaggtttagagaggctaagagcatgagctcttgtcttatctttgcatttactagctgtgtgactttggagtttcttgacctctctgtgcctcggattcctcatttataatatagggctaataatggtttatacaatttctgtgagaactaaagtagtgaatacatgtaatacacataaaattgtacctgaaacatgataaaatatattttttaatgttaactgccactaatactgccacctggctaaaaagggatagaatcagaatgtgaaacttgtttaacttcagcacatactctcatctatcctctgattctcgtatgtctctatttaacatgacaatgttcatattctcccaagattacaaatgagttaattcacttttaagttctcttcactgaagggttagaaaatattatttgaataggctctcatgtggaataaaacaagcaaaacaaaataggcgtatgcatttgcactctaatccgtggagatttttcagtactttactctgagttatttgcagggctttctcattctgggattgttttcttaatggttttggagaggaagttgccatcattatttatttatttatttttcttgagacagattttctctcttgttgcccaggttggagtacaatgacacaaaattggctcactgcaacctctgcctcctgggttcaagcaattctcctgcctcagcctcctgagtagctgggattacaggcatgtaccaccatgcctggccaatttttgtatttttagtagagacagggcttctccatgttgtccaggctggtctcgaactccaggcctcaggttatccacccacttcagcctcccaaagagctgggattacaggcacgagtcactccctccagcccaaagttgccattatttaaaaggaaaagacaaaaagagatattggtcagtaaaagttgtggttctactcagactatagaagcctacattatttttatattgggcttcttttattcattcaacaattatttgttcagtgtccactatatttcaggcacgattttagtgtgtctgctagtgtttcctgcggtctgtctaaagattactgtatttgttatctattctgcatggtgtattagtgtatttccccaaatcttagtgtattaaaacaaacatttattatctctcatgcttctgtggccaggcattcagataagacacagcagggatgatatgtctgcactctgaatgtctaagccctcagtgggaagacacaaagaggctggaatcatctgctggttcattcattcaaatgtttggcagttggtgctggctctctgctgatttctttactaggactatagtctggaacagctacacatggcttctccatgtggcctggacttctcacaacataaaggttgaattccaaaggcaagcctcctgggagacagccaaacagaattcatatccatcttatgacctagcttcagaaatcacatagcatcactcttgctttattttttcttgaacaattaacatttgtaaactgtaaaattctgcacaagtgttgcttgttattggtgtttgattggttgaatgtcatagcttttcagtattaatgaactctaattttctgagcttggatttcttaatctctaatttttctgagcttggattttgttctccataaataagtaaagaatgcagttgaaatgattaaaagaggaaaattatgaaatatttgttttgaaaaaatgcagtctattttgtaagtatttgtttgtttattatagatttaaaaccttttcctgtaacttgtactctaaagaaataatttccagtcatgtcaagtgaaggtcagcacacaagccatttggggagatgttagagtcagatagatgtgagttgaactgctgctcttttattagttatgtgattttgaacaagtttcctaacttctctgaacaacagggtactcatgtataaaataaatacatatgttcttagagagtagataataactagaattttattatcttattatttcttgttatttgaagtacagggtgcataaagaattatatacctcatgtaatcagcagttgttacactgcagatggtggcctggggagcatcagtgtagggatgtatacaatcggacttaaacagaaccatcgataactcacaaggcacatttttgcaaaatggaaaaatataacctcccctaggaggtcacagtaccatgccacagcacacagcttgggcaccagagtgtgaattgcatttctgttttcacttatccccaggtgggtttctttgggcacacaacagcttgcacaaccagacattgtgccccagtgcattcctatctctttataattttacactagttgtttgtatacaatttaccagagttaaatgcagtgatgctctctaaacaggctctcaaaaaattgggggtccctgatttgtagcatgatatctatggtgtgaatactcccacaagctaccaacatgttaacaactaggttgcaaaacaattgtctctcacttgtctataggagactgcttcaacacacccactggcaaagagtaaaatttgaacaagtgccagaaaacagccctgggaccactttattcccctgagacacaaatcacccttagaggagtccccataataaaatagaaagccttccagagatatggccagtgtcacagtaggtaatttgctttttttctttctaaactacgtctatttgaccgcaaaaaatgttagtatttctccccaaatgcttattgataccctttggaagacagaaacattttagaacatcacatatcagaaaagaaaaatgtgttgtaatattttttttaatgagatacactgctacaacatggttttggagaaggaaagacagacgtcacatgtcttatcttggacacagaagccaggctgtgccagccaagaacaaaataacctattggttacaactcgttggagctcaacatgtgctatcagctcatgcttctatatttttggtaacatctagcagattttatggtcatagcaaatgtcatttttaaattacagaaatgaagagtgaattataacaagagacctggctgatggattgtttttcatttcacttcagttttggttttgatagtctgtatcttatcacaaaggaggtaagagttagacaaaagcatttttcaataagggcaagtgtttggttagaagttaatatgacctccctttgattctattatattcacttgaatttgacaaatataaaaaggccatggccccactcttcaagaagattatgatttaaaaattggacttaaacaatttactgtggcataagatcatagttgtaaaataatagtgctactactactggtagtagtagcagcagtaacagcaactaagagaaaacccatatttgtattcagaatctgctaccaattggctgtgttaatttggacaaatttatttatctgagcctgttgcctcatgtatagaatgggaatcctatctcacatgataaagagaatatattgtctataggagttggcttcaacacactcattggcaaaaagtgaaattcaagcaagtgccagaaaacagccctggggcctcttaattctccttacacacaaatcatccttagaggagtcacaataataaaacagaaaggcttccagagaaatgcgaagtgtcatagtatgtacagtttttaataatatcatcaaatcattgttgtgaggattaaattagatagcattaaaattatttaatgaaaattaatcttttgttgggtgcatctgtaaactgggtcacatactgcttgcagcaatgaaggaacacatacatgtttgtccctttcttccccatcctggcactgtttataataaggagagggctgtggatattcagagtcagaggagatcccacttgatacaagggatcagaaatgggattgtgagaaaggtgatgttgagagaaacaaataagtatgaaagaggaggttttcagagtcataccccacatggaaggtatgaattgaacaactgcatgctcattgtggcaggatgacataaataggagaatgaactacttttaccacctctctgagaaacacagctgaaaatccatagctcaccaatagtgaataacataaatgagttttacctagatataaagattaatactctgattaacctttggagaaataattgcttttaaggcataaatattgaggatgcttagaataacaatgaatttaaaaacttatgttaattccgtgtttccaggtatcagcagattccttcttttactctgacttaaagtatttagtgccatttctacaacatataaaggaaacagggaaatcacttacttttcagagagtttcttttgaaagtgttttcaaaagcaaatctggctggatatgctagctagctagattttttttcaattacctctggagaaaatggctttagaatacttctaatagagctaattcttactattttctgctcacatgacattaccaagtaagagtgatggcattcttccatgcaatacccatttattgtatagtttctgtcaatgacatcaagatagtagtttagagcatacacttagtctctgttaggataatctgccttctccaggaacaatgtcttaagaagagacacctgcacacttccctccaagaagcttcatgtcattctgcagaaccatctttttgtatcaggaggtaaaaatgctgttagattcacctaggcaatttgtgtgagagctaggctttagtggcctcaaaatgaggggactgcaatgcaatcctagtggacaaggattcaccagagccacattcttagagaaacccccccttcattgaatggtgtcagtcaactgttgcagaacaagcattgaatcaggagtcagaaaagaaaatttaaagctttggtactaccaaatacgaggtgaatgaactttagacaagtcatatgacaactctccatatctatctcccatttgtaaattaaggagattagactagacacactctaagttccttctagctttggcattactgccactctatgttgggcaatttttctggcttacttgaagtattttacatgttgtaacgtttattcttgtgttgcaagaatgaggtttagtgataattcattgtgtaactataatgataaatattttatttgtgaaaaaattaagtgataatctctcgaattagcaagatttgaggataaatatttatcagaagtatatatatctataaatatttatcagaaatatattttcagttgctggtatggtcatattctcacaacctgcccttgattaagtataccccaaatatgttgtcaacacctagtttttgaccctcaataaatagaagtagaccaagagtttgagatgggcttaagtatgaacattaggtgaacatctaaataagatccttgaagttaaatacattttgccaataattcagatttaattgtttttattgaactacaaattttaaattagtcttatttgttaaaaggattacacaaacaaaaattaccctgttttggctgggtttatagtcttataaagtctgtgccaaaatctgacatattaaacatttagcagaggcaaatattaaacttatcgagacacaactgtatgctgatatttctgaaaacattttaatatttatctcaccaaagatttttaaaaccagttttatatcctaaagattcatgtgaacttgaaaagcattttgacttaatttttgagtgctggtttatgtatgagccaataggtagcatgctagacacaatacatattatatgtatatacacataaacatatttaaacatgtatacaggcacactgagatccaatcgcttttatgttgggattgtagccataagatagcaatacgaactaatcattttaggaaagatagcttattctaaatatttctgacgaaactgggaccttttcacatggctacacttgatttgctccaataggtaattcaaggaaatttggggaccggaatttgggtaatgtcattttcatgacagttgtgatttttaaaacctcttttatctttctttttttttccttaattttaaatcagtttctaatgctactattttagccagaactggctgaactgtataagaaaaacaaaatcttttaagtaactttgcaacagtgagttttatcttaacaccagtagcttggtaacagcagattcaaagcaggaggagaaaggaggaagatagagagttttacaagaaagtagggggtaaggatagaaagagtgagggagttgaggaagggaggacagaccagaacaaaaagaaaccaatttccaaaacaaagtcatcagcagatgaaggaattccttactgtgacaacctaattgagagctcagatttcaaattggctgttcaccccttccctttcctcctcatttaaaattgctgctacggaatcccctttcactccttttccccttttcctttcctcaaacaactcttgctctccaaataggagagtattccagagctaaaggctgtcagatttcagccataactgaccagaccagaacagaaagaacccaggagccaatggctattaaatttcagccaaataagtagaaagtaaaagagaaagggttgttggagaaggacagagggggctacaggagaaggaaaggaaaaggggaaaagtagagtaaggagatatcagagcagcaattacaaataaggaggaaagggaaggggtgaacagcattgctcaaggggtgcccttgtaatctctgagctgtcagagaactcactaggtagcagagacaccacagaaagtgctcagggggcttcttgtctactactatggagaattgtccattaagtcaggggtctgggaaccccagttccatctgggttgccagaatgttactagctgatgggttcttggccctcagtgaagagaaatagaccaagagtttgagatggtcttgagaaaggcagtttattggggattttagctcaagcaaaaagggaaacacagtgtataagtcagcacagtgtataagaaaaatagggagggctccctgtcctgatttccctgtctgtcttagtgccaggaatgcccatctttgtcctgaaaatacatatattaatacattctacattgtttgtctaattgtctgttcttagaaactttgcccagtacttacagaataaaatacaaaatcaccaacataccacaaaatgttctttccaatttgccctccataaagttactcatctacctttttttatcacttctttgtacacactcgagccatctcaaacttcctttatcattcagtctgcaagcatttatttgtgcatatatttacctctgccagggagaatggtccttaccatttatgcaattgtatctcttacataggtacgttgcatacttacttttactggaatgatgttctttgatttcttgctttccaacttttactcagcctcaaatatatatttattgaagtcttccctgactgcaaactcctccccaagcacttatctcagtaaatgacaattgttagttgacatgccattcttccccattatactacgaacccctagacaacaggaacaatgacttatttatttctagatctttagtacctaacatggctgaaataggaaaaagttcttatgaacatctggtaaattaaatgagcagatgaaagcaacttaaatgaaatccattctatcctcacctcttctttgaaatccatcttggcttatccttaccaattctatcaccttcttttctagtatttccattttcctcttatctttcctgatttagattcaactatgtttaccaacacttgtgctttatacagtcatgtaccacataacaacatttcagtcaacaatgattgatcacatatatgacaattgtcctataagattatatcacacttttactataccttgtctatgtttagatatgtttagacacacaaatacttaccattgtgttataattgcctacagtattcagtacagtaacatgctgtacaggtttacagcctagaaacaataggctatattacatagtctcaatgtgtattgggctataccatctaggtttatgtaattacattccgatgttcgtacaacaccgaaatcacctaacacacatttcttagaatgtatctctgttgttcagcaacccatgactctatttcatttgatttttatgaggctgtatttcctatattttttgtctttccatagagttctacccatgtgactatttaataaggctgcaaatatttcaatattaatgttatttgttgtgtgttcatgcctctttatattcatattatctattttgtctataattagataggaagataagttagaaaatcattttgctacagcaatctagcagaagtactggataaatatttaatgatagtaatgttgatttactacaatatacagaatgagaacaaagaagttgccaccaatatgtgatgcaaatgtctactgcaaggatttgttgctactgaaatagctctcctaccatgtcttactttttgctgaggctttaaaggtttaaatgatttcctgaattttaactttaattccaaggccatacaaataagactctgggctttcctgtgccatcagcctaatgttttatggataggtatagattgtttctgatctttgatttggtccctaggtctaaaggaattttctgtggcatttcatatagtgacttatagtcaactttctctattccttcagtgtgttcttcctcaaactcattcctcttcctaatccttgccagattaatcttcctaaacctattcatcatttaactataccagaataaaaccttccaattttaggtccattgaagatagactgatattagaaatagttataccatgatatgataaatattattagagattagtcattatttaatgagtccttgactgttgtctagtaatatgctaagtactgggatagactggtttggtccctgtctgagtgtttgggaagattcacaaaggaaatgtcacttcacttggtgcttggaggtgaactaggaatttactacctgattctaatttcctactaattccttacattagtcaatgagtctccctgctctagagcaaaatggaatagttatgaaaggctaaatagcaaggattaaaacatttaaagcaaaatggaataacaaaggagaaactggaacttggtttgtatattaaactctaaaattttgtgtattttacaaatattctagtacctacttggtaaatttgattttttttacctaagtaagtttgagaaacatggtgctttaaagaaagagctaagatctaaagcatgtcttggttaaatcccatgataaggacccagttatggacaaaattgaaagtgttaaaaggcactcatctcaaacactaacagcagttctggctgcaggggagtaagggagttaaaggcaaagatataagaatgtggtatttggagtcctcaactggtgtgttaaatcattgcagcatgggtatacatgtgggaggtttggtgtgtggagggaacatgcacagggaggattactgttgtttctcacttggctgagtttgaatggaaggactagaacagagagtgggaaaatttgcattcctttcttcctctgggaaattcagaactagccaacaagatccaattaacacacatggaagtcaagggaccattttatggtaatccaacatacttaatcacatgtgcactaaacccaaagttatccactcaacccaataaggcatacccaatctcctccttatattaattgatttctgtgttataaaatgtagtatgaaagatgaaaagagtaaaataacatttatggagaatctgctcaccatcaggtattgtgcactttgttttttaggttattcatgtttaattccattataaaactgcaaagtaggtattgtttttaatttgtatttttccagcaatttattatggtaattttcaaactgaatggaatgttgaaagaataatacaataaatgttcatatttcctggattcaataattgttagcagtatgccaaatatgtgttatctatctacctattgaattatcagtcttttgatgtatctttccctaagtagatagccagattatcttcacagaacaatttgaaagtaagttgcagacatagtaattttaatactcatcttctataaaactataatggtgttaccacacaagagatgattaacagttactttctaacattatttaatagctagtccctattcaaattcccctactattcacccaaattatttatcccaatttttttcataaagcaaaattcaattatggttcatgcattcatttggttcttatttgtttggtgtgttttaatgtaaaagggtctccccaactttctcctatgccactggccttttctcccaacttttattttgaataattaaaaacgtatagaaaagtttaaaaaaaagtaaacaaatccctttacacgcttcaccttattcaccaattattagcgttttgccacgtttactctctctagcttgcttcttctaattctgtcatttcttctacatggcattttttctataaataagttttctttcattatcttaaaatgttatttctatgacttactgcttttctcttaactagcaacttttagaataagaagttggtgtaaaaatcaattctaataatgacaaatgattctcaatttttaaaaaagcgttatcattctttttgatactcaaattgttatcagattttcctaggggaatcccttcaaattgactttcttgttctggaacttttgctgcccaagatacagagtcagccatttcacaagatgtcctagctccttttagtagaaaatgataaatagacaccaagatctttgtgctagatacggtcgttgctattggggtatcactgattcctaggccttttagtgagcaaagataggaaatttatatatattttaaaagtcataagtagatattgatatttctaattcaaatctaatattgcataatgttcccttaaaatttcttgcttttatatttgtgactcctttctgttacactaaaatttttgttttcttagtatttttacttattcactttatcctaacaaatactgtcacaaataacattgtggatacgctgttttgtatttacagaggtatggctatagagtagaatcctgtaaacgggatttctgaattataggaaagagtcatatgtacttttgttagatattgctaaaagtactctcataggtattctaatacttagtacccccactagaaatatgtgagaattcctgctgcttcttgccaacagagcgtgttatcaaattagaatttttaccaacctgtagcatgaaagagtatctcagtggaattttgtttctcttatcagtgatgccgaacatcttttcatatgtttgggagccatttgtctttctgtttttctatatgtagtcgtttgtgtcttctgctcattgttctcttgggcttttagcggttttcttgcagacttctggaggctctttctatattaaagtgatcagatctttgtgtttgtgatataagctgcaaatacattttagtttgttattcatctttaggggaaaaatgtccttaatattgagcacatatgtttgcatcatagttacaaaagctttcttttctcttaggttattagaaaattattcataatcatgttttcctcttttcttctaatacttgtacattttcctttatttaacatccaattctatgatgcatttggagattattttagggtatggtgtgaggtactgatctagttttgtcctttttgaaatagctatacagttgtctcaatattatttatttaaaaattcctttttttataactgatttgagatgtcaactttatcatacactaaattccatatatatctgggtctttttctcaaccttatttctgtattcaatctgagtagtatggcaacatcaaattattttaattatagataataatagcctccccttaaaaaagtgaagagtcaaaagctttatgagataaatggtttgctaaaactcaatttattaataaaatatcagagctaggatttgatctatggccaccctgtcttggtaggatttaagtatacatttaggcaaaatatttatctcagtcaaataagtctatctgctatttatgtcagagaggtactctgaataagtggtggtttggggtagcttaaactataaatattaagaacacagagtagttttgtaccataaaaatgattattttgttaaaagtgttatttcctaatacatgaattttcctatgtactataattccaaaaattcttgaataaccctttatagaagcgagatttcacatgcataaatattattagagtataaatggcaaactttaaactgatttaagccataatgaagcttgaggatggggaaagtctctatcattgtctctatggcccactctcattgtctctcatggtgcacgtaacatgagaatctctatgatgaatgtgcattcttttacaaatatgaagaagatccactagtaagtagatatgaggcaaataaatgccacttgcctaatgttaagcagtttaaaataaaaacaaaaacccactggcagaagccatctggtcctggcaactttcccggttaaacacttttaattgcttctgtgatcttggtgggttggcatgccatggtttccagggatttaagagaattgacctttatgaagtaatcacagttcgttgcacaaaagaactctgagttaccaaagcaggcagcatgtcctgctgtggagccatgataatggaagtgaatcaagtgtgtgacggtttattatttgaattaaatttactgtgatagtctacatagtacgacttaatgttctacatactatgactttccaagggccaacagtgttcaacctggaatattctgtcagttttggcaatgaatcataaatatgtcatgacctataacggatttttttgtttatatttagggtcattcatgtgattccgaggtccctttcctatgcattgtcttgagatttttgcttaagagttgggagaaagtattcccaacataacattaattactacatatttgtatgtagatatgtgtatatctatatacatgtgtacatttttctcttattcatatctatttatgttgaatttcattcagaagaagcttattcaagtccactataagctttttatcttaatttaatattaataattatagttaacatttattgagcaattattatgtgctaagaactatgatcagtacatttcacctcttgatgcaggcaaactcataatttttgctctgaaaagataaaaaagctaaactctacactactgaaaaaaattacctaaagtcaaaacagatagttaaatcatagaaccatttaagccaggtcttaaatgtgatgccaaagtccaaactctgaagagattgagatatagggatattaattctctgtgctctatcacataactagattcttacaaagctagggttagtactcatgtttactgtctggcaaaccaccacactgagaagcttaagtctgaagctgaatgtacccagcatcatttgttgcctcctctttatccctgtagttgtttgttcatacctctgttgtagcagctgccattatacatattattctctgttgatatgcttgtgtacctgatgccaatatgcaaaacttgagactaggatcttgtaatattcatatatgctcccagagcacagagcacagcccttaatatatagtagcttctcagtaatgtctgtcgaatcggtcaatttagttcccaatacaaattatctctgtatgaccaactcattgcaagggtaaccatttttgaatattttagagtaaaattagattgaaattttgcatatttgatgtatgttgctgtatacataattgctaattcattcactaaaggtgaacttcagtttatgcccgaagtggagggcaagaggacatggattacattcccccttctccctttctctcttagtctactaaagaaaagagtataataggtcgatcaagtctggtattgtatgcctcttattttcagggacacagataatattgaaaacccacgggtgtgttcaagattagggattttcttccaggtacaacatgcatcattcacacattccttgtttcatccagcattcattgtacatcaaacacgatagaccctgaggatacagagatgagttgggcatagtcccttccctcagtgaatgcatagttaatttgggtatcataatcaggtaattaaagtacaatgcacccagatagtgggggcagtttcatctacaaagaaataatagtccatcaatactacctcatcctccccttctcttgtctcaagcggtgttgagctcaggcactgtctgccaattgtggtttccagacaacaagagtattaggagtgcagtccttagcacagagggctcagatatgaccaacctacaagaggccttttcttgagatagcatcactttctctcttctcctttctcccactcttcaaacttctctgatattcctgaggaggatgggccctactctgaccctctcatttctgacttatttttattcagagcagctggcttctcagaggatacatcccatgaggaatactgtagtaaacaagcctctgtctgaggaaaagacactgcctggtaagagaaaagaattaagcactggaaagtaggaaagcaaattctgtgaactggctctactccttggcgtgacattgagcaaggggctgaacctctctcagatccagattgtttttttccctaagtcaaaggtgctggctcagagatttcttttctgctctaatattgcatctctttgaagactgccttgtaacaaatagaattggattttatataataaatacctactcccatttatgcacttgacacttccgaaagctagctcttacgttgttaaaaatttggtaaaactcaaaaatcattcttcattgcaaaaagatcagtgtgtgatatctgtagtagcctattaaactctttgtaggttctgaaacctttccttaaaagactgggaccagttgttacgttggccactaatagttttgctcagctgaagtctaactgaagttagacatgttattgaatttttgtattttcaaccctcgtgagtgatgatgtagtcatttcctgttcaccattaaaaaacagagagagtaataagccactcctattgtcttttcatttctttggaactaaactggcatccctcttaatacttatattttactctgagtgtgaaaatgtgataaattgtgactttacagccctgtgaaacatgaagggtttgtttcttaacataggttcatttcttagtttttggacaagtattttagtagtagaggctgggcaatgtttcttctaccaagaaaactagatttatgtacatgcttaaaagcacagtggtcactgtgtttatcaattaatttcagttattttatatgtttatttgcattattaggtagttgttggaaaaaaggtttttaaaaaaatgttagtatatatagtcatcaaatagaatgtctaaggataaaagagatataggacctcttgcatgaacttccaggaagattgtaaattgtttaatttgtggttaaagtccctgactgcttgggaaccattttgataaatgggaccttttcctctttgatgggtaagaaggcttagtaagaaactgaaattattaattataaattatagaattataatagttatatacttaataaggactcgtgggatcatttagttcagtcttttcatttcacagatgacaaaagtgagtcatagagaagtcaagaatctacttaacgttgatgacatttcgccaaggatcttgatctcctgtctttctgatgtcttttcctatcatctgaactgatttttttttaggactacagagactcattcacccattcatttatccaggcatttactgaatggctactatgtggcaagtgttgtgccaggtgttagaaacacaatacataaaatgtagttgctgccctcccagaactaattgctctatctaccacaggaaaaaaactataaactggcacctttctccattctgaaaaaaaaaattcagtatacattgattcaatacagttgtgctgaagccctgccagttaacttttaattttgtgttcttcactctttatattacttctaaattctcacccaaagcctatcttgaacatttatcaagtcttcaatgaagtcctgaaaatattgatccaattattttatatcaatttttaaaaacatttttgtattactgcctatacatgattgattgacaggttaattaacttttccctatttctggtcatttatttaaaattatcggaaagcataatttaaaataaatttttaaaaagaacatatttttcacactacactcttacaactaatctaatcataagacatgcatatagaaaagacatagcagagaggcaaaaataatacctatagaaacagactaacctggatttgtgttctgtgttaattgttccatgtgtggcattcattggccatcttatcttaaattctaagcctccattttcttatgtataaaatagtgataacatcttccttgaaaagtttgtacaatgctaaaatgagatagtggcacatggtataggcttggaagaaggtgagcttgacaagtaatagcaataactcctacttaacctttagggattaaaattcatattgttataattttcttatttttttcatagtcttcctaatgcagtttcactaaattaagagagtttgtgaactaccagaaatatagctgaagaaattttcaggggccatttcatgtattttcctgcccttaggtcgaactgattaaagtatgttacacatatgcaaaagctgcttcttaaaaaatgtttcaatgagtctcttatagggtagttcagtgcagtaatttattcacttagaatgtggatttaggcaaactgctttacttgatcagcttcacattttttatttatatgggctaagaaagagctccacaagggcaagaacctcacctgtcttattcctcatcagcactagagaaatggttagcatataatatatacttcataaaatttattgaataagtgaattaggctactctgagacttaaataaaattaccacacacatgcatgcacatgcactcatatttaataattgactgacccaaattcatttattaatgtttgaagtaatagtgttaaaaaggttgtaattcatggatgtattaatcaactgattataatgataatttttctaatagaaaagctaagaacagggcaccaccaagaaagtgaatttgaacatgagagagatgtgtgatacctgagctaactctgtgtatagtacaaattttagatcttcattcttggaatgctgtatctagaacatccttcaaatatgattggttctttgttcatttgtttgcttgatgaagcaatattaacttcacttgatgaagtaatattacccagatgtcaaaaatgataagaacaaaaataattctatggcctaccctcgttcataaagatgaatagatcctaaataaaatgcatcctacacaacgcaatagtcaattgatgaatcatctattagaataaatagagtttactccctggaaggcaaagatgttttaattagaaatctattaccataaaacatagaatctgaagatcaaaaaaataaaaaagtatcattctaaaacatattaatcctatttgataaaatttaaaactcattcctgacaaaatttctcagaaaacctaaaatagaaggacactatttgacatagtgtagaaaagctactccaagctaacaatctctgtcatacttattgttgaaagactaaaagaatctccattgaagttggaaaaagtaaggacagttgtcatacctattatgctttaacattatttgaaatttctgacaacttaattataacatgaaatagaataaggtacatctcagggagaaggttaaattgctgtatttttgtcaaaaactcaagatatgggccaaatagaagtattaaaagatgtatacttctaactacttcaaaaaatggaaaatataattttaaattagatttataacactaacagaaaacacaacctacctagaaataactctaatatagctatgcaggatatagatgaataaaactacaaaatcttaccaactcttgtcaaatgtcgttcaacttaatggcaaaattatggggcagcccatattccagaatataaaatataaaagttgaaaaaaagttaaattttctagtattaattttttcagaaacaacctattatgtaccccataagtacatacacctaaaaatttctaatacttaatacaatttattgatggccaaataataaattattttaactaatgaaaggattataatgtttacttgggataataaatagagaagtgatattatttgtcaaaaggtataacagtaagtgggctatttgtcctattatatattaattaacattacaaagatacaacaattaaaatggtatactgctggtgcaagaactggctgacagaccaatagaatggctacgtgtggaatagagcttagtatgtatggtaatgtcatatatgatgaaggaagaaatgcgaatcaaagaggaaactgatagattattcaaaacatagtgttcataaaattgacaatgtgctgaaaaattgttagatccatgtcatattagcaaaaaaaaagagtagttaagagtgcaggcttagggactgctggagttcaaactctgactccatcatttactaggtgtataaccttggatatgtaattctatctctctgaactttagtttcttcacatgaaaaatggggattgttattacctcataaggtgtttatgaggactaagtaggagataattcatgtaaagaatttcgtgtactgcttgacaaagtattcactcaataaatattaccagtaatttttataattaaataccaacttaattacaaagatattgataggctaatgtaaaaataaaatcatgaaaacttcatacttaactgatcttggctttgaaggacattctaatcgtaaatgcaacagaagaattcacaaagaatgaatagatttgactacataagaacttcaaaatactatgtttaaaatagaaaaagtagaaaagccacaaataaaaaaagttattatatttaaactctaaagagctcttaacagatcaattcaaaaatcaccaacatcctaaacaattcacaaaaattacaacaaattcaaataaattaataacattctaacagcatttaagataatataaataaaataccaatgggtactgattttaagctatcaatttggcaaagattaggaaaagaatatgacaatattccaggtgacaagactggaggacgatgatcacttggatacttctgaacaggatttacttcattttaatgttttggaaggcaatttggcaacacttagcagaagtctcaaaaatatttttaccattttagtcattaattcttattccaggaataataatcaggaaaccaaatcagcattttgtatacttattttatcacagtattgtttgtaatagttgacacattcatgagatggaatattattcagccacaggaaatcatagctctgaagcacattagatggtgtacaatttcttacactaatagattaggaaaattataattagtagctatgccagtctctacatttatatctacatctgcgtctatatctgtacctgtatacagaaagcaatataccaatttactatcatttacgtagataacaggcttgcagatgaattttatttttatgttgtatgtgttcagattttctataataatcagcaacagttaaaaaattagaaaaaataagacaaatattaaaatatagatgtattctatgtattgcttcatttttagaagataatagtttacatgcaatgtaaaaattggtatttatgagatttgttgtatttaatcaattttgcacgaatttaattataaatataactttggaaaattaacaataggctttctctttagttcgtttgaaaaaacgtgagagagaagaataaaactgaggttatgaaattgctctcagaaacagctggaaacatcattcagggtcgcactctgtttaatgttcaatgccttttcacagggaaataagagaaatatgagtcttggcatatgttattttctgcatgaaagcttactaaaatccctggtgtatttcaattgcaggagtaacaggcaatagcattttagtgtctctgccatacagtttggcatttgattatatttagtttagcactttgtaatatactgtctttgtaatttctccctctatgaattctcaaaacattttgtatttttactgaattttagcacattttattccatttatcgagttgttattccactaaacaagttttattttgtagtatatccaatctcttaccagactgtcaactccctgaagtcaggaactatgtcttattcatttctacacctcctgcatctagcccagaattccttgcatatggagatagtactttttatatgaatgaataaatgataactatttgatatattgtctttgaattatttcaggttttatgttttctgttctcaacaagattagaaactttaggaggtcacatatggtttttgtacctaatacctgttaataaactcagaattattgcccacttagttaaattgcttaacctgttgttttgcaaagtaagtttggataaaattgtctgaatatggcttattagcataactcttggctaaccttaaactaaaaacaataatttattttaaaatgttgctgtaccttttttttaaatactaacttataacaagtggttgttacttaaaaccacatcacttccttttaccacttccaaatatttgatgagcatctacaatacatcaagcatccttctatctaatgagcaaaaaaggctaaaatttctcccttcacagaacttgcattctagtgaggatgggaagagaagaaacaaaataaataagtgaaatacgctgttagaagctgataagtgcaatgtttaaaaataagagcacatccaaaggaacagattcattgaaaatgtgtcactttagtgaagacttgaaggagtgaccatatgaatatttgggaaagagaatttcaggaataggttagagcaaagaatgagacctgagaagataatgtatgtggtgtttttaaagcccaaggaccaaagcagtgaccagttaggagatctgtagcaaaaggataaagttagttcatgacttcacaaagttgtgatgaggtatgaacttcctgtaaagcacttagcacaatgccttgcacatatcaaataattaattaatgttatttatcatcattatgggaattatatgagataggctcctagaacatttgtagaaaaagaaacacaagtctatttagggtgaaaactagggcattcttccaccatatgtctgggccaaacgtatctgattctaaggcattacttccttgcatagctacttgtcatgattcatatcatgggtaactacttatccatgcttctaaatacatttattaaaaatttggtccatgcagcttcagtgaatgagctgagggaatgtaagttgccttatcaaaatgcctgaatatagtcaccataagattgtcaacaggcttttcatgcaaagcgacatgaaggccctcctgctcagaatccagtgttccatacttgcttgatgagggttatgctcattttcatggatgttaggtcttacacacaaccttaatgtgagccaaattcctttaatggatgtgctggaaagatctcagtgctgtgaagtcaagaatgcaatttgagctgtgccgacaggaaacaaattgatctttttggcctgtattcctgaatctgaagcagcccttccccatcagaaaagactttcttagatgatacagttgaattcccaaatgttcctggatgtggagtcctaatttggatttgctgttaagcccttgaatatattttcaaatagcggctatgcctttttaaatgcccaatgaaaagtagaataaaagtctagtatgtgttgtatgtatgatccttagtgatactttctttctatttttttttaaccacttggcttctttttcacttccacatttttcctttgatttctaactttttttaaaaatgcatttgggcaaagagagggagcataacacagtcccagggtctcttagaatagtttgcttgccaaaggttgctgaggttaatcatttaggagatagacttggtaaattttgtttcctaagcaagcagcagaaaatagagtagaaaatcaattttggaaattaaaattaggtacactgcttaagtctttttctacaccaaaaccaaactgaataaaatggaaaagaaaaatagaattgggatttctgaaattctttatgaatctacttgcaatgcaggccacacagaaacatatacccaaaatacattgttaacacttgcattattactaaacgttaaatggtgtcagaaatggacaggtgtgaaatttcattaggaaaattgctgtaggtgaggaatagaagaacagaagttaggctgaaatagaataaaaaaggaaatagaaatgtttgacaaattattttagtttccccctgttttctttattattttatatttctttattatgaagtcattttttattccacctttttaagaaagcaaaacgttttcaagttttagatgctaagtgtccttattgaagaataattggcataaaattgcacatatttcaagtgcaatctgatagatcttgacatatatctacacctgtaaaatcatcaccacaaacaagagaatgaatacatccatcatcccctaaagttcccttttgctcttgtgtaaagccttccttctctcatcctatcattgatcaaccacttataagctttctgtcactataaatttgtttgcatcttccagtactttatataaatggaatcatgcaaaatgtgcttttttatttggcttattttctcagctggattatttggagatttgtccatgcttttgctcatgtaaataatatggttctttttattgctgagcagtatttcattttataaatacaatacaatatatttattccctcttaaggaacattggttttttattccagttttgggatattgaaaatacagctattataaaatttgggtataattttgaatgaacatatgcttttatttctcttgcttaaatgctttggagtggacttgctggctcatattttaggcatatgtttagctttttcagaaactcccaaacatttctgaagtggttgcagtatttaacattcccaaagcgattgttctattctacatttacatttttgaaagtatcagaggctagacaatttcctgagttccatgggtagtaagaatatatctatttcttctcagaggacagtcattccttccatgagaatagctcctaaatttttgccttcttcttcctccttcctttgtaccttatcatcttcctctggagattcagcttttcaattcatactgctaattggctaattatcttctttagtcatctttttatgagactgtgcagatgggacactggataaaagtaccctaactcagtcctcctgaattattttttccctgaggcaacctcaggtagaactatctccttatatgatctagcctgtcatgaataaagcctttatttgactttcttcaactcctctgtggcagaatagaattttgcaaagactgcaccaaataccaaagaaaacaacaaaggaaatgagtacagaaaataagaagaacggcttctgatcctcaacatagctaacaggttcacagaggctacagaccctcctccaaggaaaacagagaccatatgataggcattctgcccctacttgtggttaagagcagagattctgagttagattttggcttgcatgcggaatgtgccattgttggttgagtgtcaacccccaacaaggtacttcatttcttttagtttacttacgtgtaaaatgggaacaaaaataggagttaccacactgaattctttgaaaattaaataagataagtagttaagtacttgattcatattttaaaacttgataaatgttagatttggtagtcatcttaaccacacgaagcaaaatatctacaatataaacctgaaatacttgttggaaccttaactccaacaaacttttgggccttacctggtcttataattattgatcctatcatcttttatctggttcccatttctcttctagccttactaccttttctaccaagcttaaactctaggaaaattctttataaccagttccattacatagaacctcaactttcttatccctctttcagtatattgatttcataggatttacagttcagtaagaaaatcatgtattaaatagataattgtaaacaatgaaatgctcaaggacttgatctttaagctttttctctacttcagccagtgatcaaggctttacataccatttctattttgatatcttcctcaaactctggacttatatatccagtggcttacttgatgtcttcagtcagatgtctaaaagatatctccaagttaacatgtccagaacctaacttctttttttaaatttatttttttttgaaaatttatacatagtagatatacatatttttggggtacgtgtgataatctgatacgttcatataatcaaatcagggtgattggaatacctataatcttaaatatttatcttttctgtattttttaaatatatttttctgagtatacgatccatttgtaattcttttttaaacttttatttatttatttggagatggggtcttgctacattgtagaggctgaactcaaactcctgagctcatgccccaacctgagtagctggaattacaggtgcacaccaccataccaggttgtcagaacctaacttcttatgtttcttacaaaacctgctccatccacagctttcctttgagctggtgatgagatgacctttctggtttatcaggtcaaaatgtttggagtcatctgtgccactcctctttttctcacaggctacattcagtgtagcatacaatctgttggatctaccttcaaactatgtccagaacccaaccactttttaaaaattttcatattaattagtttttccaagttactattccttttgaatttgataactgtaataattcttaactgttctccctgctccaagccttgatcccctagagtcaaaatttttaagacagcaggagtaatcctattaaaacattagtcatatcatggtattgctcttagattgcttcctgtctcattcatagcaaaagccagattgcccacagtagcttatgaggcttacaagatctgctttccacacttcttccttcacctacctgtctagctctccaatcttattttgtaccattttcctcctcattctgttttagccatgctgttctccttactgttgtcaaatggtagccctagtcttcatcgtcgtcctcctcctcctcttcctcttccttttctcctcctcctcttcctcatctcctcctcctccttcttccttctttttttttttgttaacctttcagtttatttaatacaggaacaattacaattttacttgaagatgaaaatgaccattcaccatatttcacatgaatatacctctattcattcatctagattcatctactttttcaaaaaaccatatctagaatgtgatagatctgtgagttcaaacagtcccttcttaaggccttcacatactctttccccagatatcttcctggcttgctgtcacttccttaatcttactgagctttaccttaatcaacttatcagaaaaatttaaccattcccaacaccttttattccatttatctgctttatttttctctttagcttgtatcactattgaagagactacatttttctatttatcttttgtactatctcttttctgcaatacaatgtaagctccatgaggtagggattgttgtctgttttgttcattgttacgaccccattgcttataaacaggttggtgcatcgtaacattcaaattaggatttgttgaataaataaataagtggaggagggattactttatcacattgcttattagacatatatactcccgagttttccaggggcattaaaatctgaatatatctaaaacttagcatatcatgaacgctttcattttttacatgaatgtggatgtccccctaggcacagcataagctcccaagggcaaacaatgaattagaaaaaataaaataattgacaacacttctccatttcaaaaacaagaaaaaataattatctgctttagaagagtttacaaagaaaatatagaagccttaaatggaaattgtggaccatgagaaatttaatgagataattaaatttctaagacattaatttaacgaaagtttagatgcagcctataatattagaaggtaaaaggattgaagagacaagggaagaaatacaaacatttataatgaaagaagaggccatgcaaatgaaaatttttccttcgtcttacagataacttgaagtcccctgggctcaactctttagctgcttgacttttttttctcagcctataaagcagcagtcaaattttacagatttttaaaaaataatttcaaattttatttagattaaagggtacatgtgcaggtttgttacatgggtatattgcgtgatgctgaggtttggattacagatcagttatacacattctgttccctatgttatttcttctttcaagcatgaattaaataactcttttttttttttggaacacttattatgcaccaggcatgttgttaggcacggaggctacaatgatgaataaacaggcatggcctctgctttcatggaatgccctacaaggaaaccatgaaaaatagatgtattaaatagattattgtcaacatgataaacattgtgaaaaggagtgtattttactaagagaatgggccagggatttgaactcagtctaggacattaagaaataatgtttcttttattggtctttgcctttatttctaccatcatccccctaattaaggcccccattatttctaccaccttcatcattctccctgatctctaaatctgaccatgtttgtcatgattaaacatttattgacattgtctaattatgggtacagtgttttctgccttatttttctcctcaaacacatctcatgttttccaaccttcttgcttttgctcctgctgtttcttctggaaaaaaaaaaaaaaaagtacttcttgttctgatctgttttctaagtactaaatcaaattttctttctcacagtaagcctgtcttcaccaatccaactcatgggctaatgttctctgaactcatagaacttgctgcttttatttattttttttgtcataagctaccacatgacatttcttgtactgttacgccatggcttaaagataaggatgttgagagtcagacagggtttgaaaatctggaagcaagtgagaagcaaaccaggattcaaagcttaattcctctaggcaaatgaccttgaataagttaatcaattcctctgaaatttagtttcctaaatttgtgaaaggaatttgatattatctgactcaggtattttttgtgaggattaaattagttgagagtatttcttgaagtatgatatacataagatggtagatggaaaacatctttaaaaacatacttatactttaattttaatgtaattacttaaaaattgtaacttcagtatcaaccatcatcttttcaattagactttaaaattacttgtttttattttacttcttaatgtgattagtattttatttttattgtgttatttatatggttatttatttatgaaaacaaacccttgtgtttattcggatggcaataagttcccttttaaaataaatttatttaaataaaaagtgagtcaaattaaattttaaaataacataagtaaacaacaataaagatagtatgtaaacattttaaaaatggctgatgttagaccaatactaaggaaatgcatgttaagtactttagtggacaaaatactttgtgcatcttaaagtcaaggcacttttaacttcatataaagatgcttaacataaaaatagctgacatatagaatacaactaacaattcagtctccccttttctatctagttagccatgaagtatataacaagatgatgctattacaccttttttaaaactttgtatattttttaagctggagagaggttgcagttaatatcaggaatattttcagcaacactatctgtaattgatattggcattgaagatttcagcagctgctctttctgttttatgtaggtggcaggatggaaaatgaaatgatttgtatgttttcattagtggatctcatttttaaggaaataaaaagggattttatttattactgtataaattggttttatttattgtattttgcaaaagatcacttgttactgtgaaagagtaggaattacaaagtaaaaaaaatgtgacagcttataggtccatgtatcaataagtgtcagtgatttacctttagaaatggtgttttctgaagcactttgaacacttgttacaatgacttgtctcttatggtatgaagatgagtataaggtaaaaatgcaaatagagggtaataacaaatgctagataggtctctgtatagtgccttcctttcttctcataggagtgtgaagctgttgtattcaagtgatatgcttcattcatttgttcattcattaagcaaacaactattaaattattcaaaagatagttattattacctaccacgtgtggaggactatgtaggtctccgaggatacgaaaataaataaggtatgttacttttcttgagtgtttcataggcgttcggagggaaacataagctcaaagtaattacaagtaaatataataagaactaaatctgagttatgtacaaagtacaataagggacatagaagagagttactggctctgtctggtggttatctggaaaaattttcatagacatttatttagccacatctcagaaaatttgtcaagatttgtcacatataaaatgacaaggagcagaaagtaaggtggatagggctgcagacagcagaaacagcatgttcaaaggtacaaatttatagagcacattggggaaacagaaaataattttgtgaagatccaaagggatggtatggcaaaaatacaacttcatcaaaaatggccaccggatttaagagattattgtattactcattaattattgctcataaatgtcatggactaatacattatttgagctcataaggaattgattatgtagttcaatacccagagatgtgacaactgatggaaatgaaattaaaactaagactattgcttccaaaactagcacttcacctccatgaattatgaaaataattctgttgttgagatagctagaataccaggctaactgaattttacttaaaagaaagttcccattccaaagcagtcaggttaggtgagtggtgtttaaatgtctgtgttttttgcatgctttggaagagcatgtgaatttaaagatattgaattgcattctcagttactaaattattaaattaggcatctttagcactgtgtagctgtttcaaaaaaatggccttatttatgcattgttgtttgtgctcacaagtcaaagttctaatgttccattagatattccttcttgactgctggcttgatatttttctacattgctcgtgaggagctatgtcttcccagctctacgttccttttgatagttactgccattatcagtctatttttctgctgtaagaaaatttaattttgaacacatgaacacatgggtggtaaatcacagcatattaattcagatctactatataagtttaggacccatttgagtttttgttcttacaagaggtcctgcaagccttcttttgaggctctggaaagattctctaaataaataaataaataaataaaacttagaaaagaaaaagaaagaaaaaactactcataaggctcaagaagatatttatttgtctcagaaaagagacacatgggaacctggaagactttaaatttatgaaatatttttacaagtttgcaactgatttgttttctttgctaatggcataaaaggggagaaaacactgaagcagaaagaaggtagactttcctcacaggatgattaaacagaattataaagagcttttagaaatcattcttttcggcttcttttcataatattgagcatgtactgtctgtctagactattgtgattttgtcttccttaaagattggaatatgaataaaaataaaagcagtatttttattgcactcaggctatgtgccagaactactccaaatagtgtatatgtattatctcatttgctcctattatcaatactgttacatagtttccgttattacccccattttataaagttagcataacttttccaaggtcacaataatgatggtggtggtctgtcttacagcgtagtttagctaattaactattataatatggtgacttttgactaacattttaattagttgatttccccaaatctcttgcaggaaacacttaacaataaatcttatacatgttgttaccacacatacttattaaactctaaagcctcatttgcaggctagttaaatgatctagtttgattttgggttaatttagagggatgccacgtggacttgtttgtgtttgtgtataatgatggccacagcagtgagatcctgaactgactatggtatcccaggggtgtatgggactcaataaaggcatttagggtgagagtgtagggttttgatggacattcagggcaggacacttgacgttaggatcaccaaaggaagggaaatgaaactgagactgttgcataaaactgaaaacataaaaggattctcatttgtgaaaggactttttaaaaactttattcaccagcccagggtagcaacaaggatgcatgtttctattaggagtggaaaaagaaaaaaaaagagtaaatttaaacccaaccctattttgtggggagagtatagctccaagtcaaaaaaaaaaaaaattgatatgaaactgctcttgggctagtgaaatctctggacaactagaagagggatgtgcaaaattattctgtagcaacagttgcacaactgaaggtcgcagggactcccacagaaactataatctttctaaagataatctcagaataaaaatgtacaatacgatgcagaaaatactcaccatgagtgaaaccagtgagattagacgttcaggaaaattagggaataaaaatatcagataaagactacaaactaagtatgtgttaaattaaaatcatgataaaggaagaaaaatcataataaaaacagaacatgatagatttaaaaatatatatagaatgtctaaaaataaaaatggtataaacaattgattaaaaatggatactctgtaggtaggtaaaaaacaataaattgaaatttaaggtaaaaatagaaattagaaaatagtaattagatctgaggatataccctgaaagcagcacagaggaggaaggagaaaaaaatatgagctctatgaagcaatagtacgggtagaataaaatggtccagaaaaaacataacagaatttaagagaataatgagagtgagggaaaataaatatttgaagagttaatgactgagacgtattttttttttttttttttttttttgaggcgaagtctcactctgtcgcccagcctggagtgcagtgacaccatctcggctcactgcaagctccgcctcccgggttcacgccattctcctgcctcagcctcccgagcagctgggactacaggcgcccgctaccacacccggctaattttttgtatttttagtagagacggggtttcaccatgttagccaggatggtctcgatctcctgagctagtgatccacccgcctcggcctcccaaagtgctgggattacaggcgtgagccaccgcgcccggccatgactgagacttattttataaataatcagattaaagaaacagaatgagttccatgtacattttttaaaaaagaaaatattatagtaaaaccgaagttcaagaaaggcaaaaaaaagtatttatgcaaaccatattaagaaagacatatttcttgtaacaggcagcaaataggcagcaggttaatatcttcaaagctctgagggaaaatcattgtcgatttacaaatctgtttctatactctcattcaaagtctagtctactatcattcagttcagggaaaatataaatgattgggtatgtttaaacatcattgatttttgcagaaagactattaaaatgtatttatctgtaagaagaaaatttaatccagaaagaggggttaggattctaaaaataaagaagttaactgatagttattgtgagtaaactataacaaaaaatgataatggtgataataataatgactgatttggtggggaatgtaactactatagcaagataaaattaaaatagcgtacaataggctaagtgcagtggctcacgcctgtaatcccagtactttgggaagccgaggcaggcggattacctggtctgcctgaggtcaggagtttgagatcagcctggccaacataatggaaccctgtctctactaaaaatacaaaaattagctcggcgtggtggcacgtgcctgtaatcccagctattcgggaggcggaggcaggagaatcgcttcaacctgggaagcggaggttgcagtgagccgagattgccattgcattccaatctggacgacaagagtgaaactctgtctcaaagaaaaaaaaaaaaaaaagtatacaataataacatgacattttgcagatactataaaagtgctctattgtacaaatttatgaaaattaacttgaaaagttagatcaagtgaaaaggatgaatcacccttcaagtaacagtatttactataaagcatacataatgtagtactggcacaggtaaataaaaataggataattgttaaaaagccaggaaacaattatatgcacatacatattatctagatatataactcagggacattagaaatcagtaaggaaaaggaaaagcattattatatatcagctaatgaagtaagcaagtaaataaataagtaaataaataaataaaactggccatacatatgggaaaaatatagattcctaccttccaccataaattactatttttaattgttattttaatattttattttatcaccttttaagttattgggtacatgtgcaggatgtgcaggtttgttacatagggaaacatgagccatggtgttttgctgcgcagatcaccaacccatcacctagatataagcccagcaccaatgagctgttcttcctgatgctccccctttccctgcccacacccgataggccccagtgtatgttgtttaccctgccccaaccatgtgtccatgtgttctcatcattcagctcccacttataagtgagaacatgcagtgttgggttttctgttcctgcattaattggctgatgataaaggctttcagctccattcatgtccctgaaaaggacaagatcttgttcctttcactgtaaattaaaaaaaaaaaaaactttggagacttattgatgaaaagcaaaacatttaaattgcttagaaagaaaataaaatatttataaacttagaagagagaaaaaaatgataaaaatgtaaacataaaacactgaaaaacttcagtccttttaatttttatgaaggctctgtatgacaaaacatgaataaaactaagacaagtcagagattggaaacagatattttcaaaacccataataaaagattagtgttcagtatacatcaagtacttcacaagtcaataagaaaaatataaccctatttaaaaatgggcaaggggtatgaacagaaggaagttcaaataaccaataaatgtatgaaaacatcttaagtctcaccagtaatcaagaaaatgcatatcaagactacaaagagttaacattatatattatgtttcggaaacatgaatgtctgattacactgtgttatatagaatactgatctcttataaactactaatatatactactcatttaaattactaataatggcaactggagaacaatttgtaatgaatagcattaaagctggacatattctgtgatccaccaattacattttgaaggacctgctctaaagaaacttgtatgtacttaaagagagagctacaagagtgtttattgaaaattattttgaaatgaatttgaggaggtagggtggagattttacctatattatgaagaacttatttcttaaaaaattaatctgaatcaaatatgacaaaatattaacatttattaaatctggatggaaggtaaatgttacattaggttctttacatttctgatgccaagtatgttatgattaaacatatgaaagaagaggcacattatacattcaactgttgaagaatgagttttgatgattttaagaggagaaaaagatataggctttgttcatttataattagagttagtgggtttattatttggaatctttttttcacacttatctataactgggtatttcttcggtgcagaaatatatccatctgcagccgggccagtttgtagcattgactgtgatatacatataaattcatagtgacaattttttcctattgtccatagtgataaaacatgcaaagacatgtagctattcctttgctttgctttttaatatacattagcactaattattgcactttttccagctaatatttattagtgagtttatatcatataaataccgaaaatcagtaattttatccctgagcatcatacatttgtaacaaggccattcttcactgaaatttctttctttctttctttctttctttctttttttttaattatacttaagttctgggatacatgtgcagaatgtgcaagtttgttagataggtgtgcaagtttgttagataggtatacatgtgccgtggtggtttgctgcacccatcaacttgtcatctacattaggtatttttcctaatgctatccctcccctagcctcccgcacccactgacaggcctcagtgtgtgatgttcccctccctgggtccatgtgttctcattgttcaactcccacttatgagtgagaacatgtggtatttggttttctgttcctgtgttactttgctaagaatgatggtttccaccttcatccatgtccctgcatgaattcatcctttttatggatgtatagtattctatggtgtataaaggaccccttcaaggagaaaaacaaaccactgctcaaggaaataagagaacacaaacaaatggaaaaacattccatggtcatggacaggaagaatcaatatcgtgaaaatggccatactgcccaaagtaatttatagattcaatgctatccccatcaagctatcattgactttcttcacagaatcagaaaaaaactactttaaatttcatatagaatgaaaaaagagcctgtatagccgagaaaatcccagccaaaaagaacaaagctggaggcatcacattacctgatttcaaactatactataagactacagtaaccaaaacagcatggtactggtaccaaaacagatatatagaccaatgggacagaacacaggcctcagaaataacaccacacatctacaaccttctgatctttgacaaacctgacaaaaacaagcaatggggaaaggatcccctatttaataaatggtgttgggaaaactggctagccatatacagaaaactgaaactggacccctttcttacacctgagatttatttattcatagatatgtgtccccagctatatagggctctttgagaaaaagattgtactttattcatttataggcccttaaggtttgacatgtagtaatactcaatacatttttgtggaaaagcattgtttacattttcagtcacacaagtactaatgagaatatgttatgtagatgagtcacatgatacatatatacttagagcaaaatataactgttttaatcttcccctttctactagtttgtatagaagtaactaatatcaagatcttggcattcctctgaattgaagttaaatattatgtacatattctttaccaaaatattctacgtactatatattccacccttttgtttaataatcagctaatcgcttggagaacccaaggtacgaggatcacttgaggccaggagttcaagaccagcctgggcaatatagcaagacctcatctctagaaagagaaaaaatttaaaaattagccaagcatgatggtatgtgcctactgtcctacctaccctggaggctgagggaggaagattacttgagcccaggagttcaaggctgcagtgagctatgatcgtaacactgcactccatcctgggtgacagaacaaggtcttgtctcaaaatagtaataataataataataataataatttactaacatcagacattagccaaaggactatcaaatatacatatcaaatatgcaaacaaaccaatcaaaatctttgtacaattaattttttacattaacttacttatgtctcaatagttattttgtttggtctatattcaacactgaaattacatagcttttcaggccaccagatattaattccttggattgaattttggctctgtttttaaaaataattatctctgatataaatagattatttttaaacaaaaatcattcatgtgctaggcagaaaatgtatgatagttaatggcttgatttaaacattgtatttaccttgagaattcagaggaggctcacatagtgtgtgtgttgaggcatgaacccaaagctgcttaaatggattactgttgcatctcaaactcagctgcactggtaggtttccgtcataggagaggctttaaaaataaaattataaaggaaaaggtctgtccaggtactgattatatacagatggaaaatgtctgaaaaatttgttttacttatacagcagagctgcaaatgttatttatctcaatcagcagagcaatggttagagactagtaggattaactgtaggaagctgccacctttacagcagacacatctgcccacagagagccagggaagatggttgtataaatatggcaatgacttcattcagttgacattatatccatctttcaagcaacttttgctactgagaattttatggccattcttctattgagtcttctggtctttctcagtttgtggatttttctattttgtcatagatgcatttgacaaatatattttgagtatctactgtttactgagcatttgcataacatgaacacgagtcctaactgcactgtgttttctacctccaactgcctatttaagaaacaatagttattactgtcataagttaaatcttagctggcagggccaatttattttataaggatcttgtactataaaaaaatttataaagcctcttggtcaggtgtgtaaaaaaggtcactaaaggttcaacataaaggcaaaaccagtaaacaaattgatcaaacatcaaagatctctccaagccttagttttagtgatccatgaagttttaactcatgaagagaatgcaaaaattatagaaagatataaaaaattataatgtcagtcccatcagagtaaattaacatcctttgattctctctatgatatcagtggtttgaaagttcaaggcattttgtctcacctctttattgtctgattctgtctaaggtgttaaaaacaaaattttctaatcattaacttagggatgattgtttatccccgttctttttatctactttagtcttttagttgaatacacttttaactacaacatggcttggaacaacttgtgtgcagaaataataaatacctttacatcacagcaatattagagtaagctacggtcctgctgagtagctctttgaaaactaagcaggagttaccatgtatatttattcgttggatttctgtggcacttttcctccagagagtacagggtataatatggataaatttgcacaggggttgccttagagtgtcaaaaggaaattaaaggaaaggagtgcttgtaggagcatagagcaaaagaaatagctaatggaaaaaccaaaccctggttggcagcaaggcatgtcaaaggaggtagaagaagctgggctaccccaggggtaccactgttgactttttgggacactgaatcatttcaccacagcctatgtatccggtgagcactcgagatttctgttcaatatcatttgaagacccacaataatgatcatagactcatagggcaggaaaggaactttaaaaatatctgcccaattctcttaatttacagatgaggcacatcgaacccagagaaaacaaataaataaattagaagcaaagtcagggtcagaaacaagatcattcattccttgaataaacgtagattaaatgtgttgtgctaagcactgttctaggcacaggagttaccttagtgtgagtaacatgaacatgggttctgactaccaatgtcctgtcttacactgtcttgttctacctccaattgcctatgagggtattcaacatcctttacaatatacttttgttgttgttgttgttgttgattccacagatgaaactctcttaagggatagacctcaagtgactttgttaagagaaggaagttcttttccaagtgtctgcaagtgtgttgacattctttgattcttcattgctcatagggcacttctgtcagatcagctggaaaacatttactatattgagtctagtttgtgtgccactggaaggcaggctttccttgccatcatgagcagtttatttttgtcctctggtaggactggcaaagggctaaaaccttatctctcattggaagaaacagttgtctcttagcattgaccttatcttaaaggtgcctcacataatagtctaaactctaataagataatggaagtagttaatgttagaatcaaatgtgaaaattcttcaaaggagcatgatttaaaagctgccataaatctacctccccaaaggtgatatttcagtcatccactgaacactggatgtcactacaagaaaacctgggtttttttattttttattttttattttttttaaaaagagtagtttgctctttttagtttaacactcgatttgaacccctgtccatcctccagtaactatgtcaaaaaatcgtcctgtaatagaggcctcagttcttttacaggtacaactaatgacttctaaaactacggaccttcactcaggcatttgggaggagacttcatcctgctcactttgcccttggtcccaggccattctctaaagaaataaagtgtttaccttgtaagttgtggataaggctggctggtgggcagagaagtgatattccttggaccaaatggagctggggaggagaaaagagaaggatgcttgtgtttccagtcaccctaacagccctgatagtcctcttagtcctcttggaggatatgagtgggattgggttccagggacacctgtttgtgcctgcaggggcagattcatggtggttctgcctctccccttgcctggcagctctcttccccatgcctggcaattcctgtattggctgatttacctgcgaggctgtatgtggatctgtctttatgtggccactgccgccagcacgtactgtcaagatagagggaagccaaagcgaggattgtaactgcccaagcctagagagggaggtgagctgcctccggacttgactgcagcttcccttcctcctgacacacatggagtttggtggcgacggtgccggtgccgaagaactgcagacaaatacttagccaactggatgtgtgtgagctggctacaaaggcagcgcctgcctcacccggacctcctgctggcaggatgtaaatatacctgcagactggccaaacaggactgccttttctcccccaacccctccctcctcccaccctctccctcagctaaccagcatgagaggaactgagaaagcaacagcctgcaagtgacagctccagcctgattctgttcgtctctgagccgaggtgggaagttgattgtgcggcagcttcattgtgaattccttccattggcatcgctatgtttgcctctatctggtatgctaagaagctgggtcgcaggttcgtgcacaatgccaggaaggcgaaatcagagaaggtatggaatgagtggggttgaaaattacctttccggtttgccaactgcctgctctggaccattggtctgagtacagacgcagtctttatttgcttggagtgagaacctgcctctcactgtgaatgtggtccttgccactatgaaaaggggtaacacttagagcctagcttgcttgggaggggagcattaagggttaagcaagatcattggctattcaaaatgcgtggtgaaatcatcaactgatacagtgtcttcacagagacttaagattcctttaaattacataggatgaaagcaattgagcagctgcagtttatgcttgttcagagagctctctagtaaacttgttgctgtactgcattatttttattattgtgatctttggttctgaagtgggcgttataaatacctgagcctttctctagtacatgtgttacagtgtgtgtcctaggaacatatatctgggactctcagtaacgttgaccagactctacaggggtgcttggtatcttatcactaagccatcgtttcaaaagtgttcacaatgagcaagaattatatttataatcaggtagttgtggccatttaaagaatagatttgcatttcttgtattcagcatgaccagtcatttccagagaatctctgtgtagacttacctaattagttatatttccctgagaaattaaaatggcctgtaagtcctaaggtatattacatgcttggagataacagaagatgatagcttacatctctaattctccagtgctttctggggcactgtccaaactgtcatatttagggaatcaatatccaatgcggtaggcattggggaaacttccaaaggtaacaaaatcttgtgaaacagatttttcatattcctctgaggatatgatcttcagcccagtatctttactgctttatgtaaactcatgagattgacccagagatggctctcctggcctgtggcacagtgttttctctcacctagaaagatgccttcactataacttgctattcattccttcagagtggaaatgataaaatgaacaagaatccagtgatgaaccaagatacgaatttttttagctttagaagagaaaatatcactggggttctgactttagagcctcttataatgtccagatctgacaattttagaacgtaactgacttgttatttaataacacttttggtggatgagggaggggaggattgggctggaattggtctcttctccactctatatagcccagataaaaagattacaagcctaactattatgtgtcaactagtatcatatatattgaacagttggcttttgaggttgtgttttgttttgactttcaagtaattttgcaggaaagagacttgtaagtgggtcttttattggaacaaatgttttagaaaagtcctttcttcctataaaaattataagttgtatggatgagagaactgtcagagaccataaatggctctgacagccactgggagataatgtcttatgccaaattagtatgcaaagaaagttgaatctcccagaagcacttatttcaagcctggacccaaatgtaggaaatagcagctctataaaattcagtgtatagaacctaaaaagacattgatacaacaaagtaatctgagcttctgcttcttaaggagctagtaaggggctttcaatctgtcccatccatttctgtgatggctaatgtttaaaacaagccagaagaaaccaagtttgattttaagggttcaaattatttaattaccttactcagagagtaagatacatttacatcaggaaatctacattagagaactgaaggtttgctctctgagtgacaaagaccaaaggaaataacaactctactgcctttgtgctaggaagagagctaggaggagttaattttgaacattaggtcatgataagcaacatgaaataacatcttggtattttttaatggaatttgtattcacagagttcctgaaataaattaaaaggtgtgttgcctcaaaaaatgtaggcactcagtcgatgcctggtgaatggaaatagttcatttattttgtatacctaattttataacatagcttatttaaaactataattttaaattaatttttttctaagggttcagtatgtactttagctgagaagacagttaacaaataatacaacaagctgaattaatttacataatgtattcctataatatcaaagatcatatagttgcaaaacagtggggcatgtaaagtgctactaacgatatgttgccatggtttatcaacagatggaagaagatgtataaaataagattattattgaattttgtttagaaaatgaccagtatacttaattgtgaaagatcatattttagcatttggggagatatatctttacaatggacaatgattgtgatttttagtaccctctataaattctgggcttttctttttttttttttttttttcagtaggtgacagtttatttcttcacactctaataaaacaacctgaactcaccatagcccttcacttctattttaacactgaaaagtattttcctcaaggttggggttaattgaaaagctcttaataattaggaacatgcaagactaaatgccatcctaaacactcagtgtgacttattactagttgtcttgtctactgttttgcctcagctaatgtcactagaactcagtagcatcacaaaatgaccatcataatgctcacaacaataataatattaatgatagtaatctccatacagcttatacattagcttctttatacataaaatttaatctaattatcacaacagccctattaaatagaaattatttttcctgaatcctagagagaagagtagctagcccaaggtcacaggattagtggtaagtctcagtgttgggatttgcaccaagtcagcccaaggtattccaaaactgactccttgtgtctctagcgccttcttccttccactcatcattcttctagatccactaatctgtcttgtctgaataaggttactcatcttttcttatcttgtccctctcttttatattagaatttcaaagtgataatgtttacagaatcaaagttactgattgtgtaactcaacctctttatttcagataagactatacataaactatattgaataaacagttttctttcatgttgttaaagattttacattctttgtcctctatcattggttaagtgtagcaaacttgttttgtcacctattattctttttttttttttttttgagatggagtctcactgtagctcagactggagtacagtggcacaatcactgcttaaactgcagtctcaacctctccagactcaggtgatcctcccaccgcagccttccgagtagctgggaacacatgtgtgtgtcaatatgcccggctaatttttgtatttttttgtagagatgaggtttccccatgttccccaaagtggtctcgaactcctgagctcaagtgatctgcccaccttggcctcccaaagtgctgggattacaggcatgagccaccatgctgggacacctattattctatttgaatagcttttaattgtcatatcattttaaccttaacgttggcatttgtactcattgcttattcctatagaatccaaaaatgtctttaatcaaaaaggacctaaatgcctggcaattgtacatgtgctctctttttgaaaaaagtcaaagatgttaggtgattcacattgacatttttctaaataagctacataagagattctttgttattctttcatttaaaagttcatttgtaccaacaaattctctgaataaaattattttaaaagtgataatgtgaaatccagattgcctggctgggatagaatacctccattcaaataattattcctttcttctttgttttgaccctgtgtaagtaattcagaagttagtatcttacttgtatgcctgttgtcacgtttcaacttaaatctcttaattagacaatctccagattgtcttactctaaaaggccagttgaagaatctttaagataaattgaaagtgcaatttctggttacgtagtaatatacaagagtattaaaataccaaaacttgtgaaccttcacttccccgtcagcaatatattgcttatttcatttgttttgttttaatttttatatttatctttttagtgcacattatgaaaagtactttcatgatgcatttaggaaagactagtatcaatattcataatctaacagacacacctgtagatgagcttggcagtttataacctatgagtgatgtaaccaaccccacatatcctgacattaggccatactcaccttggaaaactttttttgaatttttttgacagggcctcactctgtggcccagactagagtacagtgatgtgatctcagctcactgaaacctctgcctcttgggttcaagcaattctcgtgtctcagcttcctgagtagctgggactgcagacatgtgccaccacagctgactaattttttgcgtttttagtagagatgggctttcaccatgttgcccaggctggtctcgaactcctggactcaagcaatccatttcagcctcccatagtgctgggattataggtgtgagcccccatgcctggcccaccttggaaaactttttaaaaaccagcacactagttctactctcccccttgtctaaaccaaacacattaattcaacaaaaactaaaatggaggataaactagtaatacatttgctggcagtaggaccaaggaaagagaattatgtcctggtgatcttagtagaatataaggggcaccaggtttcaggcaaggatttagagggaggggattaaattagccttgctctttgctatccagcctgaagtcagtcacttggtttctctggcctcagttttctcatctgtcaaatagaagtaacatttatgcttcagtagatctccaatgtcctcaagacagtgttcaaaccattaatataatctacaaaacccatcatgatatggcctctgctttcctctctgtcatcataccttgtacctcttctatcagcactttaaatccagaattctgaactactttcaaatccctaaatggcccatgctctctctagcttccaggattttgcttaatctgtttggctaaccagctaatcacagcctggctgtatccatcacttattccactctagccttaggtgacatcaccatcactaggaaacttttcttggcctctaaagcccaggatggatctatcatcagctcccacagcaacttgtgcatttgttgtaattatcttcatttttctacaatcctcagtagatttgaaatgaatgatttctcaatcttattcaacatatttctagggtctaaaagaatgcttgacacatagttgtctttcgtatgatatttaattgatttgaagttgtcatcaattttgagatgtgtcattatttcatctattactaaaaaaaagattgccaatgaaaccataacacatcatgaattgcaagatgcatcttgatttcacaggtgttaaaaagtgaaaaatatttattcttagaattaataatatatgacataatggtgaagaatgaatgatttactttgaggataaaatgagttaatataaataaagtgtttaaaatattatacttgctatcaaattatttttatttatctggtaatattaataatagttttcatacagagtattatatggaacactgagatatatcatatattttgacttgtgccagtcagactcaacaaatattatgtgtcctattctgaatttaggaaggtaaatgataaaggaaaaaaatgaaaattaacattatgaaatgaattaaaagatataatcaaactggaaccatttagattgcagaagagaaaacttaagaagccttccagactcccactatatatttatatgtctaaacaacaatggttaatatttattgaatttgttctatgagctgagaactgtgaatataaagacccagtgagattattactactagtttttagagagaaaacatatcaccagtaggtgactatgattagacatcctgtatgattctagaccttgatctcctcactggtagataatactctgcttctgtatgtttgcgtatactatatattgtgtgtgtatatatatgttatgtgtaatacatattatactatgtttataaaatcatgtaggtttatgatgagttagatactaagtttatttttcctgtgaaaaataaattttaaaaattaaatgcaaaatctgaaatttatctcaggcataagtagtgtcctgatattgaagattcaccagtcctcagtgatcattttatttctatttttgcctcatagtagattgaagagtggtctgacctggagagaaggatgaacagattgtcctcttagatccctttcttagaggcttgtgagtctctcaaagctcctcagttgtgagcagcagcatgactcagcgccagtgtctgcctagctgtggtgacagagaggacaggtgtttgtccatgctgaacgcagccctgctgcagttctcctctgtcacctggaaggtgaatcaagcagcaaaatggacagtagcacctgttctgaggtcccagaactgctgcccaccctggcagagcaaaaagcacaactgttataaggtcagggaaagtagacaaagggcaggatcagagaaatggccaaagtgaaggaaggcaggagtaggctggagggcaagatagttggtcacaaaaccactgtaaaattgtgactagttgtaggaatgactattaagcagtttactcgagcattattacatgtattttacacataccatctcatttaattcttactacagccttctgaggtactcttattagctgcatttccttctcttttttttttcttttcttttttttttttgagatggagtctccctctgttgccaggctggagtgaagtggcacgatctcggctcactacaacctccgactccctggttcaagcaattctactgcctcagcctcctgagtagctgggattacaggcacccaccaccaagctcagctaattttttttgtatttctagtagagatggggtttcaccatgttggccaggatggtctcgatctcctgaccttgtgatctacctgccttggactcccaaagtactgggattacaggtgtgaaccactgtgcctggctattagctgcatttcatagatgaactaaggtataagatgttatgggattttgccataggtcacaagtggtggagccagcattcaggaacaggtttactgaatctacagcctgtgaccctagccccaactcatattttatgttcttctttaaacctaccttcagttggatggacctctgatatggagaagagataagctggaaatgagacctgacttctcagttatggtccttcagaaaccaggtatccagatagccttgtttcagtctagtttacaaaactttaattgcatttttttcttaatataactttagaatgatattcctctacctgatattgttgagtgatattacgttggaaaatgaagatgaaaggagacattctccaacacagcaagattaatttaagcatgattatcattgtaaagataaatttgataatcagataatctgcatgttttatttgcacatgtattgcaggaatgaggctattagagaagccatcccgctttaaaaaatgcctcgtagtatttgcttatatctgaggtagtcttatttcctcaaatatcttattaaatctttaattattaaaccattataaattctgtcctatttggtctggacacctagcatctataaggtcctaaatgaaccctggttggatgattcacttggatgggacactctcagctgtattaagtataggaattaagaccagattagaggtcagtaggcctgggtgttaactggctctgccccacaacctgtgccaccttggttaagtgtccaagctttcatgggcctgagttcatctgcaagcagattcctccccactcaaacattttttgattctaattctgattttctataagactgcagaatccttaaagggaaagatttgtactcatttgtctttgtattctcagcacctagcaaaacgcctagcactagatgaaacagaacatttatgccaaatgactatacacaaaaggtctggaacttccttgaccattagtaagaagaatgtaaaggagactctgtccaccttcaaagtgagagcaagatgaaaaatgctcaggggctcttctttttcaaatgccttttttctttggagaaagaggaattatgaggcattttatagcattgcgtttgaggctttggttctcttcctttctcaccctccatgccactaacactgaagtaaaacaaacagtaactagcataaagccagagtcttcttcagccaccaacaatgacatcaaactaaaattttccagctgccttatcccacatgccatatcattacaagcttatagttgaggatgaaatgtttattgtttgaacactctcaatcctaaaattccagttatttagagaatctccatcccacctgctacagactgaattgtgacctccccaaattcatatgttgaagctcttgtcctcagtgtgactgtatttggagataggacttctaggtggtaattaaggttaaatgaggccataatggtggggtctgaatctgataggcttggtggcattgtaagaagcggaagagacagatttcttcatctttgtctccactgtgtgaggacacagagaaaaggcagctgtctgcaaaccagggaaagagagctcactggaaaccataccctgatagaaccttgatcttatacttcccagtctccagaactgtgataaaataaatttcttttgtttaagccacctaatacctggtattttgttatggcagcccaagctaagggcttgttataccacctcccaccattgtagatatatatgatgatgtctaataaggagtggtttttagtgcccaaggccagcctatcaacaccgggtagaaatagtgttcttttttattcaaaatatgtaagttctgataaacacatggattcagcagagttaacaccactcaatcttttgaaggagctatgagaggttatttaaaatggtaatatattttttaaaaaggagaagtagagggtaaggggaatgaatgaaatgcttttggaggatagctttggttgtctttatagttgtctaagctacagaggaggcaaaatgaatgcaaactattcacccaacaaacttgataaaacaaaaaatacatataactcacaaaatacttttcttctcttccacacctacttgttacattaggtcacactgatttacaaacaattgattgattttccctatcataccattcactgttcctcacaagctagtcttggagaaagttcctactatcagaagggctggtaacttttcaccagggtttgcagcaagaaatgacaaaacaagtactgttagaggtattgaggtccgtggtattcctgtgcttgttagcagtgcagatctatgtgatttgacagacattttggtgattccctagcatgggaggggtaaaaatgtattttctgtggaaaggaaaaaaagtatattggggttaggggagttgaaggagggacagtgcttgggaaagtttaagaagattgagaaaaataagtctttttcttgttcctttcctatttggacattatcctggcataggactgactttcctatatatttttttccccaagattcctgtaaaagttctttgtcatcttcgttgacttctgtcctttacccattttgtgaatcctcttattggcacaccacccaagaacagtaaggcagtgaaagactgtagacctggcttcaagactggttgggtgaccttgagcaaatgactgcacctctttgattattagtgctctcatgtattaaaaatggtgataaccaccttttcatgggtttatgattcaattaaaactgcatgtgaagaatctacctattgtaaaaactttttcttccgtacctcctttctttcctccctccctctcttctttccttccttcattccctttttcctttcttcctaccattcatttaaatattctgcctagttctagaaagaatgaaaaatagttctgctttacctcttcaccaatgatgcctcttactctactatccccctgggcttccgaatgaactttctctgtcaccctggttttataaaatgaggaggtgtgtaattatatctctgtctttggctagaggcagaaaatgactaagaagaacatctttctttaactagttggaattgttagtataatgactctgagagagttctaggtttttatttccttttaaataattttctagatcctccttataaaatattgtccccctgctcccagcctttcccatacattctctctttcaaaatataccacccaacttttaagagagggattccctgtttcgtgagtgccagttaagacatatcacttctcctttgaaaggaagtattatgtgctgaatgactcaagatgcttatcttccagctgataaatgtatcacttgacgtttgttgctttatttcaagtcttgggaaaaaagagaaaagagtcccatgcaatgttacattgaagttcaaaactagaaaggaccttcctttcgtagataataataataacattaatgaacatttattgtgtctttactatgggccagtcactactctatgattttatgtgttctaatttagcaatattcacaatggccctatatgcaaagtactattatatccacatttttacagatgaggcaaagaaaggtcaattaatatgtccaaagatgcacagttagcatgtcctaatgccaggatttcaacccaagctatctggacctgagtccaaattcttaaccatgatgctacagtaacttctcatgcctttcaaatgagtaagctgagtccccaggtaatatgaggtttaggaatttttttggtccaatatctccccaatattgatggccaagttttggggatttgaacctagatattcgcaattccaaacttcggcctcattggcttcatgcgccactaagatgtacgcccctacatttatttctcatgatcaaatattgaggagtttcaagcactaccattaatgtctttggtaaacagtacctgctaagttcctctttcatttaaccaaaagtattattggttatattcatatttttgagtggtggtattgataatctttcatgaaattttcagttatataattgatgtgactttaccatgtcttcagtgccctgcttccattaaaaaacaacaacaacaacaaaaaagtcacccaacaggatggcatttggaaaacaattccacaccagtggttgcattaattgctactttgaatgttcctgctgtgaattgaatggagtcactttggatctatttcttagaaataacaatttttattacctctgctctaggatgcacagttttgagatcttcagaggcaaatatcttcactaaccactttctcttttctgttttctttccataagtaatccttttcattgttatgactgtttttaatgttctcagatttaatttatgaaggataggggatgttgtaggatgattttgtctcttgttatctcagcatatagcattccgttaacttcccaagtataacattttgaatatcatgtttagttcaaatatccattattttattaaagttgatgtttttctttatgtatatgtagaatttacaaaggctttatgaaaatggcttttgtaatacacaagtaagaatttcctttagcagtagtcatttctttagtgagtgttttgaaaaaagcaggataaaatgtagtatgatgaataatgcttgttagcagttatcagctacactatgccttttagaaagcaaattccaatacaatccagattaaataatgctttccattctccagtttcttaaaatcacctatgtagttgtcctgaacaatttgaaagtcatatcttctctatctttccaggttgactgtagactgaccccaggaaaataaaattcaggtaaataaatcatctgcagcctttgaagtcaattaacaattcaacaaatactcatttgccccttggtattaaaaaatacttatttgcacagtaatattaataatactgtgctgggacttacaatgatgcatggatacagaaatgatccagctatggtccctatcctagggaagtttaggtatagattggaaaaatctaaaaagaagcatacacaattaaggcaaacacttagcaaactctatactgcttaaacagtgtaaacaatatgccagtttttccctcttatttattctgtcttgcccagaccctctttgcttatttgctgaatcttaacattcttgagctctgtgatcatgcctgattgcacaccacctggtatatcattcattcactgagccctgttctccaagattagaataaaacacacgtgctttgattacattcttaggaagcacatgtgaatgtccataatgtccttctacccaccccaaaaaatgccttaaagaaactgttcttatttttaatacttctattaaaatatattgatacataaaagtagagtatttaagaacatggtttctagatccaggtttccttgtttcaaatcccagcactgccatttactagctgtggaactttgagcaagttacttaaacctcgtgtgcttcctcatctataaaatgagaataatagtgcctgtctcataggcactattataagaattgagtaaatatttttgaataacaggtattacctaagtttttttttaaatgaatataatgtgacaagtcattaagaaagatattatggggtgcatacaattctttggagcttctcagctaattggccaactatttcatgtcattctctgcctctgattttgacctgtagtaggactattttgaacaactttgtaatcacatgctccacaatatcagcatggatgggcaagcacatttctgccctaatatagcaaccttgagtttcactgtcactgagcagtacttttggaaggtgactctgatttaagcagttgatcttaccagagatactaggattactgtcatttgattgttgagtcattaacttgaaaagcatctattcaagagtgtctgctttgatatctacccaagagagcatcatctgtggaggtagggcaatggcctctaattagtataatagacttctgtctccctaaagcaccagttctgcttttgaaaataagtcagtgtccagcatcactatttgttgctcaattatatagatacttcaatgtgtttttctgcatttatggactgtttaatgtttaatggaggtaagtacattcaaatagcagaagatggcttactgttgcatttatgattaacattgtatgttcttgaatgtgtattgcctatgtatgttttcatgtcacacctatttataatttatgtaattgaatcactagttgagcaaagaacatgtctttctgaactatttttttaaagaaactggacactaactttgagtaattaaaagataatctaaacaatctataaatgaattcatttaagagctacctcacagtatgctgagaagctgggatgtgatggtgaacatggcctattcagtactcaacattcaacagtgtatgaggaagacaacaataaaggagcaattgcaacatagtgtgatgaatatgatgtgtttagggattttatacatttccattattgattgagtaaatacttcataagtctgtgaagtagtccatcttagatgataaaaagataaagtaggttggttgggattttattttttaacacatcagttacagtagacaagtgccaggcatgacatggacacagttgaatttaagtcgaactattaagtatcttagtgtactaagtgagacaaaatatcatttagttatcaaacctgaatgtattatttttattgcgataaaatataaacataatataaaatttgccattttaatcatgtttaagtgaagaattatgggcattaaatacatttgcaatgttgtacaaccatcaccactatccatttctagaattttcatcataccaaatgaaaactctgtacccttctgaatattaacattaatgaaaaaatgttcagaccttccccatttgaccttgccataaaatgtgctgactaatttacaatagttccatctaccctttacagttattctgagaatgtttcagaaatacttataaatctttcaacttccattactactttgataagattttgtaacaagaaagcaggagaagtgactttgggtaggtctagagtcatgatgtttaagcattttgttgcaagtaatacaatttaatttcaactaagtacctttagctttactaagattagtaattaaatatttagttgtatactaaattagctatgccatgtggtcactggaaagtaggtactccatttactggaacataaatgttttacaaggtattgtaatataactagtaaattaataatgacaatttaggtttcagctaattaaattcttccttagtatatattaatttgagggtctaaactaaaacaacttcaactatgataactgctgtaatgatttagctgtgcccaatcatgaataaaattgggaaaattgaatgtgcgtaatgagttataaagataagttagtttccaactgtctttataaattttgattggcaaatctaaaccagaattaaatatgcattaaggagagagactttatggtcaacttcatacccttattcagacagaaaatttttcaagaggattgacaccattgctatagcttacaatcaaataaattttaaagagcatgaccaatgtgcccagaactgcggtaggctattaaaacatcataattaagatctctgaggctcagttttgttgctattgttctttttctaatctgtaaaatagggatactagaggtaaatcacgagcataacagtgctgcatacagtaagtgctccagagtcaattcatttattcattcactataataagtagtaattagaatgaatgatagatgcataatgtattctcatttaagtatctaaaaataaaagagacataatttgcccaagtaccttcctcaactctgaagagttcaagcgcctagtgagggagagatatgtttgagtggacgaccatatagcatgacaattcaagtgtatttttcaaagttgtgcgttatagaggtctctagactcaacacaatttgtaggcacaacaggagaagtagacagaaaggagtggagccacaggaggcctcggagaggggatgatgctcgaaaatacttaacataagaagtttgacaggcagaagcggtgagggattcattccgagcagagaaaaagagcaaagcacagattcctcaaagagcatggctttttcatgaagctgcaggaaattcatcttggcctgagcagagcaggtacacaagggaatgggaagatgtgactttgcttaggtcagctggggccagatggtaaaaggtttggtttgttatctaaatagtacgaattatttgatggaggatggaataacagtgtcactgatgggttttaaggtgagagagaggttgataagatcagattcagattttagaaaaacttatctggtagcagaatgtggagagtgtattagaaatgagcaagagtacagacaaggagacgctttaggagacgtttacagtattctcaaactttagtgtgcatggaaatcacctggaagtcttgataaaacacacattgttgcactctacccagagagtttcaaattcagaaggtctgcaatggggaagaatttgcattcttaacaagtttactggccccgcttgctgctctgggatcctgttttgacaattgcagacataaatataccataaaagcctgtcttaatcagtttgggctgctgtaacaaaataccataaactgggtagcttcaacaatatttatttcttcacaattctagaaactggaaagtctgacatcaaggtacaagcagattccatatctggtgagagctcacttcctggttcatagacagctgtcttctcactataaccttacaaggttgaaggggaagggagtgttctgggaactaacttataagagtaccaatcccattcatgaggctccaccctaaggacttcaagagctccacctcctaataccactgcattgaggattaggtttctacggatgagtaacagaaaacaagcattggggccgggcgcggtggctcacgcctgtaatcccagcactttgggaggccgaggcgggcagatcacgaggtcaggagatcgagaccatcctggctaaaacggtgaaaccccgtctctactaaaaatacaaaaaattagccgggcgtggtggcgcacgcctgtagtcccagctacttgggaggctgaggcaggagaatggcgtgaacccgggaggcggagcttgcagtgagccgagatcccgccactgcactccagcctgggcgacagagcaagactccgtctcaaaaaaaaaaaaaaaaaaaaaaaaaaaaaaaaaaaagaaaacaagcattggtcactgtgctgaggcagtgaaatacaagcggcaaattaaatctcattctaaaggcctgattggttggaagcaccctcgtgatacattttttcctcctgaaattttgcttgaataacacaatgccttaggcatttgatgatgctggtgggtgttgggggaaataaagtgaaccagctgttttctactagggtcagagtgagtaaaagtgacctgtggttctcagtgactgttaatgcagtaaatatccttaggaatatcgtatttcaaattccactgttttccattcagagtgggggaagaaagggacttgtctcttcacagagttggttatctaagcaggttgctgtctaacataaagtgcggctcttgcagtcttgcatatttcctccgttttcagctatattatggtcaaaggagaacctggctgagttttacttgtttcaccatttcagattttttatttttaaagtaaccgtatactttactaagaaggtttacgtgataattttcttttggttgaacaagatttttctcctgtttctgtttattctgtgtgtttgtttttaaggcaaacatgatctctctaattacctttcattgtaacgaaggtttctctttcctgtagccccagtgttgttctagtgaaatgagtttcatctgctgagtgtaggaaaaggttttaattgacataattaacactggtgtggttatctccaatttaaaaagaggtagttgattcttccagaatgtgaaggtattgcctgatagagccaagcacgcagtgtgtaataatgaaggtagtttgggaagaattttctgctcttaattaggagcaaaatgggtagccttttgtcagcaggaggctcaggacacaggctaattgcgatgaatataatgggattacctcacacttgagatggtactcgcactaaaggggcacagagccttccctgcaaatctgcactggtctgggggtggggatcttatagagggatgttttgaagatataatttattgtctagttcggaggacttttttcccttctttctgtgtgtctgtcttgaaagagaaatgatcataaaattatcggcatttctcaaacgtgtttttaatggaagggcttttcagggttgttttgtatatgagacagtatgttcaggatgttctaaatgatgtccagaataaatagattttacttctgtaagcacttggtgtgattgcctaatattgcagctcataaatgtttatgaaggtaaaatgctattatattagtttgtgtaatttctcccaggcataaggatagatattggggagatattattgaatacaaaacgtgttttgaaaacatgtatagaactttaaatggattttaatttcaaagtaagcacaagtttgagttaattaagcaccagtgatcttacacaagcccaccaaattgagtaatatataatatctctctctctctctgcctgtctccctattcctcccctcttttttctccctctcgccttctcttttctgtattttttcatatattcacaaaactttgagttgtgtctaccaagcaatgtgtagagcattaagtataccaggacagataagagagaacatttgcccttaaggagtttacattttaatgtaagaggcaggcaagcaatttgtgtctccaagtcaaaccaaaagttttgcatatactaaagagggaatacatcattccagtctaaaaatagagaatattccaaggaaaatatggaaaattaactgattataaagaagaaaaaggattttgataggcagaagagggtaggacagcattccagggtgagaaaacagggaaagcaacgggataagagcattttagggaacctaagcgtatttattctaggttgagaatagggtatagaggagggaactaacagttgcatctgggaaggaaggataggaccagattggggaaagccttgcatgctgtagtaaggaggtagcagcacctaattgcatgaacagaaggtagacatggtataactaattcaaaaaccatttggacaagaaaatacagtgcaataatggttaaaagcatggactccaccaggatttcaaactcaggactttgtttattatttaattttgagtaagttatttcatgactctgtacttcatttctttcatctctaaaaataatgatacctccttcatggttttggtataaggacgaaattaaatggtgtatataaagtccttcatatatcatccaactattattctggactagtattgttgctcttctttttatcatcttttccactgtcacttcacattgggacttttcagcccctatgtgttcatagaactaaactagaaaataacgttgtattctggatcttgtaagtcttactatgtgccaggatgtatggaaagtattagcaacacagagatgaataagagcccaacatacaaataaggaattgtgctgccgtatggtagcaccatatgcaaactccttttaaagtgcttttgaaatatgaaccaatcactacgctctaaatggttatggtcaaagagcaaactcatattatcttaagattagttataagaaacttggacattgagtttggctcttaactcagtatattaatagacagcaaggaatttatttatattacatgtaaagtgtataatttagcgttgagagatactgtaagagtataatcgggttaagggatagggagataggaagtccattcccaggtgttacagtgtacaaaaagaagttcagttttataagtttcatccagaaaggcttcctgaataaagtgagattctaatgctgtttaaaagccaggaaaataatacataaaatggtggggaaaaaaaacacgtcttcatgaattctgtcattgttttgaagaaggcagaggcatccagtgagaaatgaagagctgaggataggctgtgagatgacatcttaaagaactaaaggggcaaggtgggcagagaagatgggcatgggtcagggttgggtatgtgtttgtggcaccctagcaaatggctgtagactcagacgaagtcatcaagagccttggattttcaaactgacctggaaggcaaatagatgattgtactggggagaaaggaaagtaccgatgagggactatgtatgatttaaagaaggctgtgatagtttgggaaagagatggactttagtacaaggagaaaagggaaggaaattcgcatgtattgagcacttaatatgtaccaggcataatgctagatactttccatgtcttgttgcatttcaacctcacattaattctgtggacagatactattatcactgttttataggaggggaagttgaatttcatttaaaatgactttcatagatcatataataagtgtgaattaagaaatccaagcaaagtgttcacaatcagaaagtctaaattcagtgtttccgctaaaccacagcatatctccatccatccatttattcagtaactaatcacagagcccttactgtgtgctggacactatgttgctgtcttcacattcttgctgttcaccaactagctgcctaatcatggaatctgcatttctgtgactgttttctcaaatattaaataggcttttgtgtggctactttatcagtattcgtcgaatccaaattcatatttcaataattataaactaattgcaatccattcttttcaattccccaagaaaacacaaaattcaatatttggcattattttattagtttcattccattatttctgttatttactgtaatggttatgaagttgatattggtataataatgttgataataacaatcttttaattgagcacatatactgtgtgagatcttgtgttaatgtaatgctttatattatctcatttaatctttagcagaagtgcatgagttggaacaatttgactgttttatgtatatggaaactcaagcttcaggagcttcaatgactttgctaagatcacacagttaagtgatagaccaggatcttaaatctcaaaatgtcttatcccaaaccacatgtttttaatcgttaggtgatattgccttcttatctagcagaatatgttattttgtcagagtagtcagttattcagagcatccttgctcccagtgaactttcattctaattcatgctctttggagttggttactgttgttttaaattactgtgcttgaagaagacagtttcattttgcttaagtgggaaacaaggaaaaaaaatcagttttgctgtacatccatagacatctcagcacacatctctggaaacactgatttttcttggatggaaaatgtgacattcagtttctttttggttggggaaattcttaagaagcattgaatgttagtctctttctctctctctaagttactcagaagtaatattgtggactttatttttgacagatcttgtgaagaaactaaatagaacaaaaaattatgaatatagggtcatgaaaggatattggtatcaaggctggagcacaaaatggagaagggagttttattaatcttttgatgttttaggttctacacatttagaatttgagattaagatgaaaggagaaagaactggaaagaagccaatgattagtttgcaaaaacccaaaatagtaattaaaattattagagaaggaggaaaaaaataacagcaataacagctaatatttattgatggcttatgatacgtggcaccctaggcaaagcactcaacatgtgattaacttatttaatcctctcaatgcatatatgaagtaggtactattatcagtgctgtatagatgagaaagtgagttttggagcaacaaaatgacctgtaaaaggtcacacaaccagtggagccagaagtccatttctgtctggcccaagtgttttgcccactgattaccatcttgactatcaaaaaagtgagtcaagcctgagggtctgggaagaagccccatgtgtttcactggcgctggccacacctatgacaaatctccactttggaatcacgaatcctaattcttagaattatgacaatatgcattcattgataatgaaaaaacttggcctttgtagtctggcagttgtttcatctagcggcataatcttcagaaaaatgctttactgaggcatacttctataaaattggggaaaaatgaagattatataagatgaatagaaaacttctatattagtgctttgtacataatgttcataatggttcactcaatatgataataatatcatgtgtttaatgcaatagtttgttcccagaaagaatgcttaataaatggtgtctgtggattttgcattgtgattcttaacaccctgtgattctaggaaaattagcaggtgcatgcaatgacatccatagttcttctacccatagagaaaggtcatctgttcttactaataagaatcacatttccagaacaagttctgatatgtgacaataccacagtaaatcttcttagaataacatctttattaaataaaagctgtttgcctttaggggaataatagtgcacattgcataatcctctgctttgcatattgaaatttggctgccagaccttgctagaggaattcaggaagtgtcttaaagtggagaacgaccttcacatttttataaaataaatgattaatgtggggacaattaattccacccatactctgttccccaaacagctttatccatcttgaaaaaggtctttcactttcaaggataaaggatacatatttttaatacaattgtgaacaatcaggtatgtaatttatatttgctatgcataataaaatacataattaaacatcattccataattaattaaggcattaaaacctggaagtggcaagaagctactttgcagcagcatcctgagttgggagattgtttgtaaatagtcgcataatattaggactgcttttatatctgttttattttctccaagtgtcattagatagatcagtcttgattatatactgcatttgaatatgtgctttaaacagagtgaccaaaggatactcatgtaagccgttcagataaaatctagggaggaaaacgttcagtccgaatataatacccatttcaaaacaaaccggaatggaatttactatgtatattattaagatggtccaagttcgtccctcaggcagtttgtggattgaatccctacagcacaaaaataggagataagccatttcttttatggttatgcagcaatagtaaaaatagaaagttcagattcacctacctgcctgtaaatcttgtcttctgtgacaagcaagtagtttatcacagttcagtgtagtcagactatcctgaatactttattgataataatgattataataaaatgataacagtaaacatttgccagatactatgttaattaatttagatatgctcacttatttaatcttcacaatagtcttaaaaggttaatattgttattcttgtgttacagacgaggaaactgaacagttaagtgacctagaatgtatacaatagcatgatctatcttatagattaaaagatgagaaattgaagaacatagtacaaattgcatataattgttttctgcatatataagagatgggtgttttgtcgaattggcttgggttttgcctttgaagtttgtgttgctattatgataaaaagaactcagcacataatagttgttctatacccttgaatgaaattgaaggttcccagccagctctcagctagtttcctcctggaggagtcagaatgtctgaattgataattatactgaagaaaaaaaaatctgcattaccatatctgtcagggagaaggatggataagtgcagaggaaaggttcactgagctgccctcatcagggataatcatattccttattttcaagtaatgtcccatttgatagctgatgtcagcaggtgattgagtgtgttctgagaacctgtgactgaaccctgcagggattttactaagtatgaaaggccctcaaaacaaaaagcagtctgggaacaggtaggttggagatttgactgtatttatttcatattcccatgaatgcttcatgtgtcttgcaggtgagtttacagtgaggacacatcacatttctggatctctttggtatctacccttgtgctaccacaaaagtgttgtctctgtattttaacctctcaaggctgcctggcattcttcaaatgcaacagcaactcaaatatcttctgcctttgtttatgcctcctctttccttgggaagatcattaattatttcttaaaacccaattgaaataccacttctaaactagtagttcatttgactccgtgctttctgctgttctttcatatcagcagattcaggtggagacatgatggttttatcatgagacatatagataaggagagatagaggactggaatagacctaggtgggctctggatgtgagaatggatccaggctgagacatctgacagcaagaaatagatccagtgaatgagacagtgacttctgagtctatgagcctaactaggtcattcattcatcattattcagtgtcaggcattgtgtcagtaggattgaaagacttatttctagctttcaaattgtctgtaccagaaggcatgcatactaagaaatatattataattcagataataataggtgtcattgttaccaagatgaataaaagaattttccattgggttttcagataataactggaggaatcttagagaagtatacattccaggaagttatcttggaggtttccggtaaatcccagatgctgggcctgcagtcctcagaacagaggccactagagtcagccaaggcaaaactctattctgggaactggaatgtagcagaatgaggaaaacttaaagctcaaaaccatggagccttaaggcaggtgcttagcttgccaccagagcaaactgggaacagccagtaaggaagggtggctggtgctcagctccctcacctagggcatgtggcagtttacaatactgtttgtcttatgtccatattggttggatctatctttttgtaccctaactctgtcacttagtagttgtattactttgggcaaatctcttaaccttaccaagcctaggttgctttgtctaaagtggagattaatattaattgcttcttcaggttgttctgagtaagtgaacaaacatttaacttgggttcgcacactcctccattatggcatttccatctatatgtcaatagtgtagaacttgcactcctctgtcacactgtaaaatcaagtacatagtatttggcacaatcagggtatgttgaacaaaagaataactcagctagaaaataaatgtagaatgtccccaaaatctatagcaaggaataaagtcagtctatggtttgttcatttttatgaacatttttatgaactataacatgcatagtagagtttcaatttttgctgatatcatcatcacattctcataatcatcatcaccatcactattgccattatcagtattaccatctgttatggggcagactttagctaagcccagctatagggtgctaaagattgcagatgtaggagcttgggttcgcacactcctccattatggcatttccatctgtatgtcaatagtgtagaacttgcactcctctgtcagactgtaaaatccagtacatagtatttggcacaatcagggtatgttgaacaaaagaataactcagctagaaaataaatgtagaatgtccccaaaatctatagcaaggaataaagtcagtctatggtttgttcatttttattttctaggatttgtaagcttaagtaaaggaaatagtaagcaataactgtggcatgataatgatacttgaaatgcaatactatgtgttgtgtaatactatgatactatagttgctttgtttaggactactggacatgatcttatgttctctgcaccttacaaaatgaaaatgtgtttcattctattaacaattgaaccctagcttactaccatccacctcttacttatttctcctacgttaatccaagtgtgaattgaggcaaaaaaaaaaagtaccacagatgtcttctaaatagtcttaaatagtaacagagtcattgcccactttctcattatagttaattaaatcagtgtacaactaagatttatgtggtccattgatttcaattttacttgtcataaatgttgctgcccatttgtggtagttttttagctctagtaaccagaagtaggaaggcacctgcctaccttgttattttctgaaaagataatatatgtccacagtgccagcaaatttgtattcataaacatcagcatataaggagctgttgtgtcaggaacactgaaaatgtggtaaatattaatttctagactgctgttttgtcaaggatttttggaatcagcatttcatgtatttttcttgcccttggagtcttctaaatgatagaagtaaaattctgcagtctttagcagggtgtatgtttttccacatggtgaaattctacctctgtttactgaaaagctgtgttctgccttttcactgcatagctctggtttgtttagatgtatggagcagggtatgtggtttttatttgattttatttttagaaattagcagtcactgtttttaaagcacaatgaacaggaaaatgatattctacataaaagacaataagtaacaatattttaataacattaacataagatccataagctcttaaaaatttattaacttggctgggtgcggtggctcatgcctgtaattccagcagtttgggaggctgaagcaggtggatcacctgagatcagcagatcgagaccaggctggccaacatggtgaaagcccatctctactaaaaatacaaaaattagccgggcatggtggtgggcacctgtaattccagctactcgggaggctgaagtagaagaatcgcttgaacctaggaggcagaggttgcagtgagctcagatcacaccattgcactccagctgggcgacaaaagcgaaacttcatctcaaaaaaaaaaaaaaaaaaaaaaagtttatgtggtttttaaaaaatgattgtttatatagtagagtcattgataggtgttttctatacactttttcttttttttggaataagccaccaaagaagctgtctaaattgactgatgactttccagtcacaaggccttcacttctcatacaagcccctctattggtcctggaaggaattgtgctatatttcaaatatctgtggatatttgaaaatgaagattgaaatgctcatggggagtggggttgaagccatcagcttgacagtgtgagtcctgagttttaatccttgatctatcatgcctaaccaggtatgtgacttggagtgtcatttaatcactctgagccacttggcatgagtcatttaacctctctgagcctcactttctccattgtaatgtagagataacaatacccacttcacatgtttgttgttaagattaccagaagcaacatatgagaatgctcagccatcagggttcagtcagtaattagctcttcttgcctaggagttaccttccagtcctagctttgtcattcatgtactgtatgatatttctatttattttttctctaaaaggatgacattacattgaatagcctcttgagtcaatatgagttctaaaagtcacaattctaatctccatatcaagaagggagagattagaagctgcttgtatggtctgtgctctgtctttgcctctctggccttcccggtgaagggagggaggaattgtgctacgtttataacatacaaatgaaccattttcagataatcagaaaaaaatagataattgcactaaaactaaattaaacatattgatctggaatgattcagaaagaaatttggagacatggttacaatgcttgccctgataaggtggtaggaagaaaaaaatacttagaatgagatcctttcctccctagtcactaactaagtaatggagaaacaatcagtttacataaagcttattgtctttatctttaaaatggaacaaagatttttaacttgttgtaagtattaagtgtggtacatgtagaaagtattgtattgaatgtgtgcaacatgttgtatgtatttaaggaatgttaattttcttttttattatcatgttaccttccctataaccggctttcatcatttccctgctgacaataccactcctacttgacaaaagccttcaaacaaagagccacacaaaagtttaggattccactcttgctgctgattagggttgcatgctgttggtaggagatcctgtggaggagagagaacctctggtataaagggcccttctaagtcctgaagtgcatgtgattcatcctaattgctaaatggctggtctgttaatcatgcactctgcttagtactctggtttgcagagcagaatagagaagcactcagagcagaatcatggtgatataaaagaggagcgctttcttggggggaagtgcaaggaattcaatattgctagaacataatgtgcaaggaaaggaagagcaggagatgagacttgagcagtaaacagtggccagatcattgaaggcctttgtaaatggtgagtcatcggaggattttaaactttagagtgatgtgatcagattagcagcaggatcgttctgtcagcagtgtggaggatgaatggaaggaaggtgagactgtagatgcaagatgagcaagggccttgctgtagacatctacagagaaagaggcggccctgaactaagacagcagcacaagggaaaatgctgagttgtaaaatgttttaggtcttgaaattgaaatggtgactgcctggatataagtggtcaaagagcagtggcctacagggtgaccctcaagattttatcatggctcattaggtcagggctacctgtgcaatcacagatgtgcttgcttccatgaagctcttgctagtccaacttggtaggaagaagtcacttctgcaataatttcattgcatttttatctatataatttctaccttgaattataattatttgtgcacatagccataacccccgattgactttaagctcatcaagatgaagacgttgtttaatgcaaccctgagtcccaagcaagtggctggttaattgtcttaaataacatgtgcaatgatgagttaatgggtgcagcacaccaacatggcacatgtatacatatgtaacaaatctgcacgttgtgcacatgtaccctagaacttaaagtataataatatatatatatatatataacatgtgcaagttgtcatttcactagacaaaaatattgggcatatatttcatttcttcttcttggccacagattacattattttttataaagacattggtctcaggtatgtctcctttggaataccacttctgcccccgttggttgattcattaataactaatgtctgatttatttccttcttttaattggttaatttctctgaatctccaggtcatcttttccgagctcattggcaccctgaataaaaattttaaaatattgttctatctgggataaattaaagctgttgtctcctcctagttcttcacatacatctaggtccttgaaaaaggataatctagtaggatctgtttaacttgtaaaggtgctggctataggttaataccctcatttcttcaagatagctacaagtgattctatgatccttgttttgcaatacactctaatttgtaaaaagtaggtctacagtgatgattgaatatggggaaaggacagttcttgactgtgacacaggaagcctgggctctagatgtcattctaccacaggctatcggtgcaaccttgaaaaagtcactttaccttttgagtttcagtgccttatctgtgaaatcagagtgttacactagcactgcaaataaatatcccatgtatccaaatgctataagatatgttaaagtcaactggacaaatccagtgatttgtcaaggccctctttttttcattaaagtgtcaccagtcctatcagagcagggttggaaggaaggtaggtctaggaactaaaaatagaaagaaacagtaacaacaacataacctgacctaggtccagaggtttttgggaagcaggccaggggaacaggcaaagaatgaaatccaaaatgtatggccttagagagcaggtggtcatccaaacagtcagatggcatggaggatgggagagatagtggccacagtaggaaggccgtgaaaggcaacaaaagaacccaggagcatgtaatgctcagaagtcagaatcatggaagtctgtcagggattagcagggccctggccacctgcctgggttcataggcggggcagagattaaaaagggagaaatgggaggggtgggggaaacaaaagcgagacagacttccaggtttggggagcctgacatattaggcatgtctccaaaagagagattcaggcagagaagagcaagacagaaggtgagttatcagaactggggcaccaggtggggactgaggtgcggaagcccagttatgataactgggacaaaaggtcagggcttgaataataggttaatgatgaggcctaaagttttagaatttgggccactttaaggtttcttctaattcacagcttttaggaagcaatgatttctcctatctgtgagctgcccatctttgaaaactgactgacagtctccttttccctctctcaccttccacctcttctctttctctctgtccctgtccatttcattgagggtttaccaagttcaaagtatgaatgaataaggaatgtactctggaaggatattgaaaaacagggaaattgataatcacaatacaacggaataaatgtggcagagaggtatgtgaaaaatacagagagaatggaggagcaagaattctgctccctccagaattgaaaaaggcaggccaagaggaattctttgaacagccttaaaaggaaggtaggttggatgtggtggctcatgcctgtaatcccagcactttgggaagccaaggtgagtggattcctttagcccaagagttcaaaaccagcctggccaatatggtgaaaccccatctctacaaacaaagtgaaataaaatacacaaaatacaaaaattaacatcgtatggtggtgtacacctgtacttgcaggtacttggcaggctgatgcaagaggaccatttgagcccaggaggtcaaggctgcagtgagccctgtttatgccactgcactccagcctggccaacagaaggagaccctgtctcaaacaaatgaacaaacaaacaaaaacaagaaaaacaacaacaaaaaaaggtcaggtattagtttgctgggtagataggcagggcaagggcagacagagaagagagacctgtgtttgtgggtaggtatgaagttaaggaatgggcatattcaggtaatcaggggttaagtgtggtgacagctagggcagtagggggagttttcagagatcaatggacaaaataaatggggagttttcagacttcaggtagcactagagttgcttgtaaagaaaatgactcttggcagaaaagaagggaagatgggagtatagagtgaataacaaaactgtgaccaagaagggggctattgctcatgatcttggcaagagatggcagagatggaaccaaggttatggcgatagagatgagcagagacagttagatttaaggcaaagaagtaagggatcctcaaatatgtaactgaactaagttacaagcaattcacaggagacaagggcagacaactagaaaattgtgaattgagtttttatatatcaccttcttagtgaggccttcctgcgtacttgttcagtaacattcccaccacattcctagtccccttctttagctttttttcccccttagtactttctagtctctattatttcacatatttcattcatctttttattgtctgtctctttccactagaatgtacctctgaggggcaaagattttgtctttaagatcattgttttatcctttaatgccttgcactttgaacatttctggctttcaataggttagatattaaatatggaatgtatgaaatcaaagcaccagcagtcatggaccaaaacttataggaaggcaagacttccaatcatacaatattctacatgaaaggaattgtagacacaagactatgtctccttcatggtacggaagacagaagtgacttgcccaagacatagagcatgtcaggcagagataataggaagtaaagagtatgtgaatgtatggtgcttggtcttccaggggctcattgacattgaggaaaggaaataaggatggagatactaaggttggctgtggaaagaatactacagctgcaaggcagtccttgtattactaaattgaaaattgctaacataaaacagataaatattttgatctctttttgtaattgaaagatattgaaacaattgtttcttttttcctgcaaggactgttttcattcattttgtcctttgcctgtccctatttatgaattattctcccccctcttccttattacaagaataaagaggatattcatttcctttgaacctgggtgttacatatcaacattgtcccttttccctattataatagtgtttgtttccttccttcctttgtccctcaataaacatcaacagtcaataaacactaggctattggtctataaaaagtaagtgacattaggttatttttcctatctagaaatgttaaaatatcctaaaaggcatgaggatttggaaattatatgaaaagttagactattaccttgcattttactagtctgtttatttctacattctttccttccttcatttttctgttgttcaacacatatttcctttgcacatattaattatagctggttgagttgtttcaggtacaaaagtaaatcagggagtttacagcatggtgagaaagataggaaataagacaaacacaaaactttcaatcatcctgtacatagatatctagtatatattctacttatatttaaattactagacacgtatttacctaatagctactataggtgtaggcactgtgttaggcaatgtgggtccaataggaaataagacaaacagagtttccatccttccatactagttgagaaaacaaacatatgactgtggcacgtactgcaatgaaaaggtaggtgagggtgctaactttgtctagggattgaggaaagccttctcaaagaggtagtatttgagtcgagttttgaaggctgagtagaaatgaactaggtaggaaaaggtggagatgggaaggaggtgtctagacagaggaaacagcatgtataaaggccctaagacaaaaaaggacatgtcttattaaaagatgaatacatgagaagatgagagcagcaaggagaatgttagatgagagcggcataccaagatatatcatgtagaatactataggccagcaaggatagacatcaaggtttttgctcttcctcagagcagtgggaagtcaataaggcttataaacacggtaaagcaataatacaatttgaaatttggagactggattggagtatggcaaaagtagatggagtgaaaaaagaaaggataagagtgatataaaaatattagataaaaatgcagaagagggattatcttctgttaaaaatgttggaaaaggatgaatggaagaggtggctttggacttggctttgaaaagaaggtaggattccagtatgcaggaataggaactgtgagttatcaaggttattttcaacagaagaccaatatttaggaggtcagggagatgtgaaagcaaaggtgatgtatgggaaacagcaagtcaataattctggctaaagtatgggacagacacccgaatcaaatgagtgagaaatagattgaagagtagaagttagagttgaagagtttggacatttaactatgtgaattttattgggtaagctagtaggcgtcattgaaggattttgagcccacaagtgcatgcttatagctgttttttttagggaggttaatcaggaaggaacatataacagtgatagaaaataatagaggttggagggaatgagaacagttggtagtctagcacaaaagatttggctggagccaatcatggcttgaatgagggtggtggcagtgggaatgtaaaggatacaaaagacatggagataaaataaacagtaatggcaattgattggctgtcagggaaactggggaccgtttaaagacttcacagcattgtcaatacttcattttatttggtctttggtacaaatctttgaggcagggtatgaatttggtgctctggaatacagagtgataaccacatgatatcttgcctacatgccatgaatagctttgtcactaccacagcagtttttgagtgactcccaaatggactgtattttaaatgttaacctactaacaattatctccatgttctattagcaatcaactgaaccatctgttcctactgatagaggatatcttctggaaatgaacttgagaatggtgaaatatcagatattaaaaaaaaacacagtctgagaacactttataccactccatcctctagccagagagagagagagagagaattggagtgggggaatggaattcttccttttctgttatataaagcttatgctattaatacaacatgtaagatacataatgaattctgagttaattttttttttttttttttttgagacggagtttcgctctgtcgcccaggctggagtgcagtggcacgaccttggctcactgcaagctccgcctcccggcttcacgccattctcctgcctcagcctcccgagtagctgagactacaggcgcccgccacctcactgggctaatttcttgtatttttagtagagacggggtttcaccgtgtgagccggggtggtctttatctcctgagctcgtggtccgcccgcctcggcctctcaaagtgctgggtaaaattacaggcgtgagccccgcacctggccgagttaatttttttttattgccaacctttttacattttttttttttgacatgaaggactaatcatgaaatgatgtgaatggaaaggcagtgccagtagtggaaaaagccctggatttgtaccacaaagagcaaaatttgaatttatctctgttatttatcagcaatataatctatgttgccacttaatatcaatcagccttaaatttcccatcaaacctagagacaaatcttgactccagatcttaaccattcaatgaccttgaacttgttctttaacaataactgccctcactgtggtagaggattgagagggataaataatatagatacattttattcctcttaaaatactagcctactggttaggctaacataatgcctcttagttattctgcctacataaagcttttctttcattattccttctttcctacagtttcaaaatttctcttgatggaaaacattttcaggtatttaatttttgattaagccattggattagagagaggcatggcttatctgaaaactccaatgaactgagaaaaaacaaggctgcatttcatttttgacattaaaaacataattttcaaaatgtataggttactccttagaaaagtacaatttatgttcttgaaattcatatcagtttctatactttatggaagttcatctgcttcaaacatgtcaaacgtgcaaataaaatatgctaaaaagtgacgtgaaaccctgtctctactaaaaatacaattagcctggtgtggtggcaggcgcctgtagtcccagctactcgggaggctgaggcaagagaatggcatgaagccaggaggcggagctttcggtgagccaagatgacatcgctgctaaaaagatgactcagttctcttcaaaagtgtatctgtagctagagtgtagtaaagttatttagggtcaccacccagaataactcttttgctgggtccagtgtacttttgtcttctgccagaagtgagctccatagatatttacattgagtactaaaatattaattaaatgtactaaagaaatcctcaatgaagctgctttgacaatagggccaaaggagagttatttatttaatgggtatttatagagtgcctaccacgttaggcactctgctaacccctgggcaaacagaagtaagcaatatagaaacagcccttgtccgcattgaagagacagtccaggggttgggggtggaggaaagacattaaacaaatgattacaaaaataagtataataagttgtgaaaagtgtataataatacttttccatgcaggaaaagtacagggggttttgagggcatgtggtaagagagtctgcaaggttctgcccttgaagaacttacagtcttctttaatatactatgcatcttctatgggggaagctggtctatgcaggtctttgcagttttacctgataaataacttgcctgctgtctgacactaggaaagctgtttaatctctccagagttcagttttctcaaccataaaatgaaacagaaatactaacccgatagggctattatgaagattaaatgaaggaatcaaccatgtgtttgatacatgttatgtgctcaatgaatgttaactatgttggcagaaagggggaggaggaggaggaggaggaagttggtgatggtgatgatgacgatgatgctgctgatgttattgcagtagacagggtagagggaaagttagtaattcagaatgagaattctatagtcttgatactcagactaatatctgttatttagaaaaaaatacacaactataatcaaaatattagggaaaaatccttaaacatacaaaaaaagcaatgtctaaatctgctgtctagtctgtatttttttttactgtgtgctaatggaaaccaataatttgaacaagaaagggaaagggtgaggtatcatttgagaaaaggaaacttagtttccaattctggtctgcacttttggtgataaagcaattgtgatatttaagcgtttggataactgtcaataaagaatttggtaaggagggttttcctgttagagtgggcataggagcctaagaagacgtgttggagagacaaacaaattagcattgaagccctaaaatgagcaggaaattgacaaagtgaaaagagaactagatttgagccagcagtctttacttccagtcttaggtttacttcaccagtgagctatatggtctagttaatcttaatgcacctctgtttcttcttttgtaagacaggaatgacacctaacttatttagccgataaataacatgtttactttatgaaatatgcctactttgggtagatgtaatatatcaagggatagttaatactgaatgagaatatacatatgaatgctcttttgaaattataaagcactagacaaacctaaaattattggtcataatcttactctcctaactgggggcttatatttttacatttaaatttcctgccttcccaagccatttataagctccttgagtgtgggaaagatgccgtatttgttttagtgtccccccagtaggtaaacacagcagaattttcaaacatgtattaactgagctgttgaggatctaccatagttgaagaaatcagacttgccttcacaggcaaggaacaaaatatttctagcagtcgatatattgacaaacaggttaggtagcatcagtagacatacgtacagccaaacgtagtgggccagacgtgctgaacaaaggttttgggtttatcgatcagacccaaattcaagcataggcaagccccttggatttttgtagaaccaaaaaacaaacaaacaaaaatagtccaatgtcttatgttcatggagcaaacttttaatgagtgtcaaaatgctatcatgggtcaggcacagtggctcacacctgtaatcccaatactttgggaggctgagatgggtggataacccgaggtaaggggtttgagactagcctggccaacccagtgaaaccccatctctactaaaaaatacaaaaattagccagatgtggtggtagtcccagctactcgtgaggctgaggcaggataatcgcttgaactcaggaggcagaggttgcagtgagccaagatcacaccactgcactccagcctgggtgacagagcgagactctttctcacataaataaatgaataaataaatattttttagtgccatcatggctcctatcctgtaggagtccaccatttagtggaggaggagagaaacaagcatataatgcaatttgagacactgtgaatgaaagtgtctacaaagggctatgagattaaaaaggagacccctgaagaggccagagatagcttctcaggagggttaaaggtgacatatagaagaaggaacactagcagggtagtgaagaggatacagagggaaaggcattcccggcattttcagtccctatttttgtatgatgatctgtcttaagaagtttctgatatttgtttagactaagagatgtgtgtacctcatgaaagacacaattaagataattaattgttaatgattccttcattttttgaacaccaaccctaaaattttcttatatatactatgcatactaaaaagtgaaaatataaagctataactgagaaagtgtcatagagttctgaaaatgaattcacagtcgaagcccaaatagaaaattaaaatctgctctttaagctgctcctttactgagagtgttttgagtccacagtaattccgggtatagaatacatcttgtgcttcataaattgggctgagccagaatactgcaactgatgttacaacacagatcatatgatagtttattttacacagtaagaattgtgtaaacccatcaccaactctttttttcactgaatggtttattttgtttcacactggagtgtgtggtttattttggtttatttacctttgctgtccatctaaaatacttggggatatcacctacactactggattgtttaacaccttcttaacatgaacagaggttttaataaggaaatgaatattgcaaatgcatttattgcaaatcctatattaaggctgagatgtgggtcttaaaaaatactcattcttataaggtacccagttttcagggtacaagtggatgaagaacagtagtcctttctgccttcctggtcaccattaattttgatgattacttccaaaaccttagataccagtatgagctctactttattctttatagtactactaatatcgtcttctctttctcctgtttcttgacaattttgctttctggtttcctccttgttcttgcactacctctgatgctgtccacacactccctttttaagagctttcagacataacacttggccagcactccctctgcaggtgatctgatgaatccattacagtcatcttgtcacaatcatatttgtttttcgaatattgttatatgttgccaaagcgctgtatatcaacttgttaaaagaattgtagcaaaagtacaaggaagcctttcagaactaagctgctttaaataacagtatcacttagattcccacagtccaatctgtccttagacagaatccactattataaaaataaagcattatgaagaaagagttcatgtataattgatttttgcatcaaaacaaattatggttcatgtgttcctgatgaaaatattgttaatttccacagactgacaaaagccttttctcctaaactagaccagtagttattacaacttacacaatctaggaataagcttgaatccttaaaagtagagaagaaactggaaatgtcagcatgacattagtggcttttatgaatgtactttctcatggttaaaaagcagtatgtgaggtgatgcaagctaactgtggtaacacaacaaacatcagtgacagtgcaataaagacttatagctctcacgtcaatgttcaactgagttggcgatagggctgttgaccacatagtcatgcagaaacctctgctccttccatttttgtcactaccactttcatcagttgacttctaagattgccaaaaaatagagagagagcatggagaattgcacaagtggtttcatgaggaggcctggacatggcccgcgtcatctctactggcattccattggccggaacgcaatgaatggtgccaaaataactgcaaacaaggctaagagaattcatcatctgtgggtccaggaagacaataaaacaatttggtgagcacatagcattgtctcagatagaagtttataatttagaatgaagtgataattgtattagtcagtataattcccatttcctttttctgatttttaaaaaatttctcccttaagaagtttaaagagaggcagagtgtataatacttggaagcaagggctttgtagtcgtatcagtcttagttcaaatttccctttactcttgctagccatttatcctccttgaggtctttttcctgttttccttatctttaaattttttcattcattcgttaagaatcaaggtacttaacaggaaagacactgtaatgatagaagtgagataatgcatactgcatagggagtattcaataaatgataactattattattttatgaataaatacaggataaaggacattcatgcacgtgacatttactattaaaccttttccacccccttaaatttaggacctttgggtcccaaaccttaagctattctcagaaaagatgttgcaccgtcacaaaataaaagagttgaatgagaagaggaatatctctggttgtgggaatcaaaagaactttacagattttccattttgtgggggtgagggttgttagctgcccagtccactggaatgcgatgcctattttcccaatggtattaaggatgactcacaagaaagcttgttttcaccaagtctctcatctcatctgcaccaggaaagaggcctagttgtacctcttaggcaggagagcttagtgaagtttttctgtccctaatttctgtgaagtgtgctttctctttgacgtatgcacataaatcacagacacttgcaaaacatctaaaagattgaggcttgagcttgaatgaatttgtcacaattgagtagaagggttctcattcagtgcccatgcacgaaacaaaagaaaattatgttgtgctgtctggtacatgatgtttcttatggaaaaacaaaaacaaaaacaattgcaccatatatttttttttaaagtatcttttatgaaaacttcctctgaagatatggttaaggacttttgctggtaacgtctctcatttttgcaatgaaaattaactataaaactatgtagcccgtataaacctagtacagtactttgaatatatagagtagcttcaaagtccttcctggaaactcttcatttagctgagatttgatttatgggaaaagtggagctataagtaaaggatttttttaaattttaaattacaaatgggaaaagcaataagtaaataagttctaacatcacatagtagaatgtcagtggcctaaaagaacactcaaaactcctaatttccaggtcaaaatctaagagcaggctaccttttattagacttcttattgtttgatgcctcgtaatgtttctataaacataataggggaaaatatgtgaaagattagtttagcccattgcccttgggcagctgaattattaaacctttcaaaacaaggacttctgtttctgacaaatagtggactatgtttcttggaccaaccatccctttgactacaactacaaatgttggatacaatatatttttaaacgaacaaaacttttatttatttatttgaaattgacaacattgtatgcttttatcatgtacaacatggtattttgaggtacatatacactgcggaatgattaaatctagttaactaaaaaattaattccttcaaagtaccagacaactaacaagatagttaagcattgtcaggcagaaacctctagcctgggcaacatggcaaaaccctgcctttagaaaacatacaaaaattagaaaggtgtggtggtgtgcatctgtagtcccagctactcaagaggctggaggtgggaggattgtttaagctttggaagtcaagactgcagtgagccgagatcacaacactgcactccagcctgggtgacagaatgagaccctgtctccaaaaaggaaaaaagcaaaagaagaaagaaacctaagtgaagacaggattccagagggttggtgtcgcactaaggccccttctgccctgacagcatttgcaaccaaatgaatttaagctttgaaatcaacccacaaagacttcatattggaattgtgggatatggattataaaatacttattgtttaaaataattaaagacgaacttgaataaacagtacaggaaattgtaaaaaccgcccagctgacttgaaaaaaaaataaagagaactttaataaaataaacaaattgaaattaaaaacaagttgagaagtgtaacagcaaattagtcaaagctgaagaaacaatgaatcaactagtccagaaaatttatccagaattcacagaggcaaaaagatgggaaatatgagaagtgagaggacattgagctaggtgaggactggtgagtatccaacaggcattacagaaggaggggataaacagcatgtggcagaggcaacatttgaaaagagaagggctaggtgctgtgactcacgcctgtaatctcagcactttgggaggccaaagtggatggatcacgaggtcaggagtttgagaccagcctaaccaactgggtgaaaccccatctctactgaaaatacaaaaattagctgggcgtgctggtgcacacctgtaatcccagctacttaggaggctgaggcaggagaatcgcttgaacccaggaggcagaggtagctgagatcacgccattgcactccagcctgggtgacagagcaagactccatctcaataaaataaaaaaaagaaaaagtaagtaggcaagaggtttctagaattgataaaatgcgcaaatacagagattcaaggagaaacaagaattgtaaacagatttttttaaaagtctgcacccagacatagcatggtgaaaatgagaaagagccatcttaatagaagagtggtaaggtggctgagagggagggatgcagagagggcagtgtatatctcaatatatattgagaaaataactgtcatgctataacttttgtctttaaaaatgaaggctaaataaagatattttcagggaaaaaaaaaaaaactgaaagactttggcaccagcagaacttctctaaagaatgttctaaaaaaatgccccataggcagaaggaaagtgatcctagagtgccatgtatctgaattaatctaaatgaacatatattttataaaagaaaaacattgctttgtgtggttaaaaaattgagaccaggtgcagtggctcatgcctataatcccagcactttgggaggctgaggcgggtggatcgcttgagatcaggagttcgagaccagcctggccaacatagtgaaaccctgtctctactaaaaatagctgggcgtgttgatgcatgcctgtaatcacagctactcgggaggctgaggcaggagaattgcttgaacccaggaggtggaggttgcagttagccaagatcacgcctctgcactccagcctgagtgacaaagtgagactctgtctaaacaaacaacaaaaaaaattgaacagagtaaaaatatgatgacaataatgtattaatgatgtgtatacattaataagaagtaggagagtaaaattgactaagtttagaatttgataagtaaacgttataatttcaagggtgaccacttttaaaaagggaaacaaaaataaactatataattttaaaaagtcatctaaaagaaagaaaaaaataaacacaaaacagtttgggcaaattaagagcaaaaataaggtagctagaaagccaaatatgtagcttcctgtattaaacattattgaaactactgctacacaaaactagatagctgcatctcacaatgtaatggtaagagaaataggcaagtcacattttgtgtgattctgtttctatatagttcaaaataggtaaactgtactatattgtcaaagaatgaaggatggcaaaatctataaagaaaaacaagaacataactattacaaaagttagagtagtgcttagctgtagacagacagaaaggatttagagtgatacttcataactactttttaaactgcacatattttatatactcttctatatatgttttatatacatatatcttctaataagaatgtttccaaaagataagtttatatataaataaatgataccatatgcatctttgctatacaagtttttcttcatgttttgtgttatttctttaaagtaaatgctcagaatggagatcaatggtgaaagatatttatatatttagcctccttaactacagtgattcaaaggcgatcccgtctgatttctaggccattttcttagtgaatacacattatagctcacacgttattaagttatttaccaaaaatttaatgtcaccttatgccaccagaaatgcatgagtaccaatgtctttttatttgcatccatactttttttaaaatgttcattttgaagcaaatttaataggcaattctattatatattttcaactatatttatgctatgttaaaaaagtttatcattacaaagaagcccagccgaagggtgaagaacatggctcctgaacccaaactgcccaaattagaatcctagctctgtctatagtaactaagtttagaatttgataagtaaacgttataatttcaaaggtgtaactacaaaaacttggacaagatgttttacctaagatattttacctgtctctattttcttctctgtaaaatgagaacaataatagaatctacccaatggagttgttgcaagaattacatgtaaactgccaaaaacaacgtctgatacatagtaagtgttcaatacatgcttgcaaatactttattattacaagaatagaccaaaatggatttgacctcagtgaaaatcacattccttgaacatcgtaagtatgatcagtaaaatataatatggccaacctacaagacaaatactaacctacacctctaagaccattggcatatgaatgtcatggatgtcatttttgctttgaggggttctagtatttaatgctgaccttgtgaatagagtatgaatcaaagagagggatggagaatgtttgcaatcatcagtttaattcaaaactgaaatattgcactacgtctctggctttgtagtaggcatttagaacatagtagtgtgcgaggctctgcacgctagcggggaaaacaaaaagcgaacaactaagtattggaagaagaagtacaggggcacaatgggagcaaaagaacaggagatccaggtctcatttaaggtgtaaaggaaagcttccctggaaaaagtcatatttagcacttactagtgtacaaatctgtgacagatacattgtgtcataattgattcttcacaaagactccattaggtagataccaaatccctattgtatagataagaaagctgagattcagagaggatgactggataagtgaagctgtttcttcatttccagtgacccactcagattcccatggaatggaaaactaacgctggtggcacttatggttctctttgtacccccttagctggcaaaatttaaaatccactgtgagccaaattctagcatactaaactgcaaacagctgctttggcttttttttttttttaacattaacagaaaatcccaagctaaatttaaatttggtttttaggaagaaacaattcgagggaaaataatcagcatctagttttgtttgctttccattaagaagtctcggaatacaatcagctgtagtgatactattaaatgctcaggaagtattcagacaaattcacatctctactagcatgccacccttgtcttgtcttggagttcattaactttcagttatgcttgaattcattgttcattaggttatggtaaaatatcgattgtttgatacttaatattgaaatgtaatataaagactggttgttggaaagatgaaatatcaaaaccatttgtttgggttgggttattggtaaaaatagaactaagctgtctcaaaggatggtctacctcatccaacctcttccccaaatgagtaaacattgtcattggtttcttatgtatcctttcagacattctttatcatccaatcaaatatttcatattttttatataaaggataacgtacatacttgtctgcattttaattttttgtcacttaataatatatcgtcaagatcttcccatatcagcacttgtttttagagctttccctgtatgaatgtagcataacttattaagtagtttcctactgatgagtatttgggtttctaataatgtcctcttacaactaaacctagtgacattaacattcactgaatataggtgtatccctcaactttcaaccttgtgtgtaggtaggatggggacacgtgtctcagttaatcaatgagataggaagagaattagcataagcagtttcaggcctgactcttaaaactgttgtctgcaactctccaacattctctccacctgccagaccccttagaaatcacctttcagatggtatcattacaagaggaaggagcgctgctgccctgctgccgcaccagcatctgacttctatgagtgacagataaactgtccacatggtaagccgctgagattttatggttaccatggtatcacctattgttttctgactaatacaaacccactacttcatatgtgcacaaatgtatttatgaaataaattccccacagtggaattttagctttaacttctctttctcacagcctctaagaccaggtgatcaccagactctataatttatccaagtgctccccctttgggcccaggcttcacattccatagatgctgctcaggtttaggtcattcctgtttaccacctgcggtctccttgccattcgaaactcatacagtttttcctgacctctcccctacaaaccctttaaaggttgccaacagtttacaggattaactctagatttttctaacctggcattcaagcctaaccacactaacatataaaagaagatagtacagtaaagtgtctggcatggagtcggtactcaacaaatggtggtagtcattacattttatagccccttcctacaacaaaatagtgccttttgtgcagttgacatttaataaataattaccagtggactctattatcaggggaactcataattcactaagttatgttaccgtagtattccttgatatttttgtttcacagcttagttttaaggtttaatcttcttagagtgttgattaattagagaattggatgtaaaggctgtagaaaagtagctcataaaatttttggtaaaacatttagggaagcattcctttgtaactgggatggattatgcaatagtacatatggcatccaaagatgattataccacttaaggcaatattaaaaacagtgtatcaaactgaatattcatattgaacatatatacctaaatgatactgctaagtcataatcaagttggaataactgttgttagcatttttgaaccatcacattccaagagataattatttgcatattgttacctcatgaatttgaagtaagcccatagataatctgaagtgtttaaaaatgttcatgagttgagtttgatgttcctgccagagctagctgcatttcttactgtaggaattatgaaatagaattttatttctgttgacaaaggctagatgcttaccagttcaaaagagacaaatattaatataatcttggttatgtttcacattgatttaattgatttaaataaaaaagtgtgaaattattctggaggataaatccagttgtcttggaaactttgaagcaataaaatgaaaacaagatattgtcatgcttcaaatgcaaaggctatgaatataaatcaactctaaatttatttcaattttattccagtgtaaacaaaattattgttaaggcccaaaaagaaaattaagcatacaattaatacaaaacaatatataccatgtaatatatttttatttatattacaggtacaaaaatatctgaattcagcattttggtattgacttgggacaggtttttatggagttttaactgaagaacagaagtttaaaaacatcagagtcctcccctcttcccttgatcactagtaatttcacatttatatgtactttacaaggctgtgcaaagtacccaagtctggaaatctcatttactctggttacaaactttaagtaatacaacaacataataaatacaatgaaataccctttatattggactttgctgaggaaacctcagaaatgttagcgagttcttttcaaattaatcctcctagcaacattagctgtagagattagctatagatatggtgctctctaatactttgcagaaaataaaatgcagggagttgacataaaggcttttagaagcaacaacccagtctatatgaaagcctgcaaattaaagtatatcctttagtggaggaaagcaaactcaatctctaagctaaatattcagggagaaaactggatactctgagagtctcagagtgacatccaagaatttcaatgtagtcagtgaacaaaggaatacaaatttaagcagagcaagagttacatgattttttatgattataaataattatttctttagtagcagagataaatggcttctgcatgtttctacttccaattcctgacatccactttttcttctttattctcttcttcctcgtttccttttttatcacatttatcacatgctcctctcttttgaggttttctcccatttgctgcttcatctcgtagccagagatgggcttctctaaaacatgacatttctagaaacacagggtactgaaataattgtaatctaaaatgtttaaatttgtgaaatttgaataaattaggaatctataaattaaaatgaaatagctgccctcttttctactacccaattccagaaaacagcccatccagcccacctcattacatcatcacaaaacatacacaataaaaaatggcaaaccaaagactagtgggaggttcttgttattagaccacccttttaattttccccctgtaggcaatttggaaaattattagagatggaatagatgtgggtttttttttgatagattctttgagattgacaatatgaaagatttagtttagatcacgcaataggatctgtagcctcttggtaattaatgacacggccatccgccctctacttatggtacttccctccagtaataacttctctgctgttattattggaattctgtgtatctgtaggataagtcgaatatatgtttgtcagtgaggctgtttgttattatacgtccccagtgtatggttgcacctataatggtgcagtgtagaacaacaagaagatagaaaactgatagaaaagggggagcattaactctaagaaacacatgagacatttttgctggaagaaatcatctccacactaaagttttccctccctacaattggctttggagagtatgtgcatggtctttgacaaggcaacaaggttccagtcatagatattagccagcccttctcataacattgacacttcatcagaatgtagaagtagaaaaatctgaagaactgtttttgtagctttatttactttcaggtaatccatatcccgtggtcttctgagtaaacctgaaaagatacttgaagtatacgtaaggcaaagggatattatagatataaagccataatataacatacaaattatgttgataaagttagattgataaatgtaactctaacatttgatctttgtggcatttgggtactgtacacttcttggaacaggagtattgtctctcatttagcttttgcatgcccaaccacacctagcaaaaggcctactattgagcagttatgtttagacatgtttctatattaaagatgcctcaggggctaggcaacaaagctgaacactgaccatagttggctatttatttttttgtgaggagattgtaatatttttctgtataactaatttcttaataattataatgattataattataaattctatataaccaatttcttaaaaattttatacttttgggtacaaatgagaactattccaggagagaggtaatttatgtacaactttaatgtaacctaataaaaagggtgacatccatcacctttgctgtattatattatttagatgtcaatcaccacttcaactcaaggggaaggtactaggtaaatgcatggactctagcgcccacctgggagctactggaagcctggggacgctgccccagtgtggtgatgggggatgacctgggactcaactgcttccaccacttcttactcagaagagcaaggaagaggtggtggggagttccaaaacgacatgagtacaaatggcctggagagtaatcaatttaaataaaagaggttcagaatcttctaaaggaagcttacaaaagcagtgacttcacagaataaatgatataatcaagagtctgtaaataactaaaaatatgacaataaaggcaataaaggcaaatagcgtaggaaaaactctaggaaggctggtgaagtactatatttttcaggcctacaaagcaaactatgcaagacgatacaaatataaaacaaattttgatgcattttaaaatgcatggtttgtgaaggaaaaaaatctatttgacctcgatgtgagaaacattctctcatgagtgatccaaggttcgtgacattggatttgcaaagaaaaaaatgcatcaacatattacctgacctggcactaacagtatttacaaaacaattataatatgatggccatttattgattttcaacttttagcaatattgtgtaacaaaatgtagaaaatattgttatggttgtatgacaaaatataaatatcaacaatcttaaaattatagaagtaaatatttagctgacagaagaggggatgtggaaggaagaatgatgactaatattgacattttacagattgtggagttgaggaagactgtcaaatattgaaataagagagagatttttaagaaattagttacagagttaacaggactcaaataatattataaatatcaaacataccaaaaggatatagtaggagagtagtgtgagtaactaaatcttcatttttcatgtatagaaatcaatagatactaaagttgacaaataaaaaattagaggtatactcatataagggtaaagagacaccctaaaaaataaagtaaggacaattcccagaggagtgttaagagttaaaaaaattggctgggctgggagagtctaagcttttctagacagcttgcatggaaatacaaatacatatattcacatgcattactttaaaagtaataaaaatagatgtaaaaaatccctaaattggttaaagaaacgtgctattctgagtccttcgcttattacctcttgtgatttgtctcctccacagttaactccttaggggtacgcattggttacctttgaggtaacttacagaattaaaatgttattcagtagtaacaaataactgtgtcttgattgattgagcttctatagcaatttcccttctaaataggaaacacaaaattatgcgtgcatacaggtctctttattgttcatttaagatttatcgagcaattactatttgcaagtcttaattgtaggctcccattggactcaaggtatatacaatcttttcagtttaataagtaggcaggttaggttgattatttgatcagtatcactcaaatgtctattatgagctaggcactattccaggccctggagatacaatgtttactacaacagggtcctggttctctagaattggaatctactattaataattccccaaaggaggcaccaccttatgcatactatttatttggctgattatgatgtgacagtactctaaatatctgtggaaagaaaaataaccttgtagtatgtttcaattcaaatactatcaaagagatcatgagctctggagaaaactacatttcagaggaagatgaatgagtttaatggaagtatgttacatattagaaatctctaaagcctgaggtcaaagcatgagaacaagttctttaccctgttcatagaactgaaataatattcatttggggctgtgacttgtagcaatgtatggaaataaagacaagagtatgcctctttgattttttttaaaactctttaaagagattaaaaaaattttactgctttagatgatttagagatctaaatgggagtgttagattcgcgaatttgtaccagtttaagtgtggaagggtaaatgttacagaaatgattggagaagtcagtgatcaggttgagctgtgataattttgaggtcagaggcaaattgggagttatgccaacaaagagtttttctttaaatacacatgattttatatcttgtcatctcctttttcaagagcctccaaatatacatctcagtttctccatccaacccctgcacctggcacatggaaacagatggaagaattcaaaatctcagttaaagttgcctttgaatgtatcatgaactcctgttgtgaagtcttgtgaattagaaacacagtaccaacactctgccaccttgtggcttctggagtcattgcagcacatatagaggaaaatcagcacccagttccagttttactggaacaacatgtcttaggttttttgggcagatactttatttaaaggaatatgtagggttcgtgagaatgcatttcggagttatctttctaatatatatatatttaatatagttatcatgtcattggctataattcattagcctgccacaaaataatgttttccaaattgcagttttaaggatcatgaaatctttgaactaaaagggacctcaaaggttacgcagttcagtatttgaattccttttattatcattctaataggagggactgaagtgtgagcttaaacatctctagggcagcttaattttgcaaagcttactatcccaactatcttcgacaacatttatttgaagatttatacatttaactaatgttgcttggataaagctcaaatttttccatatgaaccatgagaaattatgtaagagtcttttaaagttgcattttccatatttattagttcagcaccaagtatataataggccctcattaaataatagccctgtttggttttcctatatttaaatttttaagatgtaggcttatagattattaacgttgaaatagctctatgttcaatgataaaatgctttcaataaatacacttccagctttccacatttacttttgttctttttaaaaattattttctcattgcaaaaaaaaaaaaagcgtcatcgagagcttcctatactagatgctagaaaaaaagacacagtaactgctcttgaaattttttatctgttgggaaacaatttatttgagtataaaagtttcagctgcttgatggaggtatgtgaaaagtgcagtaggagcccaatgaaaagcatcttgggctgttaatgcattcattttctatgctgcgtaacacatttccacgaacagtcccttgaaacaaaccatgtttattatttcacagtttcctttggtcaagcccaagcacagcatagcaggactctctgcttcattgtctcactggctggaatccagggctgcagtcttacaagaggctaagccaaggacagatctaattccagcttacttggattgttaacagaatgtatttccttgtgggggtatggctgagagcctcagcttcttattggctgttggctggaagatgccttagctactagagtctgcccacagtaccctgccatgcagccctctccataggcagttcacaacatggctgttgcttctttaaggccaacatgagagtctctctccaatcttctaagaagtgtgtcttatataatgtaaggtaatcatgggcatgatatcccatcttttttgccatttaatgtaacctaataaagagggtgacatcccatcacctttgctatattatattatttagatgccaatcaccacttcaactcaaggagaaggtactaggtaaatgcatggacagcagggaacagagaaataaatattaggcgtcatcttagcttggggtgtgtcagagctgaagaaaacctaaccatataatccagaaaatcttctcgggggaatggacgccgtgctaacacatgatatttatgagtagataataggaaaatgaaccatgctaagacaacagctttgctgaaatgtagacaagtgaaagagtattgagaaggtaagtcggggtcagatcacaaagggccttcttttgtgaattaaggagtatgccaaaagccaagggaaaaatggatgaataccaggcaggaagcaccatggtcagagtttcatggtacaaatgctattctggcagcaatgtggaggacagatggaaggaggttaagatgagaggaagggaaataaatgagatgctatctatagtcctagagtcatatggaagactgaattcaagcagtagagtagcatctggatatgggaacttttttttttttgtgacggagtctcgctctgtcgcctagactggagaggaggtgcaactaatatggtatcaattatatagcattagtggtaggagagagattgagtattttttgtgtatttaaagccagtagacttctttcaggtgatatatgagttttaatttttaatgatgccataactaaagagcactgagatttctgtaaatgtgctaaattccttatagaaagccaaattggtatttaaggacaaatggttatgataaaacaaaacttctgagacaaatactctcatctacagcctggcataggcttgcaatggataactgatcactaccttgaatgagtagacaaaggccaggagccccaacatattttatcatttaacgtctcattcgacaggagcctcttgattgttttctacttcagtccaattttaaaatgatagtataatcttgggtaatttttttcatcagcaataagtaaagattttatgctggaataagactggggaggtagttggaaaggtgttcccattagcagaaactggcctgatacctatttgatcatctgtacaaagaaggtactagtttgatgacagctgtctggtggttttacctatttctctaaacactgagaaaaaaaaactggtttgaggagaaagaactggcaccactgtagacattaatccagtgacgaagaactagattagggagggttaaactgatttctagcaggaaagctgatttgtgggagcttgtttatttccttccatgtcaggactgcttctagccaaacatgttagggtggatatttattgtctttctgtctgcccaacattcatttttcttttcctcattgtactccattttcctcttgggaatcacctgtctcccactgatggtaattttgatatgactgtaaatccagacaggtgtccccatgctccagaagctgaaggaatcccagaggctgaaacctatgccttcaggcagatgcttcccccttacaggaggcagatagacaatctaagttcagttggaatttaatcattctagcagcagctgctttttccatatctggttattttatctaaagctttcccacattccttctgataaagactctttctgatttagttaatcagagttcgttgtttataaccacagaaaatgatacactggttcattagcattttaggagggaggaggaaatagtttattgaacttctatcagctgtcattcagttagatgttttacatattttatcactactaaattgaaacaaagtataaatttgtcttcatattaatgaactgaattattaatacattttctaatattaaacccagtttacattctgaaataaagtcaacttgcttgtgatgaatttatattataaaatgaagaacatgtatatagctagatttagtatggtaaaatttagtaagtgtttttgcatctatgagtacaatgagattgcctaattttagtattgacattatactattctgaaattgaactggtgagtgtacctcttttcctcattctacagaaatgtttaagtgtgaaatttttcacctcttggttaaatggaagaacttgtctgtaaaactatctgggtctagtatttccttgtaagaatattttaaaactttttattcactgttttaatatttatatgattattcaggttttctctttattcttgagcaaagtttaataagttatgattgtcaggaaatttgtcattttttttaattttcaaatttggtagagaaaagctttgtaaagtattatcttattatcgtttcaaattttctgttacctatcttgatatgtctcccttttcattcctaatattatttttacattccccaattccttcctttcgcataactttaagggacactgttaacaatgtattattctatatgaatcagattccatggatcacagtccattaatatattcataaatacaccatttatgtagcatatgatatgaaatgtagctcttggaattatgcaaaatgatgttcctggtactcttctttttcttgagagatctttccagaatttttaaaattttatttgttatgaaaacactaaattgggccttgctgattttctctattgtatttattttctacttttgaaatatttgttctgttttttacagtcttcttcccaactttcttttatttttttccccctaacatcttactttggagactttgcttattggttttcatactttttcttccttttctaatgtaaatacttaaggctataagttttcttctttcaatcattttagcagcattccacatattgtaatattcagtattattgctgtttagttttcttctttaactcctgtgttatttagaaatggacttttaaaatttaaaaatatatatgttttcaaagctatttctttattcctgatttctcattattttgtggtcaacaacattgtttctatggcatagactctttgacatttgttgaggcttgaactatggcctagtatagggtaaatttttgtaaatgttccatgtatatttgaaaagaaagtgcattctctagctgattagtagggatttatgtcaattagatcaagactcccacttatgctactcagaattgtactttctgtttcttctagtatctccaacctttcctcttttattacttacaggtttccatgagcatctattttgaaatttcagtaatggtcataaaatgtgcattgtttgtccaaaaatgtttttattttattctttttttctgaagaaatacttattttttcatggcaacaaaattctagttttgtttttttggtgttccttgaaaatgtaactctactctcttatagattccatcttactccatatttagttgtgttactttaggtaatctacctttccttttgggttgattttaaagtctgttctgtatgtttggtgttctgcagctttactatagtaagtctaggtttgatttcttatgataaatgctgttggggcttattgtgctacctaaatcaatggacttgtatatttaagttatagaaaattcttagcaaacttgtttttttttttagtaatacctcttttcctattttccattactgaaactctcattaaaagtgtactggcaagatactttcaataatgttacggtttatactcagatgaagagggaaatagtgcctgagcctcagaccgtattgtccttgtctctgtgtgcatttgtttaataataccatttcttttctaattatctcaaaagtatttttttgagctacctatgtttctacatcttgaatcactttgttccatcctccacttttcttaacttcatctcatttctcatcttcttatcctctgtggtgtcttccagagaaatttcctgagatctagttttcactccctggtgctctattcaggtgtgtctaacctgctgtttaattccttaaaggctattttcaatagctacttttttttaatttctggaaattttatttggttctttgttcacatcagctctctgtttttagtagtcttttgtccttaattatgcctttcattttctcctttacgtcttgaacatattagaacatattgtatattatttatcctacactttgaattgtttgagctttttactttgttattttcttttgctgattctcaatcatgatgattcactttcttgaaaattttgtggctggatttattgtttccccatttatttagagtttatgtcttctgggtatttatctatgggaattctttgagacttgggttgaaggtgagtttcaaaagaaataatgtgtatttgtttcttccagacacctggggacaactttacactctttttttttttgttattgtttgtttatgtttgtttttgtttttgtttttgagatgtttttgagatggagtcttcctctgttgccaggctggagtgaagtggcgcgatcttggttcactgcaacttccgtctcccgggttcaaacgattttttcttcctcagcctcctgagtatctgtgaataccagtgtgcgccaccacgcccaactaattttttttttttgtattttttgtatttttagtacagacagggtttcaccatgttgggcaggatggacttgatctcttgacctcgtaatccgcccacctcagccacccaaactgctgagattacaggtgtgagccaccgcgcctggcctgaactcttatattggtggtttttagaacacacagtgtgaatttgagttccaaatcttaaaaaagggccaagttgtgattacaaattctcaggcgagatttttccccccattgagtgtcagacccaagattgataaatatcctcatcatcttttttctggttatattagtctgctcaggctgctatgactaaatattacagactgaatggcttaaataatagaaatttattttctcacaattctggagaatgggaaattcaagatcaaggtgccagcaaattaggttgctggtgaggaaccttttcttggcttgtatatggctgccttctcactgtgtcctcatatgacctttccttgatgtgtgtatgcagtgcatccagagaaggaaagacagagagcaagagaaagagcaaaccagccccctgatgtctcttcttttagggacactaatcctaataaatcacagccctacccttatgacctcatttaatcctaattactttcttaggggccccatctccaaatacagccacagtcagtgttacggcttcaatatatgaatttggaggcagaagaacataaacattcagtctatagccagtggaataggtattttcctagtaggccctttcagtgatagaatgaggatttgggctttcagctctctgtaggaatctttattctgactcttcaacttgtgtgagccctaggctaagtctcttgttcctataaggtcatttagattaactgtttaggtgattgtgaatggcagatgtccccagtgaagctggtggcttcagtatttagttccacctctggatttatttttggcttcacaagatttcccatactttctgttcaaattagttaaacattaaaatatatatgttttaaatatttcaccttgtattttgaacctttttatcataaacattctcagacttttgtgatatagaagtcaatacaatagtagatacgatgtaatgtaccctcagattctataatcgtcattttgtcaaacttgcttaaacttgttcttcttctttctttttatgtttttattttaatattttagagttctaatatcaattactacattttataatactaatgtatataaccatacaaatagatattttctatataatcacctagaaagttaccaatttgtctttactattatctaatacatttgaatataagtcaaattccccttattatttcaaaaatgtcattttatggttggtttgtttaaatttgggcccaaacagggtcaacattttgcctttcatggtggtggtgctttcttttaaattccctttaatctagaataggtccttcctttttttaaaatttaatgataccaatgactcttgaaaactaagacagttgccttatagaattgttttcttttggtgtataaaatgtttttctattcttcatattttctataaactaaaaaataagtataaagcctggattatatttggattcaacttctttagcatggatacttcacagatggtgcatgtaatttgtattacattaaatcagaaaatatgtatatctggtaatcataattttagtgatgttgaaatttatcattggtacaggttttgtcagcctgacccttacattacaaatttccccattagtcttttcacataatatcttttacaatctattgatgattgttgccttttaacattttttcaacataatttgccatttggtgattttctaattctgtcattaatctacatttatcagatgaaaattttctgaaaaaattttcctcacagacgaagattttagatgactctgatgctcagtttgtgtaggagaagatgtttaattctttttaattgccaattttcatagtaaatggttgccactctagctacctcctgtgctgaaatgagttgttttttttttaattttccattaggtttttggcttttataatgtgaagcttcaaggtgtttttataaagagaaggattataaatcaaaaataaaaatcaagaatactaaccacatcactatacttgggtttcgtatttcttgggttcatgaaaagtttttagacttggctttttctagaatataagtaccttccatatggacacaagagtagatcttaatttagtaaggattcaaaattgaatttctcagtcctttaaaccctagtctatctttagtgatgtcattatttttaagttcctgtttatcctttaaggtcaatgtgatcctacatttctagaatgattttcctaaaatttatttttaatatttcatcccttcacctccctgccttcatccatagaatctgagttgggataaataacaagcctatcctcaatctcctttacatagcaaaaactaatatgggtaataagacatttgtcaaatagtgatttgtgtttttaagtcatgctaataataaaaattaagaattaaaaagagagagagagagataattaaagctctatggaagtgaatttcttagctgccaaagaaaagattgatgataatttaagcaaacttagagtgaatactttgtgaacacattaacatggctatttctcttcctgaccttatattttatcaacatcttattacgtggaaaaaaatgaagacatcaacatagtacaataagcttatttaagaggcaaatgggtcaagtttgtatgaaatggaaattatgaaaataatcacaaacaagtcattgaacaggatttaattaataagttatacaaaagaaaggctctgcaataatgtgttcaacaaccaaagaaggcatattctgcttacaaagtatgtatgataatctaagataaatgtgtgtaacataatggaaaagcaaatgtataaatgacaaagcagaggtagagatgttgttttaggtagcaaggatctagcctcaataacaatcagtattaaaatatggccagctaacactgtaattaaaaaaaaaaatattccagttgctcttccaaaggcaacctttaggttaatactaaaacggataaagtcagatgatcaaaattttaatattcagtctatctgtagacaaaaagatagatatccacattttaaaaaccctgatttttaatgttttattaaataagttttattgcacatttatagaagataaattaaggtataaaaaactaaatgtaaagtctgtattataaaatgacattaacatggtgtgccatgttatcagactcagcagcattgtcagttggtaagttttatatatattgttttcaaagaaccagttggtgaacaaaaacagcgcaataattatagcagttaattcatgcattcattcactcagaaatcatatgtcttgtatcatgtgctagatatagttccaagcactaattaaacaaagattaataagacaagaacccttcttttaaagaactcagtctctttggagaattattcacataatcagttaataacagtccactatgaaaagtgttataatgagaatatggaagatgtgctgtgggtaatttgaaaataatgggtattcttgctttggagacagctttttaaagacagagtttctcgaggtagtaactttaaatttgggtattgaatataagtctaccagctggagaaactgggcaatagtccattaaaatctgagactcaagcacatttgtagagacaggaaattataaaatacatattgtatttaggggttaatacacagttctctgtgattggagtagggggtgcatgagagaggacagtagatgagaatccatatgatgtttggtgaagatgggaaagactaagtgtcatgagaagaagcttgggcttttagactctagtgtttatgtgtccagcaaaggttttgatatagttgtatgtagttacaagttacttagtttgagggggaaaaatgaagctgggaagggactgtaggcagagagataagtttggaaggtgttgccagagttgatgagatatgaatcaagctagtggtagtaagaatgcccaacaaggtgacaatttcaggtattctttagaacaagggtgtccaatcttttggtctccctgggccacactggaagaagaagaattgtcttgggccacacataaaatacactaacattaatgacagctgatgggctaaaaaaaatcacagattaaaaaatctcattatattttaagaaagtttacaaattcatgttggactgcattcaaagccatcctggactgcatgcagcctgtgggctgcgagttgaacaagcttgctttagaacataaaatcaattaaagcagagagacagttgaacattatgggttatggtgagaaataatcaataattatcctgaagtgttcaaattgggtggattactgtggcattgagttaggagaatagttggagaaactggtttggggaaaaagttccctgagcttgatttcaggcatgtggaggcttaaaacccaggaaggactataaggaatgggtcctagagatatccttttccccatgaaacaaataattttggaaggaacatatcaagcaagctatttgggatttgactcagtttggtgggttttcattaaagcaaataatttttctgcctgtgaaaaaagcaggaggaacctctcaacgcagagcaaatgtgttcatgtaaagtatcaagaagctcaaaataacttttcatatacatttttacaaagcagaaatgagaaaattatcatccttatgtttatattttagatctattttgtgagattagatccagtgttacctttgatcttcattattagaaatttagtgaaagtatacatattttgttcaaactttagagaaaaacagaagttgaaaggaatttgggggattttaagaacatcttaaaaataatcaacaactcctagaaactaaaagttaaaaataaggatctttgatgtttcaacaatgtgataattcaacgattatttactttctgacagtatttgataagcaagtttcctccttcactagtcattatttcagtttttccccacaagcaccctaactggtatttcttttcttttttttttctttttagacagagtcttgctctgtcacccaggctggagtgcaatggcacaatcttggctcactgcaacctctgcttcccaggttcaagcgattctcctgcgtcagcctcctgagtagctgggattccaggcacgtgccatcatgcccggctaatttttctatttttagtagagacggggtttcatcttgttggccaggctggtctcgaactcctgagcttaggtgatctacctgccttggcctcccaaagtgctgggattacaggcgtgagccaccgtgccgggcctggtgggttttttttttgttttgtttttttttttttttgactgtttcttaattggaaaaaacaaagtttagagaaattaagtaacattgttgagatcatccagatagtcgtctggagtttgaacgttggccttgcatttgtttcctccacaaactgaaaaaagttcacatttaggactcagttgcttccatctcattcctctcttctcttgcctctctctgtctctctttccttcagttatttttctaaagtatccacccaagtacagtctgtagttattagttaagttcattattcacatatgccagtaactctcgtggtttcatctcttgctatatttttaggtatttggtaaggtgattgtctctctcaatgagcatttgataaattaatgtgaatgtctcagtgctaccaagctactgaatcacaaacttagatgggaactagtggactaaatcttgggaataaatgacagtaataacattcaacattgtttacctttagttaagctaatggaagctgaacacagaaaatactttttccatgttaagaaggaatagattcccgagatgcactactaacagaacttgatttgtcatttgtgactttttagagaaatgtatatttataacactattaaacagaatagccttaaatcaaaaacagaaaatgtggtttgactagtagcatctggaaagaatcaattcctttgcctataatgtttctaagcaaccacaaattgaagcaatgcacagatagttcatgggaagttaaagctataatttttatatttccataattttggatttgctgtagggcaaagacactgaaagctaatttacacattctgtctttatttattaaatacaaatttcgtgtgatggcaaatcatcacagctttttataagcaaatgggccttttcaggaggtccaatttaagtctttctttgttgtgtataattagaatctgcatatgcggtccagcataattattttgtgaaataaaaagcaacactgaaattgtgatgttaatattataaagctgtgaatttattaacacacttcagatgctttctgaattttaaaaattctaattggattggattccatcattaccaaacaatactttaatgcacctatgtacaatatgaatctaaatgtaagtcgtaagttttatactgtttggtatgtcttcatttgcatttttcagattaatttaaatgtaaatatactttacacaaattaccgcttaaaatccttgaaagtaaatgccaaaggtctgacacctaacaagaagatctgaacatgcaattttttaaaatcacatactaaaatacagccatttcagaatattatgatttttcaaaatgactgcccttttccgtgaagtgggttatctttttaataaagtaaaattagagactagctgagaggaaatgaaataaatcttccttatataccatgcaggagatattattttctcatagaaatttaaagtacgtttacaaaagttttctaaaagtagaaaattttcatagattatatcaggacttttttgttaactaaccagttgagctcaccatgagaagtataggaataatgtttaatcttttttgggagggaagaggtttggtaggccatgtttaatcttacattttaaaatgttaattgatcttagtagtatgtcgattctgaccaatagaataagcaagtttgctgtgctggtagaaaagattttgtggccaggcgtggtggctcacagctgtaactccagcagtttgggaggctgaagtgagtagatcttttgagcccaggagtttgagaccagcctgggcaaaagggcaaaaccccgtctatacaaaaaattagccaggcttggtggtgcacacctgtaacttcagctacttgggaggttgaggtgggaggaggatcccctgagcctgggtggttgaggctgcagtaaaccatggttgtgccactgttgtaccctagcctgggtgacagaggctatcaaaaaaaaaaaaaaaagattttgtatactacatgtattttttttcttttggtttataaagagatttgtgttatctgacttcttatttataaatagtgaaatagtgccatattaaaatcgcagcttgtcttttctttttagtaaagtaaaccaaaggctgaaaaagaaccagtagaaacattattcacatctcactgacctctttagatctaaagcgacaaaaagactttggtcctttggacataagtaggcaactggatttataaaaaagccagaatggaaagtgtgaagagtgactgagaatgtggtgggcacatttctccaacatataacctttgataaaatagacccctagatgccctcctcccaccacctgcccacacatgtacgattatagtggtctttattagtatgtgctaactatcagcattcagtattttgctttgaactttggttcctttcagtctggctcaggaacctactccctatactttcagttcaccaataatttcttgaacgcctataacgaacctataacgcagagacctaataggtggtaaagagtcagacactgctttccagaaatagtactcttgtgggagagaatacacacatatgttattaatgctaataaaagaagaaacctgtcttgtgtttctcatagtggtaaaaaggatttgatgctttctgaggccctactgtacaccacacactgtggtaggcacctcactttcagcatcagtcaactctccccaaaatcctatgtggataagtgatttctaaaatcatttaattagttgctagtgtgctagaacttagacctagtctacctatctgtctgaccccaaacttcctactattaccatgccacttcctttatttcaaattggggaaaactaggagattccttggaaatggtggattttaaaggtgtaattacatagtttatttttccacttttaaatgaataatatttcaaattttcataaggattttaagtacctaataaagttgaaaaaaaatacaacttccccctataccacttttaggtgagaggcagctcagatctgtgaaacggttatatattcgagtctatgaatggattgtatatgtcaaacagttgtaatatgcatatgaggaagtgcataattgccaagaaagaggggatatcctcttccttgtaagatataacattctcatctcaggaagaagaggtaaataccctctctcttcagcattataattatttatgttgttcatttgtggtgttttagtggaaacagattcaaaagctggttttattgtttagcagcagagggacctagaacaagtgaaatagcttctgtgaatgtcagtttccccattagtaaggtgaagggataaagtttaccccatatattgttgtgaatatcaaatgtatctgcatgctcctggcacatggtcagcactcaatacatatttcatatcctttcttatgatcctcaaactgtgttccctgttagcgtatctgaccctggggtttctcagtgaagggttttatacagcagttccaaccagcaatctttatgtcacattacaaaatttcagaagggcatatttttaatgctccaaccatgtctgtggcatgaagccttttattgaatagagagccaagtgccaagttacttcaggggccaactttcaacaaaacagttaaagtaaatgaagctattccttgtgtgtatgtctgcccgccccatctccccccaagaaaagctttgtatgacattgaacaagttagcctctctaagcctcagttgcctcatctgaaaagtagaaatgatcacatctgtctcaaactgttgtcatgagatctaataaattaagtattttaatgcatgagaaatattaacattttcttcccattcttgttgaagtcatgaataacttacaggaacttatacttttttttgaagagacagagtagcacagtggtttaaaaaatgagttccaaagcataacaaacctaagttccaaaccaactgtggtggctgggataaggagtctggagctctctatttttttttcatttctaagttaataatacctaaactcacagatttgtgtatttaaataaacttatctaagttatataaggtaatgtataaaacacggccatattgcagtataaaaatgtaaattttggagcaatcaaattgaaaatttcaaattatactcttggctaatgggatggatacgtgatttaacaaggcaaagccattacattgtgaatacgttacctcatgtggagaagtaattaacttcaatttcaaaaaaaatattttgagtagctactagttattatgcagtatactggactctggaaataaaaataattggtaagacactagttctagactatatacaaatatactttttctgtctgttacttgatgaatatttattgggtttcaaacacataaaattaaaaattaacacaatatttattgagtacttattataaagcagaactctactaaactttcatgcattatctcatttgatctcacatcatctttaatgaggtataccttgtgttcacatttaatagataataagacagaatcataaaagataaataactcacttagtgttacattgccactaataaatacaaccaggatgcatctaaagcctgaactcctaatatctaacttagaccacatgttaacaccaaatacgtgatcttcctttataattgtacccttttctctgaatgagcaatttgctttaaatagaggacatgtttacttgatctagtagatggtttgagcacatgctatttttagtgaccgtttatcttgaaatctcaaatccttaccttgggagaatatttatatagaaagccatgaagaataggcaaacatagaatacattgtttttattagtaattttaagaagatgagagaattataagaatgtgaggtagaaagttgtgatatgctgggaaaaaaaagctaaaataagatattttgaaaaagtagattgagcatataaaaagaacatatattacatgttgtgaataaatacaattgaccaaaccttctgtcccattgaaaaatgagaagagctgatagtggtaacatcaggcacttttatagtttagaattgttttcaaagtcactggctgcatagactgtgacaatacaataaaagcacaaaacagcattggagatcttagatatagaaagtaaattacctgtcagtgtctgagatcttgccttttctatttgcattaactagaaaatgtaggtacagggtaagtataaataaagagatgtgtgcatctattacgggctctgatcaaagctttctagagtggtgataaatgtatcatttacggaatagataacacagtgtcttagtccattttctgtcactataactgaatatctgagactggataattgataaagaaaataaatttattcgttaaggtcctggaggatgagaaatccaacatcaggtggctgcatctggtcagcttctggtgaggtccacttgctgtgtcatagcatagaggaaggcatcacatggcaagaggggtacactgagagccaaactcacttttttaacagactcatcttgtgataaataatccattcccatgataacccattacttcactaacccattaatccattaatctatgtatgatccaatcatctctcaaaggcctcagctcttaatattgttatattagggattaagttccaatatgaatttcagatgaaacaaatattcaaaccctagcacacagccgtcgagacttcaaacaatcatcctgcttgaatgggacttgacaactacagttcatgggccaagtctgtcccagtgctggtttttgtaaataaagtttcactggaacacagccatgccattcatttctgtatcatctgtggctgctttcgtgctacagtggcagaattgagtagttactgcaaagatcacatggcttgcaaagcctgaaatatttactattttgtcctcctctgttgaaaaactttgctggtcctcgacttagaagattatttgagcaggttgtttagtttccatgtagttgagcagttttgagtgagtttcttaatcctgagttctagtttgattgcactgtggtctgagagatagtttgttataatttctattcttttacatttgctgaggagagctttacttccaactatgtggtcaattttggaataggtgtggtgtggtgctgaaaaaaatgtatattctgttgatctggggtggagagttctgtagagatgcctattaggtccacttggtgcagagatgagttcaattcctgggtatccttgttgactttctgtctcgttgatctgtctaatgttgacagtggggtgttaaagtctcccattattaatgtgtgggagtctaagtctctttgtagggcgctcaggacttgctttatgaatctgggtgctcctgtattgggtgcatatatatttaggatagttagctcttcttgttgaattgatccctttaccattatgtaatggccttctttatctcttttgatctttgttggtttaaagtctgttttatcagagactaggattgcaacctctgcctttttttgttttccatttgcttggtagatcttcctccatccttttattttgagcctatgtgtgtctctgcatgtgagatgggtttcctgaatacaacacactgatgggtcttgactctatccaatttgccagtctgtgtcttttaattggagcatttagtccatttacattttaagttaatattgttatgtgtgaatttgatcctgtcattatgatgttagctggtgattttgctcgttagttgatgcagtttcttcctagtctcgatggtctttacattttggcatgattttgcagcggctggtaccagttgttcctttccatgtttagtgcttccttcaggagctcttgtagggcaggcctggtggtgacaaaatctctcagcatttgcttgtccgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccccttgtggataacccaacctttctctctggctgctcttcacattttttccttcatttcaactttggtgaatctgacagttatgtgtcttggagttgctcttctcgaggagtatctctgtggcattctctgtatttcctgaatctgaatgttggcctgccttgctagattggggaagttctcctggataatatcctgcagagtgttttccaacttggttccattctccccgtcactttcaagtacaccaatcagacatagatttggtcttttcaactacatggaaactgaacaacctgctcctgaatgactactgggtacataacgaaaggaaggcagaaataaagatgttctttgaaaccaaagagaacaaagacacaacataccagaatctctgggacacactcaaagcagtgtgtagagggaaatttatagcactcaatgcccacaagagaaagcaggaaagatccaaaattgacaccctaacatcacaattaaaagaactagaaaagcaagagcaaacacattcaaaagctagcagaaggcaagaaataactgaaatcagagcagaactgaaggaaatagagacataaaaaacccttcaaaaaattaatgaatccaggagctggttttttgaaaagatcaacaaaattgatagaccgctagcaagactaattaaaaaaaaagagagaagaatcaaatagatgcaataaaaaataataaaggggatatcaccaccgatcccacagaaatacaaactaccatcagagaatactacaaacacctctacgcaaataaactagaaaatctagaagaaatggataaattcctcggcacatacactctcccaagactaaaccaggaagaagttgaatctctgaatagaccaataaaaggatctgaaattgtggcaataatcaatagcttaccaaccaaaaagagtccaggaccagatggattcacagccgaattctaccagaggtacaaggagaaactggtaccattccttctgaaactattccaatcaatagaaaaagagggaatcctccctaactcattttatgaggccagcatcatcctgataccaaagccaggcagagacacaaccaaaaaagagaattttagaccaatatccttgatgatcattgatgcaaaaatcctcaataaaatactggcaaaccgaatccagcagcaccatcaaaaagcttatccaccatgatcaagtgagcttcatccctgggatgcaaggctccttcaatatacacaaatcaataaatgtaatccagcatataaacggaaccaaagacaaaaaccacatgattatctcaatagatgcagaaaaggcctttgacaaaattcaacaacgcttcatgctaaaaactctcaataaatttggtattgatgggacgtatctcaaaataataagaggtatctatgacaaacccacagccaatatcatactgaatgggcaaaaactggaagcattccctttgaaaactggcacaagacagggatgtcctctctcaccactcctattcgacatagtgttggaagttctggctagggcaattaggcaggagaaggaaataaagggtattcagttaggaaaagaggaagtcaaactgtccctgtttgcagatgacatgattgtatatctagaaaaccccatcgtctcagcccaaaatctccttaagctgataagcaacttcagcaaagtctcaggatacaaaatcaatgtacaaaaatcacaagcattcttatacacaaataacagacaaacagagagccaaatcatgagtgaactcccattcacaattgcttcaaagaggataaaatacctaggaatccaacttacaagggatgtgaaggacctcttcaaggagaactacaaaccacttctcaatgaaataaaagaggatacaaacaaatggaagaacattccatgctcatgggtaggaagaatcaatatcgtgaaaattgccatactgcccaaggtaatttatagattcaatgccatccccatcaagctaccaatgactttcttcacagaattggaaaaaacttctttaaagttcatatggaaccaaaaaagagccctcatcaccaagtcaatcctaagcctaaagaacaaagctggaggcatcatgctacctgacttcaaactatactacaaggctacagtaaccaaaacagcatggtactggtaccaaaacagagatatagatcatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcagttcaagatggattaaagacttaaacgttagacctaaaaccataaaaaccctagaagaaaacctaggcattaccattcaggacataggcatgggcaaggacttcatgtctaaaacaccaaaagcaatggcaacagaagacaaaattgacaaatgggatctaattaaactaaagagcttctgcacagcaaaagaaactaccatcagagtgaacaggaaacccagaaaatgggagaaaattttcacaacctactcatctgacaaagggctaatatccagaatctacaatgaactcaaacaaatttacaagaaaaaaaccaacaaccccatcaaaaagtgggcgaaggacatgaacagacacttctcaaaagaagacatttatgcagccaaaaaacacatgaaaaaatcctcaccatcactggctatcagagaaatgcaaatcaaaaccacaatgagatatcatatcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcagcactattcacaatagcaaagacttggaaccaacccaaatgtccaacaatgatagattggattaagaaaatatggcacatatacaccatggaatactatgcagccatcaaaaatgatgagttcatgtcctttgtaggggcatggatgaaattggaaatcatcattctcagtaaactatcgcaagaacaaaaaaccaaacaccgcacattctcactcataggtgggaattgaacaatgagaacacatggacacaggaaggggaacatcacactctggggactgttgtgaggtggggggagtggggagggatagcattgggagacatacctaatgctagatgacgagttagtgggtgcagcgcaccagcatgtcacatgtatacatatgtaactaacctgcacattgtgcacatgtaccctaaaacttgaagtataataataaaaaaaaaattattaaaaaaaaaagaggattatttgaattctggttttcaggtgaggtagataaattccccatagaacaaacacttgccagacatgtgaagtcttctgaattaaaaccctgatttttaaaaaagcagctgttataacaactcttcttatgaacctattaatttggaggaagtgattaattcaccagggatttcttagagttaccattagactgctttatgaaggcatttactctttcaaggagtaacttttagtagattctgagtactagtactgaactgggcgtgagaaatacaagttgaatcagataaagcctatatccttgaagaatttcaactgttgtggtgtttatactgtatctttatatttaagtttggtttctagtttgcttttttattcaatccatcaatctctaccttttaattgaagagtttagactacttacatttgatataattattaatatgctaaaatttaaatatgttatcttgctatttgctttctactgctaacctctgttcttttctcccattttccctgattgcttttgagttgagcctttttgtgattccattttagatcaactattggcttattacctatatttcttttaattttatgtggtttcactagggtttatacaatttatcacagtctatctttaaataatattataccacttcacatataatgtgagaaactcacaataatatgcttttaactctgcacatacctcttgtgcacaattttatttctctatgtaagtcatataatagattactatcatttttgctttaaatagtcatttatatcttaaagagattaaaaatgcaacaaaaatataagtacctggatattgatcatttctgatgttcttcatttctttgttgtagctataaattctgtgtatagatatacgtttcctctgtcgttatttttctttgcccacaaatcttcctttgacctttattgtggtacagatttgctggcaatgaatattataagattttgtcctttttaaatgatatttttgcaggttatagatttctagattgacagtccttttctttcaggactttaaagatgtcactgccatatgatctgaatagttatttatgaggaggggttgctgtcatcctttgttctttatggaaagtaagctttttcttttctggctgcttttgaaatttttcactttgtctttggttttcagcaatttgatcatgatgtatggttttctttatgttcattctgactggggcttttgagcttcttagatctgtgaatttatagttatcaaatgtggaaaactattggtcattatttctttaaatagtgtttttattttccctcccactttctaggactgtacttggtatcattcagcatatcactggcactctgttcattttgttccagtgttttaaaatctctgtgttttaaacagtttccgtcactatttcttcgagttaactggtttcttcttttgcagcatcttaatctgtggttgatcccatctagtgtatttttcattttgggtatctttttttatctttatatgtttcatttggttcattaaaaatcttccatttctctcatactcttcatcctgtttatgtttttgtatacatttttacatatgtaaagcacatttttaaaattagcttcttaaacattcttacctattttattatctctgtcatttctctattaattcatttttttcctaattatgggtgataatcaggaactgattacataatccacacttgtacctctctgactctctgtctgttcatgatagtccttcttatccttcaaccctggtattctgaccacaaattctacctgccatggctacccaaaacaatttctgtcttcagtgcattggagaaactagactctgtttgagtcccgtatttctttctctttcctgaaaactgcctccaggcagtaagctggggcaattgtggagctcaccttatttatttcctttctctcatggatgatagggacatcaaatgactgaaaattgttgaatcatatattttttcttgttttccagttatttatagttggtgggcaatttccctcgtagctaatttgggaggatgtgagattttatttgagccttggaagtataagtaggaatttggccctcaaatctgatttaataatttatttgaatttaaccagttttcttttctattcccttgattgtcttcttcaaacctttacttttcaagccttctacccctataatcacattttttttagaattggatttctttaaaaaaaattgagataatgtggctataaggcattttctctctcatcttctcatattttcctagtatttgtcccttcagaggcatatttatttcatttcctttcattgaaaagatacctgttcacctgcacgattgattgcatcccattaatagttttggggtgatggggtaaaattacacatttagaaactagaatagattgcattactaagctaccaattgcattttctttgtgtaagagttttagaagctatttttttctctagtcttaagaattaactcatcaaatatatcaggaaatttactgtaaaatgtaaattatcagagttcgatgaactgaattgccaagatttagaaccaagtgtattactgtggagaaagcataataggataatctgttatcttaatagattaatagtaggatgatctattatcttagtgtagggagccataggaagctctaatatgcttaagaagaaaggatgacattttatccctcactcattgataggaagggctaaataaattagagtagaagcccaaagtgtaataagcactgtttttgacatctctttaggaagaatcatttgtaaggaagcttggggatttcctaaaatatgagaattgtttctccttagtttcataaactctctgaaagtcgttgaactttttttcacttggaaaaactaaattccagacaccctagacaataattttcaggccacgtaacctttgctaataacagcaaatatttcgggaaatgtattaactcttttatattttcagggcaacattaatgaattttaagccaaccaattcctcagtaattctgcagtgaaccaaaagagttaattcgtctagcagagatggggtgttaagattaaaggtaaatctgcttcaatgagatttgttaagaaatacagcacaaccagggagttacagattagaacaacagcatattgattcatttctcagttttaccatttctttggaatatatttgttcctcaatccaacttggagaaaatttgtaatactccagaaaaagaatatgtttaaaggcttattcagtctagggaagcatattattgtattgaaaatggaatcattttcttggccatggaggtcaaattctggggtcagatacacctgggtttaagttctaattcttctgcctgttgttatatatactcatatgctcatgtctccacacaacctgacatgctgtatctctcccccataaaactgacaagtaaagaacaatgtaagagaaatgatctgggttgaaatctcagcttttttattttctagttgcatggccttggataagttgcttaattcatatgtccctcaatttctttatgtatgtagaaatgggatttggaggataataacatctgataggttgctgttggatttaattagttattatacagcaaaatgattattacctttttgttctaatggtattacacataagtcattcagttataaaactgagtatgtcctatttgtgggagctggaacagaacatttcctgacactatgtctcacctcttcactgtgtcccagcagccatttaatatgtatgtgtgataatagccaagtctttgttcctgggtggttaatagagttatttttccaaataacctagagagaagttaccacctcagagttatcactagcttccccagggcttaatttcagaggtgttagagttgaaaacagagaatcatttttatctacttattacctggcacaaaaaaagaaaatgaaggcatggaaatcggtttcatataccaatgaaagtaggtttgcttttagtctcagctctaaaaaaaaaaaaaaaaaaaaatactgggacttgctgtttgatgaagacagaagttataagaacaggtgcccttactgagctcagcatcatctgatagtggcttcaaacaatgccaagtcttaatgagggctgcatttaataaaatgccacagtcagcttttatcaaggccactgcaaaggacatagctgcagaaatgatttagaaagtgtgcatgagtatgtgtgtgtgcctgcacacatgtatgtgtttaaataatggctgacatgttgagtaccttctgaatgagcaatgagatactatacggagcagatttttgtagattggaaagcacaattaaaatatgggtaattgtcattgtagtattataatagtactataaaagtatatgtagaaatcttttatttcatttttgtctgtttccaggtaggtatatataccaatgttttaattctagatgtggccaacttctagaaaattattacaataaccctcctgtacattaagaaatttgagactcttacctactacatgtttcatttaatgccttcattaaaaaaagatttaaaaataatttgtttttatttgccttggaaaataaatatttttcttactttcactagtaataatttgaaaaataatacttatatttagaaaagaaacaacaggtagtcaagaatagtgggtctttgttgttactgtgtgaaattcagtttttaatttactcatgttattaccatatttgttcacagacctctcattctgccccctctacttttagcagtacaatttatttgttcattcaacaagtaatcctgagcacctgctttatgtgccttggggacacaagcactgccattgctcttaaacataaaatacataatcacccaaccatgtaaaattaaactgtgataggttctatgaaggagaggaaaatgctgcggtgaaaacatgtaataggatggtatgacctggtcagcgaggttcctgaaggctttcctgaggagaggaagacatacatggacttggagtcaaaacatctgtgtgccttttgatacattatgtttccaaggctcatggtgttttctgtaaaataggaacagtaatgtatatctcacatgttgatgtgtggattaaatgagacaacaggaattgcctcctatgtcttctatccctctgtagtttgctgtctacaggcagccagagctatctttttaagaagacatccagactgtgctgtctcggctcatagccctttggtggctttctctcagtctcaggtaaaatctgattcctcatgaggctccaaatcaattactttttgctcacctctcctacctcgcctcttactccacctacattctttgctcactcatttctcatcgtgcaactctcttactcattcttgagcacatcaaaccaagctgatttctacccaatagcccttgaactttctggcaatttctcttctctctctggaatagtcccctccaaatattcacatgactcattcttgcacttcatttatgtcacttgctgaaatgtcatctttttaaaaatacttttccaggtccctctgtctaaatttcctctttctatgttcattctctaccctggcattatctgatcctctttcccttgatcctcctttgagcgttctttgtagaagttattgataataataattagaataagaaaacatcaataatactatttattaataatatttactactttccagactcttctctaagctctttatatattttaactcatttaatcatgattataaatcagatagataattactattgatctcattttacaggtaagagaataaggcacacagccattatgtaacttacccaaagtcacacagctagcaagtcatcatgtaagcatttaaggccagatagtcttgtttccaaatgccatgctcttaacaactatgttttgctgcctcttagcttgggattgtcttatacaggttctttgtttgttctcagttttcttgctagcatataagcttcgtgattcagattgtatccacagggcttagaacaatgcctcacatatggtggatactcagtaaatgtttgtgaatgaatagtagtgcatcaaagcatgttgttcagtgcctagaaaaagctggtctttattatgtacatttgtggtaattacaatttcctgctatagaaatggataaagtggactgctttccccaccaaaaccaaaaacaaacaaaaactgagtctgaagcatttatcttaggtgctttaacccttttcttttcatgtcccataccctttgatgttgtgaaacttctctttctgcttttgcttctactttcaggttctcagtgctcccttaatccttctatttggaaataatgtgaaattttcacatgaagtattgacaatctagttttcacttagtgataattcaacaggattctgtttgatgtaactcaggtataacattcagtaaatatttattgaacagtgacacatttggacactatgcaagatgctgggaaaatcaggtgcaagtcatgttctgtcccttcaggatacactaacccttctaatctatcttttggcacgatttttatacaatgtctcatttacttcaaatctttagtggctttgagaggaaggtcctttgtgatctttttttaaaatttctgattcttcatcttacctcttctcatgctctaattgtactaatgactctctaaagctataaccatagttcttagttttgggctgccataataaaatatcataaactaagaagcttataacaacaaaagtttatctctcacagttctggaggctggggaatccaagatcaagctaccagctgatttggcgtcaggtgaaggtctgccttgagcaccttcttgctgtgtcttcacttggcagaaggggaaaggcacttctctggggactcttttataatggcactaattccattcatgagagctctaccctcatgatccagtcacctcccaaaggtcccacttcctaatatcatcatcttggtggttaggatttcaacatataaattttgcagggatacaaatattacatctacagcaatagcggatgtccgttttgccttcatataatctctttcctcccttcctgtgatcctgtcatctcttcatcacttggctcatctacttgtccttcaaatcctagcacaagtagcaacacctctaagaagcattcacaggttctctgttgccagaacatcctactcatgcttgtatcatcttatatgatcctattttctggggtaggagaactatacactgtgaactaaagtagggcttatgcatttaccactcattcccataagacattaccttgttcaggagagaagtcatgcttgctatatagtaaatgttcaaaaattggttattaaaaggaggcaaagaaggtaatgtccttttttaaatgtcccataccctctgatgttgggaaacttctccatctttctgtttttgtctctactttcaggtcttcaatactcccttaatacttctctttggaaatggtatgaacttttcacatgaagtattgacaacctagtcaaaccgcatttgactcaaattgatgtagtgagcctaactgtacaataaccagcttcacaactctttagggagctgactctgggttgcagaggtggctggtgtgatgtaaagtggtagatctagggtttgacagatggttctaaggtctcgagtttaattctctgattctgtacttctaaaggcaacacttctaaggagtcagtgagagcaattttctatagtttatctactttaataagaaatattcatatttttagcaaatagcatttttctcatccctgacaacaaagttattctgccaggaggaaaatgttttgagaaaaaaaggtgcaatttccttctcaaaattaggaaattaaagctgaacatagtaggagaaaaggagacgatatgcaggcaagtagaattttttagtttaaatttactaatgcaaatttattgctaaaacattatatgtaagcagtctaatacacctttataattcacacaattaacaaatgtctactcaatacttataatgcattgagtagtttaacccagagttgactactgaaatcttccactttggtacatttttatacattggattatttttgatgttatgatattttactcagatgccaaagaaggaaatatttacttaaaaatactgtattgtggaattggaataatgattaaatcaacaccttcattaattcagattttttgagaacttacattgtgttaggtgctaatgaagtaagaaacaaaccaggcacaccctctgtcctcctagaggttatttgagcatttaattatttggttatgattttgataagtgctatggaggagaggaatgagagtggggggatcttatatcagctatctgaccaatcagggaggttgaggaagatctaacataaattaaacctgagtgagaatgttaatgattagtagaagttggttaggtaaaataaatgatgaagttgtgggaaaatgctgttacaaacagaggaatcaggctttgcattctgagagaagacagaacacagtcagggtgacagaagaacacagagccaagaagacaagataaaaatgatgacaaaaacataccaaacatgaccttgaggataacattaagaatctgaaatgatatttaaatagcagtgatcaccatttcaaagttattgagcagatttatattttagaatactatggctgttgaataaaaggagacaatagttaaaaagccataactgtaacttgatttaaggtaatctcattagagacgtggaggtgtgggtgaattaaaaaaatattttggagatagacacaacaggacttggtgactgatgcatgtgtggagatgagggagaggaatgtcaagaatgactttcagatgtatagtttgtgcagctgagtgaatggcagtgtcattcaccaagggagggaacactgcaggaagagtccaagtttaggtggaagaaggcgagttcagtttggggtatttgaagtatgatgcgtctctaagtctttcaaattgtcttgctaaccaaatcctaaaactgtctattggatttaggtattgtagatatctttggtagccttaaggcaagcggtaaaaaacagttggcagtaagttgagaagcaagtgagaggtgataaaatggagagagtagagaaaactctttttgagaggtttgtttgcaaataggagggagacacaatgatatctggagagaaaatatattgaaagtggaacagatatttgaacacatttaagtgcccatggaaaaatatctagtgtaatgggagaacttgaaaattctgaagacagaagagtaatatgtgttgtaaggaagagagtaggatccagagaacagaagaaagaagtaaaactcttctatgtgttctctttagctgtccctgagatttagaaacttaagacaaaaataaagataatttgtgagcacccactgtctgccattcatttttacaagtcctgcttttctctttcataaagttccacattgtctgttttaataaacagttgccaggtggcatattaccccttcccagaatttcggggaatattaccacaaagttattttaagacattaaaaatatcttagtgccttggcctaaccactacttgcgccaatgaattgagccagcagataagcaacaatgtgtatattacaaaatggcagctccttcacttacacccacaaatctcccgcaggaatctttttttgtggctcaccctagctggaaacatacaggaaacaaaattctgggaaatgtagttcagcctagccaagttgatatattacaaaattacaaaaacaacttcatcatttcacttggtttcactatgcattttattctttctatcgttcccctcttcacacatagagtcacttaatagtgtgtcaagggcttcatacataatacctcatttaatctccacagcaaccttgtggtgtgtgtattattacccctatttataaggaaactccttgtctttcccaaggttcatgagccagaatgtggtagagctataatggaaatcaaggttttaggacttctagtttggcactttttcagctagtaggagaaaaacacatctacttcatgccatgctgtggagcaagagcgggagaaggtcttcttttggttggtgggaacccatcttcctttttccttagactgcattgcctcatttgtttaaaaaggttctatgaatcaataaacctttccaaaggcaaggactatgagaaaatatcatgtggtttaggcacaaagatggatactatttacctcaagaaatttgtttaagatcccatctgaatctagcaatcctaatatttcagcccaggaatcttcttggccaagagctgtcattcttgagagctatgactatattttaattactatatggatttatatatggagcatagtgcgtccattctacttctcctccattgttacagtctgttctaattagtgtttcaacctaaatctgctgaagcaaggtccttttaagtcttcacctcatgccaagaattggaatcaccactttcctaagattactggcaaattaatatttctgctgactacaaatttgtcaaaattacaagttctctaaaaggacaataaagggaccagacttatggagtatccactatgttccaggcgctcagttaaaatactgtatatcaataaatcaaatgctgttatatatgtcacagacccatgaagaatgtaccattaatattttttaaggtaaaagacataaagttcagagagattaattaacttgccaaggtagttaggttccgagcattatttatttatataaagtttacgtgagtatgtatgcatatttgcctcttatttgaggaggattttaatttgttttataaatatgaatataatgcatgaagaaaaataagaataaaattaggggaaatagtcagaaatatgagaggacctgggctgaaaaacagatgaagtcaggggagcaccttttatataatatatgccacagagatcccctgtatttactaaaagtcaattaaaactttaattctgggttaattttggaatcaaatgaaaaaagaaaccatgataagtgttattatttacaattcctgtaagatttgaaataaactttttttttcatctggagaaacatatttttcctggaatttaaagtacagaaaaatatttcctgtttgtcctcacatctaaagttctgtataatagactgtacagtgctctccaaaaaataaaatcctgtaatacaggtagataggctgatgccaaaccatgactctctaaaaagcatttttttacattgaaaaggggagggataggaataggaaaacattgatttggtctgatagattgctttctgatggcctagattaattcaaagacagattttagagtatctagaagcctagatgaagaacaaattatttagcaaatattccattaataccatttgttcagccaaattttaataagtatgaaaagtgaaaaggaataatagattatacctgcagtgcaaaacatggcaggttataagtagagccatattcattaggaatcaccccaatgagggataacaacattaggaaacatttattgaatgattactatatgctaactgtataactatatgctaaatgtatcaactcattccattctctccagtttcttaggagggttcaataacccagtattgacaatggcatgaatggaagaccactccgtgtcttcatggtggttagctgaaggaacatctgtggtcaggtgtaggttctcaatatgtcctcctaggtatattctcttacatagatgtggatgagtaaggcctcaaagctctatgctgtagaacagtggttttaaatacattttgtgatacttactcctttgcatatgtgataaaatatgtggagcctatttctggaaaaatgcaaatgaacacaaacattttaaatgtaatttcaagaggttcatgaagcccctgggacattcctgttaacctcttcaggttaaaaacctgttgaaaagtatggtcctcgtcattttagcctggattttttttttttttttttggggggggggacgaagtctctctctgtcgcccaggctggagtgccttggcgcaatctcggctcactgcaagctccgcctcccgggttcacgccattctcctgcctcagcctcccgagcagctgggactacaggcgcccaccaccacgccccgctaatttttttgtatttttagtagagacggggtttcaccgtgttagctaggatggtctccatctcctgacctcgtgatctgcccatctcggcctcccaaagtgctgggattacaggcgtgagccaccgcgcccggcctagcctggatttttttaaagccagaataaagattcatcttagcgatatatatatatattttagaggcagagtctcactgtgttgcccaggctggtcttaaactcctggtctcaaacaatcctctctgccaaaagtgaccacattggtgtatatttgttgataagtatttcttcttctacaacaattagtagggccttttgttagttaagactgttcagaatttatgaagataaaagtatgtcaactacctgtgaaggatgcctgtatttatagtcactatggcacatgggtcatgttagacctactgtacatgaccgtgcaaagcatagaagtttcacatccaagggtgtgtcattcacaatgtagatatatcatagctttgcatatttctcatgacggcttttaagcagtgatattttactaataaaatctgattattcagaccctttttccaaagggttgaaataaaatataaaagaaaggatgccattttcaaaccccagaccttacaaagttgcagaacttcatctggttactaaagttcaagtcaaaactcaaaaaagaaggtgggggcagggggtggccatagtacatcctgctttagacaccatgcctttgggaaatattttctgacccatcaatattctgtccccagcacccctacttctggctttactaataagatgaaaatcatatttataataatttgggtcaatattgagatcatgcacttagcctgccacacgaggaatggctaaaacaacttgaggttgtcaaaaagttaaaaccgggaggtaatctaattgaaaaacttttccaaaaagtgtttttccatgtgtattactttgttaggcttctaaaacaaagtaccccaaattggtggcttaagcaatggtaatgttttgtctcacagttttagaggctagaagttcaacattaaggtgggttggcaaggttggtttcttctgaggactatgaggaagctctgttccatgcttctctcctaacttttggtggtttgcttgcaatccttggcattccttggcttgtagacacatcatcttaatctctgtttctttgtcttcatatggtgatatccctgtgtgtgtacaaattttcccttcttttaaggacagcagttattttggattagggctcactctaatgacctcttaaaattgactacatttacaaagactctatttccaagtaaggtcacagtcacaacaggtactaggaggtaggacttcaatatatcattttggggtacttaattcaacccatacaccatgtgtgccataaaaatggaaaacattcattattagaatcccctgtcatagcttacctacatgcattagcatattaagggtttgagaaattctgcagctaacaaacctaagttatttattccagagatccctgaatattactcttcctagcatacctataaacatcccatggaatatctttcttcttggatagaagaaaaacatagacttgaaagcaaatatgtagaatttagagtgagatctagaataaaatttgaattctatcatttcctaactgcctgacctttggcaaattacttaacgtccttgagctttatttttcttctttagtaaatgaatgtaattatttctacttaataagtttgttaaatagtactagaaaagaaaataatttatctatgctaaataaattatttaccttaggtacagggcttggcacatggctcaaatattataagtaatgataagaatgataagtaataataagagtgacactatatgatatttgttgagcatttactatgtgtcacatgctttccatagtactctcacctgtgttatctgttttaatcctcataacaagcttgtgaatgttattgttgttccaaattttagattaacatacctcatcttagagatataattactcaccaaagatcacaaattgtcagaatggggatttaaacccagatatttttggctgtaaagactcataaacccttatgcaatctgtatcagatagtgatgatctaggctacaagcagcaatgtgcctaagagtgacaaataaacattatttttctcacatattatgaactttggaggtaaactgccattatatcagggctgacatctctgtaaacctcttggccatttcattgtcacaaaatgggctctgcatctctgaacatcatgtactatttcagcatagggtgctaggagtgggttgtggggaggcatcaataatgtctgttttatttgtcatgaccacagaagcttttccagatttttcctccatgtcacagaattctgcttttagttcattggccagaattcaaacatatgaccacacattgctgcgagaaagactagaaatcaaaaacattctgcttttccagaacctatagtggagatagtcaagggagagggttgagattgatttcatttccctctagagggtaaaccaaatatcaatgggcagaattaaccaggaggaaactactggcttaacaaaaattataagtagaactggtcagcaatggaaaatccaagtaaatggcttacgttgtgggcatgatagaaatctcgatatacaatgtattacatatgttaatattctcaagtggtcacacatctaagaagtcatttgctctagccttcacccccaccccaatgcatttatttattcagcagcaccctaaccaattactgccaagcttctgtctgtgcacagctgggtgacactttccatatcattcaaaactcattaacagccatctaccagagaagtgattgacccccacactgagatggtgtttttattagatggctgtatgtgacctttttagccctgagatgaaccacaaaatagccataattactttttaaatattatctgcaattatttagtgaaacgactatcctagatacattgaacattagggaaagaggtcttgaaaggcatttcataatgcaacatacttactttacagataaagacagtgaaacccaaattttcaatagtagaatcaaaatgaaaactgcagtctcttgggaggccaaggacagtggatcacgaggtcaggagattgagaccatcctggccaacatggtgaaaccccgcctctgctaaaaatacaaaaattagctgggtgtggtggcatgtgcctgtaatcccagctactcgggaggctgaggcaggagaattgcttgaaccagggaggcgaaggttgcagggagccaagatcgtgccactgcactgcagcctgccgacacagcaagactccatttcaaaacaaaaaagaaaactgcagtctccagattacagtcagtaagataaatggaaagagcacttgaatacttgaattagtttcagatctaggttcaaatcccagcttaatcacatgctagctgagtgaccttcagcaagttaatttctcaagatttacgcttaccacttttttacccagctaactttcataaacatgtactgatacctgctgtataccaggcatatataagattcaagatgcaaaattaattaagacactatgctaagtttggaggcgcttataggctagagtgaagggaagacctataaataaataaacaaatgaaatactctctaatacaggaataaatgtgagttagccatagaaaggaatggtcagatccatttgagagtatcaaagaatactttgcactatatgacttaactgagagccttgaaggaaagagtgttggaattcaccttggtaattagtttcagaaaaaatttcacagctatgaaataatatgtaaacacatagtagtttttatttataaaaataaaatactacaggtttctgatgactgctttgataaatagaagagaaaacaccttcagaagtactcttttctttactgcttgttaacccactgcctttccctttataccaaagggtagcaaactttttaaacaaagggtcaaattgtaaatatttttggctttgtaggccagacagtctcggatactactattcaagtctgctgatgtagcagaaaagcaattatcagcaataaatagacaaatgacctggccatgttccaataaatctttatttgcaaaaacaggaagtgagaaggatttggcctacaagttgcaatttgctaacacttgctctataccatgaagcctcacaggtaatccaactctgtcattacaaagtaccagagaaggattttgaaacctcaggttaaaaaaaaagaaaagaaaagaaacatagattgtgacaccatcttcacttcaatatttgattctcactgtaggagataagaatcttcatgtgactctttctcttgggatattacaccaccactatcagtccagttaaaaatgaagaaggtttttattataattctgtaacctgttgcaaaatctaatagggtagaaaattattagtagtttgggagtttagaagtagggtcaatatcctaaaaagcttaaatatcataacttaaaaatcagccttgaatatgctttgttaagggcttagtatttactcgtgtacaggacttttgctttattccaaaatgttactttcacattctgcaaatataccggtttcaaaatttccaaatccatgtttcacatacaaattgctgcagtaattttcccaggtcagcataaaatttgttcctgctggcccacatttggaaagatgatctatgggaaaacaaatgatctggctgacatttcttttctttcttttctcttattttcatgagtttgcatttgcagtacttctctcaaggtaatttctaatgcgattggaccctcagccaaagtgagctctggttagggatctcaaatattacatacatagcattagtattgcattgcaaaggattaaaaagtaatataataaggcttcaatctctcttttttttcacttcagcttttattaaatgtacaaaagaaatatcatgtgttttaccctctataatccaaattgtccccaacctggccttccatacggtagaagaaataatgatggaaatgcaaaatgcagtaaaaatgtgaaattgcctttctgatgagggttcagctatcaagtaatttttagctctgaaattttggtaacttgagtaataacctggatatctatattcttcagacagggaacgttagttggaaaagagtcactgggggatagctagggaggacttcggacagataagttactgtgattaagttagatgaaggaagtcttttgttttcagatagaagagagtttgaaattgacaaatctgttgcctttaataggtggaaaagacaagtttctcaatgtctggttgcacttcactgagctttcaaccatctccatcaagaagtaaatatgagagctctgagttggttctactttctccagttttcttccattagaagaggtgtaggtttaagggtagtcatgagagttaacaacaataatagtagatagtatgtagtgagccctgagtacactactctaaaacctttacctctatgaatttattgaacctttccaaaagccctcatagtaggaactattatcaccccaatgttagatatcagaaaaattagtacagacattttacacacaaggtcatatagttagtaaacagtggaggcaagttgtggactcagtctggttccagcatctgttggctcggtcactttacctcctcccttttcaaagaggcttcaaactggactctgtgttggtatttgtttcccaaactgatattgatgttgtctttatttcttcattcttctctgactttaaataaatatttgataggctatattctttcgaacataaagtagggatctttcaattctgtcctcactctgcatgaatctgggcacatcactcaacaggtggcatcattttctttcttcaagaggacataactagataactagacaggaagaataattatgctgatttctcatgaaaatataaatagttggtattcagtacttcatgtggaagaaataatatttcaagacaattttttactgatgaatgtctatattaggaaaaaaatgtaaattttaggctattttaaataaattcaattaggtggatgtaagaagagtgacaacaataataccttcaccttaaatttttctatattttaccatgctttaaagtattgtcataacctgtaccaatcgccctggaaattaggtaacaaaattattactattgccattttttgaagcacaaaatcaggtataaaagcatttcctgcccatcccctgttgaacacttctccaaatgctccgtgtgtgttaaacatctgatgtttccactagatttcaagctcctcgaagacaaggaatgcttctcctttcttcagctacatccccagtttctggcagagttcttgacaaatagcaaatatttaacaaatacattcaaccagtgaataacaagagaaggctagtgacttgctttgatgaaaacagctgacagcataattcagggcttttcccttaggttggggggatatattataaactttgtaataaatataactttgtaatatctaattataatagcaatcataaataattaagcttgaaacctttacatgttggccctgggcaagaattcagtgtgataagcatttgttcattctaacttttgccccagctctctcttctcttcctggtgaatgtctatcgattcatcaaatccctaaatgggttatcatctctgcaaagctttctcttctccagacagttatttcctctgtacccatgttcccacattacttgccactaaactttctcattgtttttgttgcactgtattgtcattattttttggtaagactgccttcttcactagactgaaaagatcctacagggcagggcattgtgtcatccctggtgcctgggacgctgcatgtattatcaggaagggatctgaagcatcaaattcagctggaatgagcacacattccaaattcacaggattacctgattgagctttttgtgtggctttattattagcatgttgatattatcggtgttggcgccaagtcctatttcactattttagacccaataaatatgtttggtgttggtgttcccaaactctttcttttccctgagcctgttgcctatatatgtgttgagtttaaaaggtgtttactgaaaaagtagttataataagctaatcataatagctatggtttggggtaatgtattgtgctaaatgctttatatacatgtccacatttagtcttcataataaacctaataggtagatattataatattgaccccaaggcagtaaaggctttaccttggaccaaattattattgtgccatttcaacagatacccaaaagacagtttatttggtatttactgtactctccactccacctctgattcacaaattattaaaaatataacacccatattctgtcaaaagaggggaaataaatggcaatagtttaaaaaataagctcagctttgaaccatagctccttccaacaggggccctagattacactcctgctgtattagtacttactttttaaatgtaggtgggcattcctttctggtgctggtaaattggagaaacaagtgggtggaattcacatttctccccagttgggatctagagtctgattgttagtgatactcagagctcttcagggtgctgcctccagagtgagcagtctcctgggtgagcttcaaataacagaacagccagatgacccatcacaaacgcaccaggcctctggcccaagggtgcttatagaaaagtaccctaaataaaattaaaaaaaaaaagaaaagtccaggttaggacattgtatatgttagaatttggtagaatggatatgaactaagtaactgaattaaagaatgtgaatccttttcttttgatgccaaatgtcatatctcctccactaaaattgttattccttcagagttacagcatgttatttgtaaaaactgctaatttgaaattgtgctttgttatagtgcatctacacacaggttagtaaggcagtcactagacattattaaaaaggggtacagaaattctgtggctctgtgcctccagattctacctgattgatacttcactaccaatgcccaaaggcaaaacacaggccattcaaaaagtgttttttactttattccttacctctagcagtgggtttatctagggctgagaagccttaaggtaaagtcgcccttgggcagcattgtcttgttatgcagtgattctcaacccttgttgcatatgggacatagtggggaattttcagaactacagaaaacctgggtatatctctagaataattaaatcataatctctggggagggagtgccattttttatgtttttaaacagattctcatgtgcagccaaggttaagacccacctgtctgacaggaactggtttatgtaaacaatgccaacaaaaataggcatgcctatttatttcagtctattaccttgccatttccaccatttttttcttttattagttaaggcaatatgaatttcacaaccacaactactaccaccaccaatttgaatttcacaaccacagctaccaccaccaccactattatatattaggctccagtggtgcaactaggtattaatatatatcttaagagagaacaacacttcaagaatactattatgagaacccccaataatgaggaaattgaaactcagagaagtaatgatctcacagctactatgcaatggaatagagacctcaaagcctgaatcccccacttacgatccttagcagttataggttcctttgaggttggggacctagcttagaagttgttggatttcccttagccttaaactactcagaaatatttgaagatactcttcaattttttattcatctggatagaatgtactgttcttccacgtagctctccttcaatcatgctgatcccactgcttatatcctcaaccattccctatttcccatctctctcatggagccataatgctttctacttgattgcaagagtggccctttaacactagccccatacttttgattttattttggtatctttcagttttgcacctacctcctaacatatgctaattaccctgaagttatgtcatggccaagcatcagtgattttgtttccctgcaatgaagcaagaagagtgccgacattagagtcaggagatacctgtttcagtcctgattctactgtttactggccaggtgtccttgagatattactcgagatctttgagcctgtgcccttactggtaaaactgatctgtaaaatggatcagaatacctacttttctggagatatatgcattaagttttctggtatatggcctgattcatagactctaggtaagtatgtagtatcttttttctctctttctgacctcttacatctctgtatgagaagttatacttaaccagcacaatgattgctactaagatgttgcatcaccactgacatttgtctagtgatcacttatttccctagaggagatttgaattcaatttaaaaaaatacagtgcatgcagacctaggcgttatgtgtctgtccagtaaaagactggggcagtgtggacagtagaactcagagattaaggcaactggtggggttttgtgttaaaagcaattttagattattggctgagaaatactcctggtgtgcctgcattcttcaatattgccttctttagatactaccaattagcaaataaaccagactctcctgcaaaatacttcattactttttctctacgttttctctgtgaccatatttctggctgtgtttacttactgggtgactttctgtaattgggttcaaacagttcagcaaacatactagtccccatgcacacacaagcctaatctctaagtaaccagtgtggctcttagatggacgtatggccaggagatttactgatactgaagaaattaaagtcgtcatgattatttttctgtactttattttctggagagcaaaaaagcaaaactattcacatgttgctaaaatctagcttgtaatcttcaggtctaagaagtacatgtagcaacaatgctctatgagtaaaaataagactcttttctaaaggggattattttaatgagggctacttccatggggagatgctggaattccaggttccagaattcagctctgcttcctaagggatgatcttgatagaccaaggaaaggacaccacagagtccagactccttcttaaattggaaaaagtgtatatcattgcatcaaagggaggtgagatgttgacataagacttgtgccaaaatggaactgaaagcaggagagatcaccgtcttaaaattctctgctctaggattttcttaaaaataaagagaaaaaatagatgaacaaataccaataagcatttgttgaatatccactgcatcaactataagaataaaaagttgcaagtaattaacctttctagatctcagctttaactataagatggaaatgatgaacacggtctacttcaaaatgttatgttgaggatatgacgaaataatggttataatagttgctggcacattaatgcttcataagtgtaggcccccttcatcctattacttttgcttttaacacagttccaacaagttttataatttagatgatcagcccgtaaccctccatcccttcagcttgatagaagtacaaagagaaggctagggaaataagtaatagctgaaacagtgtcgtgatacagaggagaaaagaaacgctaaaaccctttataatatgtaaatgtacatgctcaagatatagagctcttgaatatttaatgaaataaatgaaaataaaccattatagtctgtgcagacatcactgtaatgtaatttattacaataagagatgtttgttatgaatgatcccagtgagcaaatccacatttatgactagtaaaatgataactactactacatgttaaggattatcatgtattatttaattttcatatgtgtacttcaaagtatgtattaccactttattttattattattattattgttattttgagatgaagtctcactctgtcacccaggctggagtgcagtggcgccatcttggctcactgcaacctctgcctcctggactcaagcgattctcctgcctcagcctcccgtgtagctgggattacaggtgactgccaccacaccaactaatttttttgtatttcagcatgttagccaggttggtcttgatctcctgacttcgtgatactcccgccttggcctcccaaagtgctgggattacaggcttgagccaccgtgcccggactaatatcaccactttatatgtgaagaaacggaggctcatagttgttaaggaactttttaaggttacaaagggattagctaggacaattttaaactatttggaaaattaatttattggaaactcctcttttttatgtcccagaaaaaaaaataagttataaaatattaagctaagttttagatccagttaggtataaacattttcagagaagagagtgaacaagttgccttctaagaatagagttcatcaaggaaataggcttggggttggaatctcggtagatgttaaagaaaagagagcatgttagttgggtaaacgtctgtggacaattgcacgaaggtggagttagattcatgtgggtgctggcttcgaactgtacagatttgatacctgtctcaaactgtgcttccaaataatgatttgtgaattaacaaataaatatctctcttatttttttttggtaccaagttgtatgctaagcattgtgatacttcactagacctatactttcaatgagttttatattttcatatttccaagtgtcttaataaagtttacttctctttttgtttgatctttctgtcttccatccatgacaagctgccatattggttttgttaaattgccagctctcagtgaaatccatagtcactgtgctataatgatattttgtaaagcactgtttcttccttaatagtggtatgttggagagaaactttccttcatttctaggatcttacttctgttgtggattctgcctaataaattcttatttaagtcagtgaacagggtaattgcccccaagcctcagaggctattaacaaggataagaagatacaaggaatatgtaagtttaagaccactatcagagatgggagacctagtcagaggtaccaaattatatagtcatttagactatttttttctacaaattctactgagaagagtatttattatgtgaaaaaaatcttaacaatatattaaatgtgaaagcagattaaaaataagaagtagaatctgatagtactttttgcagaaaaaaatatatacacatagaaaaagtctaggaagacaataaaaaatattaaaaattgtcatctctaacaatggagatatgagtaatttttctctttgcttatgtgaattttctaacttttctacaatgaatatgataattacaacaatcctagtaatgacatccaactcttattgagtgtacactattgagctaagtacataggctctgctctggggttgaaccacgtgaacttggatcctgggttctcttttattagctgtgttaagaagtaggccagatacctcatatgtatgacctcacaacatctctatggggtagatactgcatctacccgtagcccataacgtaattttatacattaaaaaactgaagcttgtagagttgaataaacttacccatgttcacatagaatgtgcacatataaaacacataataaaagtgaaagttatcctgataaagaatgtcagactcaatcatgttaattacaataaaatctcacaaatgaaattctgtcaagattatacatacatatatgcatatatttgtgtagtgtgtatataggagtgagggaagagggagagaaggcatccccttggattgagtttagaaattgataggtatgaggataagagcaagaatactcaatttgtagagattccactcagcaaattcatcaagcttatctttttctcctctgtttctgctatagtcagccatgttctgcatcccttgaacccagaagaggtacatagccacagacctactttagagtgggaagactggctgttttcctagacttggctcccggggagccatgctggccatttaatgtggttgctggcttgtggcttagtactagagatgatggcccaccagaggaagagagcttgtgagagccaagaaaatgggtcaaacataggaagccaggaaaggaagttaatccatgtgactagcatgaggctctgtggtcttggtaaagggaatctctaagtgaggccaaactgtgagttggaagtaagggaggaatactttatgagtcaatagtcattccctgagtaggagctcttttatggcatgacaagcaaacatgaagttctgtgagcattgaaaatggttgggaggaacagaattaaatcaagtccaaaagacactgggcttgcagtagaagattggggaacagggagagatgaagctagagaaattaaatagttatccattaggaagctataacagctatcctccagttgtgatagcatttaaccagattatttattttctctggttttactttttaacatctcctaatttatgttggggaatttgaattacccattaggcaaactaagcgtgcactcagagaagtggcaaagcatgggcccccccaaaatgagaaaagttcctattggtaaatacatcaaaatttcacaatcagaaaaatcttgaaagaagctatttgaattgctacatgaatatggatatgcatgttatgctgtgaattaaaataataaaaatttatgttgaattatattggtggggctagtatcttttcaggggttgaggtgattaaatttcttaatccagccctgtaaataccatagactgaaagtcattttcatcataatcatcatcgatattaccctaaaatttgagcccttgcaatgtactagataggcatggtgccaagttcatgacaatcattacctaatttaattcttacaactatcctaagaggtaaacatcattatcctcatatcacagatgaagttagatgaggctgaaagaggttaagtgacttgcctgaggtcccacagctgattgatgatgcagctgagatgcaaatcaatttctccttcctcagagcttttgtgtactccatgagtgaaaaaggtgatattgctagcagtgtaggtagtaatgacataaaacacccgtaaactgttggaaaacgtaaatcatcagcatgtatatattactttacaagggtcacctcagttttgatgtctgatccagaattccttggagatcaatcagtattgtcaacctacttgctcaaatattgtagcagttcccacttggggcatgaccttactatcaaaatcagagagtcgttgtgttttgtttttaagattatcctccagcacaatgttgttaccagtgccagcaatggtataaacttctttgtattacttctgaagccatgttaaaatggttgtctaccttttcctccctccctcccttcctccctctgttccttcattccttcccttccttcattccttcccttccttcattcctttcctttcccttcccttccccttccttcctttttttttttttttttttgctttctttattgcttgctttcttgctttattcttttttgtagtaaaggactttaattaaaatataaggatttgacttagttctggatggcatcagtttttaaatagtattaaatcatatatttttgaggctgcaaattttagctatttgcattttggaatgtatttcttcctgtagagctgtatatattacaggttgtaaattaatttaacatattctgattttatttgccaagttgatctagagtggaatagattttactttcatagacatcagctttctcagccgaaatgtcactttctcaaggaacccatccctaaaacctctcttatatacccccatagcctctaacacttcccttttattcatgctatcaaagttgtagttaaattattatctctgaggttatttattcaaggtcgttcccattagtctgaaatcaccatcagggcagggacaatatctagctgatacaatgctgtaaactgaggccttttgaaggcaaagcactggattatagtaggtatgcaattaatatttgttgaacaaatgaatacacccaaattgttttcctatatttagttcttagctttatgaacagacaggtttcaactttgcgtagtttgctacctttgagaattgaaaatgccaaaaagtgacattacctttcaaagctaatggagaccctgagaaaacttgtaatatgtcacttgaaactcagaaaagtggttaaacaaacacctctatatctgctagtgggtaaggatggcaattaagtaacttgaaagaattagcaaaatgcacaggagtgtcccctaaaacctccaaacttgcatggtccctcatacaggccagacctcagaagttctgggatgtatttctggaaaaagatgagcattagtttcataaaactcaaatatttcaacattttgacaatagctttcctttatcctgactgcatttgattgcaggagactgaaacataagattggcatactcttataaaagaaggtttttgagaataattctcattttgaatgttgatttaatgaaggtcttagagtttgttgctctgataaattctgcttaatatttgcatattatgaggatgtgcccagcctacagcatatgtagaagtgtctctcccctctacaggcaggccctatagtttggtagcagatacctcaccctctggcctaccacctctgacacatgacactcacgtcttcaacttagtttcatttcttcgaaccctactattttttcaaaaagtgtcattgtatttgtgacaataatattctcaggcacttgtaagcattaaataatttgtctaagaccttatatccttagaataaattaattcccagtatgagtgatactaggattaaaggagatctgaacactttggagtcatagaactgattttcagagaactgaaatgtaaaactgaacatagactttatcatcactatggctgtcttttttttggccagagacaaagctgttttattgtgaatactgttcttctgtggatttcttcattcgcagttaaggagcttggctttaagaaaaaagtgtaaacagctttttaaattttctgtaatttgaatgtacctggcagcttcaaaagttattgcagactagaattgattgctttagattgcttttgaaaaggggccagctcttttctgatccagtagaagcatacagcagagatcagtaatgtaacaaaaaagaaactgtggattgaatgccaaatcagtcatggaccaaacccaatggttgacgtggtcctagatcgtaagagcacatattttagtcagaacctaatttaaagcaaaagcagttgtatttttacttgttagggagctatttggaatgcagatgtttaacagcacaatttcattttcagaaacatttctctttgtttggtgccatcaaaatttagcaacgcaatttccaaaagacctttcattggaccaaggcagcagaggactatcagtcctttcaatttatccttatagcactctttataaagcaacagggactttgcatgtgaacagcaaaaaggcaatggatagggaaagtcatgaggatgtctgaaaagtgggctagaacatgagtggtaggtataaatgacatccaggtgtataaagctcctactcatccactcaactgaattctactgggtctcaacaagagtctgtattgtagctgtgtaattgagacttattgaatactccctcttgaatggcctgggtgctttctggaactgaaaggggggctgcctgccatggcacagtaaccataccagtggagaaggatatgggcattgcatcaaggtcctctttaggttgtgttgactttaatttgttccaagtggaacgaggtgctgtttctgatgtgctgcctacctcatagacaaagaccacctaatagattggatgcaaataggcagtaagttttcccattgccctataaacttcctacacattagctgtttaaagaaggacaagcggccaggcgcggtggctcacgcctttaatcccagcactttgggatgccggggttacagtgagccgagattgtgccactgcactccagcctgagcaacagagcgagactgtctcaaaaaaaaaaaaaaaaaaaaaagccaggcgcggtggctcacacctgtaatcccagcactttgggaggctgaggcggttggatcacgaggtcaggagatggagaccatcctggctaacacggtgaaaccccgtctctactaaaagtacaaaaattagccgggcgtggtggcgggcgcctgtagtcccagctactctagaggctgaggcaggagaatggcgtgaacccgggaggcggagcttgcagtgagccaagatcgcgccactgcattccagcctgggcgatagagcgagactctgtctcagaaaaagaaaaaaaaaaaaaaaaaggacaagcaaagcggttgtcttcaattggaagttgtagacaagagaggaaaaaatatcagataattgattttcagcttttctttactaacggatgattgtttaggaaattgcacataaagtgatgcataccctttgctgtacaaattacaccaaaggaacatattctgaggatgaaataaatgacctttctgcagaaaagaaaatattttattgttggttgtgtcctaataaatttgcaccaggtgaaacctctcagatgtgtttttcagtgtcagttcctgggctccgacttggatgtctcggacccaacaccaatttttcagaaaccaattcacaggtagtttgcaatttatgttttattggcttatgcgtgagatctgaaataaagaagatttctttgaaaggtctcacgaaggcactttggcacttgagtgtataataccacatttcatttagcccagcaggcctaaatgaatactcactatcagatggtgaaaaactccaccccgatgtaattgacaactgcatttctgcttggccttctcaccaacatggggattttataaaattagaatttgtttcccaccaccacccacccggccgccccacctctcccactgcccacctcccctgccgacccacctcctccatcaagtttgactcagagattaatatttaaagtacttacatcaccaaaagaaaggtagaagtttcatttgtattacttttatttatttatttattttttttttttttttttttgagataagtaacatggtgaagtgggaagcatcaggatttggaatctgactgacctaaatttgaattgcagctttgctatttaatagctgcatgaccttgagcaattacttagtttctctgaacctcaatttctttaccccagaaatgggaataataacattgggactttcaggactattacaaaaattacttctaattctgtaagtttcttggcacattaatagtagatgatcaataaatggtagctccagctgctatgattgaagctgttccacagccagaagaaatggagtatacataaattcaaacctcttgcttgtggctgcaagaaactgcagatgcttctggacttgtatgagaaaatataattaaggcaaaaattttatattcatttaagcctttcaagtttagaaaaccatttccatcagacctctcaaaatcgtgatcagtcctttccttaggatctgtaaataagaacagagaaggcaaatgcaaattttgtgctgacaccaaacttaaaaacctatgttctaggttcactaaatgcacctcaacttttgcccagtttttgatggcaaagagagtgacaagatgtcatatattcatacctagaaatgaaataaggggaatgtactgagcaggaaagcaggatgaaatagtgtaaaaatctgggactgaacactgaggtttgaattctggtttcaacaatatcacttaccagctgtttgaccttagacacattgtttcatggtaatggaccttagttttctcccctgctctgcctaccatatggggctattgtgaagatgtagagaaatgaaggctataacagtattttcaaaaaaccaaagtcttacacaaaaatgagatgtcattttgcacaggttttcctgtatggctccaatgttatatggaccttaatttattcctggtgtcactcctgctaatgctgtgaccatgggaaaactacagaatctttctaaacctatttctatatcttaaattgtcacctcaatgtttactatatatggttactgggataaaatgagtacatatgcttgagacactttgtaagtagtcaatatactgtagatatgttggtgatggtggtgatcttatttagcaactagcccagaagcagaaagccttgcccaaaatataatttgagaaaataagtttaggaccaatatggaatcctgacattcagttgaaataaactgacctttattgagtctctgttcataagcactacagaatttttaaatgtcagcctctggaaattacaatggaaatagggagagggatgacaatagacagacaggtaaatgcataaatagacattgttgagcataattatgtgccaggtaatgtgctaagtacttcacagaaatgagcttatgttattttcacaacaattctatgagattggtgtgaaagcttattttataaatgaggaaacagaggcacagagaggttaagtgacttgcccaagttcatagctaataatggtcagagttggtttgggaacccagaagttttactctgaagttcataccttgtccattatgaccaggaaaaatgaggtgcgtaaatgttatacaaagctttatcacattatacacaaacatagaaaacagtgtttcagaagagaagcaaaggccattggccttcaaatatttatgcaacaatgaaaatgttctcagcccttaaatgagcacttgtgacttgtccaaagtgagataactagtcaatggaagagttcaaactagagcatgtatcttagtctgttctcatattgctataaaggactgcctaagactgggtaatttataaaggaaacaagcttaattgactcacagttctgtatggctggggaggcctcagtaaactgataatcatggcagaagaggaagcaagcattcccttcttcacatggcagcaggagagaggaatgctaagcaaagtgggaaactcctttataaaactatcagatctcatgagaactcacacactatcacagggacagtatgaaagtagctgcccccatgattcagttaccccccaccaggtccctcccacgacatgtgaggattatgggaactacaattcaagatgagatttggtggagacatagccaaaccatatcagcatgtttcctaaaccaaagtcccacattttccaagttcaattcaagtatttactgagaaataataattatattgtgaaataatgggaaagaaagagtgagtttacaaataaaggatagttcttgcctttgaagagcttacgatctagtaataagaaggacagttgtgcccacatgtaattatataactcaccttaatgggacaagttcaatagcaagggatatcctgcatgttgtttctgtacatctcaatttaatcactgagcacacttgtttattcaaagtctttctgccctgcaagaattctacctggtctaaagttcactacatcatccttagcatagttcctgatagaaactaggcactcagtaaacatatattgaataaaatgcataaatacaaaagcaaaatgatataagcccagaggagaagatggttaattaaatgtgaattggaaatgtactggctaaagcacagccagctaggataaactttaccaaaatgttaggtctctaaggaaaagagatcatttagatgaaagaggacctgtaatttatattagtccataccctgcctttaggccaatttgtagatgaattacactggcaagtcagactctggtttatttttaacccagacttttttttttaaccgtttgataaatttagaaaatatctattacaagttattcatttgaaaaataagaacttgcaaaatttaaactgaagaaaaactgattccattttatgattgcattacaaattctggttatgacagctccaaaagccaggcactctacttcaaggaggcctcagtggtgtgtccaagactgtcccagagtaaaagaaatgtccatttatatttacttgattttggttttgtgtattaaaccctactatgtgttttaattatctttttaaagagatgtatttcctcagtttgtgaccattccctccttcctttcctttcttcttcttgcccacccttccttccttccttccttctagcttccttccaacttccttccttcctcctttttttcctcttcacttccccccttgcttttttcagttatgactcattaccataatgttatttttacccatatcattattcatacattttctccctcataaaacagtgcagtgggcaagggatagcacatgctatgccctttctagggcctccacactctcctacactaccttttctgcttttggcaaccaggaaagagtcagtagaggatctagaacgggaagagttgggggaagagacacttggaaacaatacacccaggatgttacacgtattagtctcccaaaagtctaatcaaaagccatcctatcatttaaatcaatacaattgaataaattaactttcaagatgatgcaagctttggacaagagcatatttatgcctcattcacaaagctcagggtttagtactacagttactgtgttaagaactaaggaacttaaaagacaaaagtataaaaataaccataagtaaaaaataagttaatggacacataatataaaaagacgtaatttgtaaaatcaaaaacataaagttcttatgtggggggaagagtaaaagagtagagtatttgtatgcaattgaagttaagttattatcagcttaaaatagattattataactgcaagatgtcttatgtaagcttcatggtaaccacaaaactatagctatagaagatatgcaaaagaaaatgagaaagaaatcaaaagcaacaagagagaaaaacagggacaaaaaagattcaaaacagaaaactattaacaaaatggctataataagtccttccttatcaatatataattactttaaatgtaaatggattaaactttgcaatcaaaagatagaatagctaagtggattttaaaaataagattctcagctgggcacggtgtctcacaactgcaatcccagcactttgggaggccaaggcgggtggatcacatgaagtcaggagttcgagacctgcctggccaacatggtgaaacctgtctctacttaaaatacaaaaattagccgggcatggtggtgtgtgcctgtaatccctgctaccaggaggcagaggttgaagtgagccgagattgcaccaccgcactccagtctgggtgacagagagagactccatctcaaaaaaaaaaaaaaaaaaaaaagattctcattatatgttgtctataagacttacattaacttagtgacatacattggctgaaagtctgaaagtgaaaggatagaaaaatataatccaggaaaatggtaataaactataggtaaaaaatgttaaaaaatataaagaaggatattatataatgatagaagggtcaattcaggaaaatataacagtgttaaatatatattcacctaacatcagagcacccaaatatataaaacagacattgatagaattaaagaaaaatacagagcaagtcaatattattaggggattgtaatactcttctttcaataatggacagagtatccagacagaggattgataaggaaacagaggacttgaatgacattatagatgaaaaggacctaacatatacagaacatgccagctaacagcaggagaatatgcattattctgaagcgcacatggaacattttccaggatagatgacatattaggtctcaaaacaactcttaaccaatttaagaagatggaatcatgccaaatatattttccaactacaatgaaataaaactagaaattaatggctgaagagaaattggaaaatttacacatgaggaaattaaacaactcactcttaaccaataggtcaaagaagaaatcaaaacggaaatcagaaaatgtcttgagacaaatggaaataaaagcacagcataccaaaacttatgggataccataaaaacagtactaaaagtaaagtttgtattaatatacacttccatttaaaaggaagaaagatctcaaataaacaacctaattctacatttcaagaaactggaaaaaggaagacaaactaagcacaaagttagcagaaggaagaaaataattagagaaaaaaataaagaataaaattaaaagaaaaaaatcattgaaactaagagttacatattttaaaacatcaacaaaattggtaaagctttagctagattaaccaataaaaaaagagaaggctcaaatagctaaaattttttaaaatgaaagaagttatgttactactggttatatggaaataaaaaggactataagaatactgggaacacttgtatgaaaagttagacaacctagatgaaatgaacaaattcctagaaacatataaccttccaaaactgaatcataaataaaaaatttatatagacctataaacaataagcagattaaattagtaatcaaaagcttccccacaaaggaaagcctaggaccagattgcttcactggtaaattctaccaaacacttaaagaataattaatggcaatctttctcaaactcttccaaaatattgaagaggaaggaacaattcaaaactcattttataaggctagcattaccctgatgctaaagctagaaaaaaaatcacagaaatactactgcacaccaatatcgtcaatgaatatagatgcaaaaattctcaacaaaataatagcaaatgaaatttaacagcacattgaaaagatcatataccatggccaaatggaatttatttctgagatgcaagaatggttcaacatacgaaatttaatcaattggataaatcacattaaaagaatgaaatataaaaataatgcaattatatcaatagatgcagaaaaagcagttgacaaaattgacacatttatttcatttcaaaaaaataagtgggagttgaacaaagagaacacatggacacagaaaggggaacatcacataccagggcctattggagggtgagggggttgggggaggaatagcattagagaaatacctaatgtaaatgacgagttgatgggtgcagcaaaccaacatggcacacgtatacctatgtaaaaaaccttcaccttgtgcacatgtgccctagaacttaaagtataataattaaatttaaaaaaaacctcaacaaattaggaatagaagaaaattaccttacaatataaaaatcagatatgaaaagtcctaagctaaacaccatactcaatggtgaaaaactgaaagcttttcctctaaaattaggaacaaggatgttcactctcaccattctactcaacatagtactggaagtaacagccagagtaggtaggcaagaaaaagaaaagaaacctcaattggaaaggaagaagtaaaattatatttgttcacagataatatgatcttataggtagaaaattctgaagattgcacacacaaaaaatctggaacttaatttaaaaattcaacaaaattataggatacaaaatcaatatacaaaaattagttgtgtttctatacactaacagtaaaatatatgaaaggaaattaagaaagcaatcccatttacaatactatcaaaaagaataaaatattgaggaacacacttaacagaagaatgatttgttcactaaaaactaccaaatattgctgaaaggaattaaagacacaaataaatgtaaatgtgcatggattgaaagataatattgttaaaatgtccatattactcaaagtaagttacacattcaatgtaaccactatcaaaatctcgatggtatttgttacaggaaaatttaaaaaaaatcatatggaaccacaaaggaccccaaatagccaaaacaatcatgagaaagaagagtaaatctgaaaacttgatacctcctgatttaaaaatatattacaaagctacagtaatcaagacactatggcactaagctggacatacaaattaatgaaacagaatagagagcccagaaataaacccacacagataaaaatcaaatgatcttttacagaggtgccaagactacacatggggaaagaagagtctcttttaacaaataatgttgggaaacagaataatcatatgcaaaagaattaaattatcttataccacccacaaaaatcaactcaaaataaactaaagacctgaagataagacctaaaactataaaactcctggataaaaatataaagaaaatcctatacaacactggtctttactgcgatttcttggatatgacaacaaatgcacaggaaacagaaacaaaaatagacaagtggtactacctcagactaaaacacttctacagagcaaaagaaacgataaagagagtgaaaaggtaacctacacaatgggataaaatatttgcgaagtatatacttgataagggcttaatatccaaaatagataaggtactcctacaactcaatagccaaaaaacaaataatctgattaaaaatgggaaaggacctgaatgatatttttccaaagaagatacacaaatagccatttggtatatgaaaaaatgctcaacctcactaatcgtcttggaaacgtgaatttaaatcacaatgaggtatcacctcacacctgttagaatggccattatcaaaaaaaaaaaaaaaaaaaaggaaaaaagaaagcaaaaaaaatgttgttgaggatgtggagaaattggaagtcctgtgcattgttttggggaatgtaaaatggtacggttgctatgggaaacagtatgcaggttcccaaaaaatgaaaaatagagctaccatataattcaacaataccacttttgagtgtttattcaaaagaattgaaatcaagatctgaaatatagatttgtactctcatgttcattgagcattattcacaatagccaagaggtagaaacaacctaaatgtccattgatgaatgaatggataaacaaaatatgctatatacatacaacagaatattattcaaccataaaaaagaaggaaatcctatcatatgctacaacaagggtgaatcctaaagacaatatgctaagtggaatagtctatagaaggacaaatatggtattatgctgcttataagaagtatctgaactagtcaaactcaaagaaatagaaagtggaatggtggttgttaggggctgggggaggaggaaatggggttttgttgttcaatgggtgtagacttttaatcatgcatggtgaaaaagtggtagagatctgctttacaaccttgtgcttatagttaaaagcactatattggacacttaaaaatttaagagagtagatcttatgttttgtgttttttaccacaacttaaaaaaaaaactaaagaaaatacttgctatggataataattctgtttaatattttttaaatttgtgacttgattgcgagggaattagaggagatatttacatgccttcatattctttgaagcacacttttattatcttctgaaattatcggctgggcgtggtggctcactcctgtaatctcagcactttgggaggccaagacaggtagatcacttgagatcaggagttcgagaccagcctggccaacatggtgaaaccctgtctctgctacaaatacacaaattagctgggtgtagtggtgcatgcctgtaattccagctactcgggatgctgaggcaagagaattgccagaacctgggatgtggaggttgcagtgagctgagattttgccactgtactccagcctgggcaacagaataagactgtctcaaaaaaaaaaaaattcttgtgaaattattatgacttttggcttatattattttaaaattaatatgactttggagtttaggattctcttcatgttttaccactaactggcttttgacttagggaactgctccctcttttgtactatctagctataaagggagaactcttgaaaaagcttgagagaaatgcacagctgccaggaagtgcagcttttatgaattaatatcttgctaaaataaacagaagctgcttcagcttcagtgctaagaccactaggaaatttctttgaaaaatgagttcatacacttatgccactaatccatactaaatgttccactaaagtgctgactgtaggaacacattgccattttgtttttaaaatcaaaatgcttatttattgattttacactgagaagtagaacacagaccagaatacctatattgatgtgatcattgaaagatacttttgtcttcttccatgtttgatttatttcaattagggttaaacactttgtgctgagttcaaaggatgcagttgcaaataagagagctctttcattgccctactagcaaccacttactttctgtttggggaaaagggtacaaactaagttatagtgtaattcttgttttaaatacaattttgttaagtgttgtaatagagaagcacaggtgctaaatgagtgtttaatggaaagatgacatgagctatcttagaaggtgacccggtattcagggaatgctttcttgaggaggtgatgatatgcaagttgaactccaaaggacagggaagacaccagaatttctgagtaaaagagatctggatggcaatctggttggaagtaaagactagaagctttattttggagctgtgttgcatagtaatcccacttctttttagattatactgtatgtttatttacggtggctttgggggagttgcctcttgatgcagcctacagaagggtgagtaggaattaattatgtgaaagtatgaagtggggaaaagaacatcctccatggccacaaggtaggattgagctcaagtattcaaggcctgtatggttggaggacagagcaagagtgtgaggcacagacaagactggtaaaaagccacagaggccagatcacatgggtcatgattaaagaccatccaaactactttaaagattatagtatcaatgaggataaagagtcccagaaaatgacgtttaactgacaggtatcaagcataaaggacctgatcataattgcattttaggaattactctgggtgctgtgtgagagagaattagagcaagggtgtatgcgagagaccagttagaaagctgtttcaccagttctacacagaaatgatgctgggttagacatcacagtggtcatcatggtgattgaaagaaatagataaatgttaaagatatttacacagacaagtatacaaatactgtagagcatgacttaatttgccaaggggatctgaaaagcttacagaagtgacattagtttaatcttgaaggatgagaacaaatttctggtagaagtatagtttagcacttagattcaattgcaaaaatatgcaaattttaagtgattattacctttttactagtgtttctttcagaatctttaagaaatattacataattaatgttctgatttctgtatttgtgatactaagtaccttagaatataatacatttacatttcctgaatacaattttataatttagacttgtaattaattcagattaaccccttccccatcaacactcacccaaatccaactatgctagttacaattcgggacattttaaaagttttttctaccttctattaaatcctctgttttggttaaatctttgcatcaattaagcatgttttcttccacactaaattcctgcttgtttttgtctcacaaaagttatgactaaattagtttaaatattttggaaataattttagagcctaaaatactttacgtattcctggctttcttattttgaaggaaatgtgcttggatctggagattatctaggccaaaggttattagatgtaaaagaatgcggatttcttagcatttataaatctctagtttttgcaatcataggaatagactgtacacacttttcaaagcattttatgattatttggcgtattacttgtggctgataaggatgtctgtcaccagtcactctttagcaatcacttagctctccttttattattaatattttcatttcccatatgcataattttatctggaaaaagattctgtatcaagttttagtgcagtacaatatatttatccatttttgctattttttattaaatcaagctaggatattagtcttaaacgcttgctttgaaactagtgattgttctatgaagccagtgccaggtcaaagagagttcaataagttatatctcatctaggcattgctctgtgcaccatctgcccatgttaaatcacagtgataagtaggatgtgtacttgtgcatcgctaattcttgtttggccagaatttcatgtcatctcatggtcattacaattgtccaattatagttgatcaaattggattaccattaattagtgagtctgtcttatagtacagagggctagttgaacatatttatctgtttaagtgggctgtcctcagaaagccaaatgtcatgtttgaaaagaaaagtcttgtttgtggggagggaaagataggagtatggaattactttacatgtactaaactgaaggagtgatttcaatatagtcttttagtaagcttaataaaagtttgctttagccttaaagatcttttaagcaaaataacattagttatacaatggatgctatttaactataaagaaatgacatgctaagttattaaaatagaaattctgtggcccttgtgatgggaagaaattgcgcattctgaacaacccattcataacagatttaagtctctgtgaagatttgtaatatcttgagtagtgtcaagccagaaaattgtttctgccttgctgcaagctgcacacaccattacaaagttgtgatggatgcacactgacttatgtctatgtagattgattcttatacttgagaggcaaatggatgagaaccggacatgtgttccctgaagatgccaatgggcccttgtgcaatgatatctgcctaaaaaactagagaagcatctatggttagataagattggagacagccaaacttatcactttccgacattctcatttgagagtgatggcattggcatattgcatcaaatcctactgtacagccatgcatcatggttataccagaaaagcctaaagttctctagggttttcttcgacccaacagttctttcaggtataatctattgatctaaaataaaaaggggggagggagggaaagagagagagagagaaataattttctcccttttcgtcactgtcttcaggtattgattttaacttcttgatcttctttaagaaggcaaaaactattaatgcctttgttatttctgcccaacagttcaagtttcatatatttttgacaaatttccttaacaagaatacctcaacaccagaactaaatttaactttaaaggaatagtttatgtttctagaacattgctgaattaaatattattattttaaaaatgtgtatcaactccttcatttctctattttttccttccatttatacttccacccaaccatccattcatccgtcaaacatatgtatgtatttactgcctgttttgtggtggacggtgtgaaaggtgcttagagaaaaatggccattaacatagaccagaacctgccctctaaacttacatatctggccattattattgaacaaacgtgttttgaataccttctgtgatgggcacaatgctaatatcagccccttgtgcagaatttggaaaagtacccttatatggagatacatggacaaagaagatcctactccttactttcaagatttttaagtctaacagtgatttatccagggagtcttagtgttcaaatgtagaacttgctatgatctcagcccttgcaataagcaccttgccagctcaggcaaaaatcaggcctatactgccccagcacctggtcaatccactgagaaggtagatttgatggcatctgatggtctacagataaagtaattatttcataggattatataatctttgttaggtactgcatggatggtaactggctgcacacttaaaccaaaattatttccttagtaatgtgtgataaggatagacattttggaaatggatgtggaaagtttcaaacagaataaaaattattaatgttatggcaattagcctttcacttcactgaaaatactatgtatggattcagcaagcatgctaaaatttaacacaaaaatcctctttggaaggcaattgctttaagttagaaaaaattagctcatttttcagtgaaagaatttgaaaattctgtctttggaaaccaaaatactgtatggcagagttggatgcatctttcactttaaaacgcagactctatttgtggtgaatgtatttgttatggtaaagtatttgaaaggaaaccctcagaataatttggggtaaggaaaaatactgttttaaaataagcccaacccatcagttttaaaccttgaaaactgccttgctttgaataagaaagaattaataatcgtgtatagcataaagaatatatgtttggactaaaatgcataatcgtgatttaaaacaaacttccaaattttaagagactctagtataatggtgtgacctcaatgatttttccaaatgaatttatgttcttcagagttaatattgatgatcttatatagttacttcatgactgggtctgtgtcttggcaaatctctctctagataagtgattcttataaatgttgaaaattcctttacaggttaactttcccatcattttttattgcttatgctataaagtttaagcctagatgcatcctttctggaaagaagggtcctactaatctcataagaatctcataataagttctctttcttaaggtttgtattttgtgtggggatcggcaaggaaagggaaaagccggaatgccaaacagcaaagagttattctttactgtagggctccatccaaaaagggtttgtaacacagtgtacagtcttgtagcccagctgtgtggagcattgattgcttctgcctagagcagggatactgtcaagttgctctgtgagttgagtcatctattgacaaagagctaccagcccgcagataatgctgtgcggagctgctgtcgctgctcccactgctcccacgatgcactgcttatagcagctgtcaaagatactgaggaatccacggtggaaaaaagacttttacaactggctggaagaaaggggtgtgagggaggagacatttctgtgcagagctgaccaaaggaaagagtaggcatcagtgcagtatgaatgcatacctcaccaagcaacacagctgcagccgggggtccgatgggatggatgccgtcaggagtgcgcccaccctgatcagggatgcccactgtgcttgtggctggcagaggaactgtcaggggctcgggtacagttctcagaccatgccctcctcaggaccagggggcccagcttcaaacaggaccggggggtccagcttcaacaggaccttgtgggacagtgtgcggaaaagcccccacaagacgagcaccaagggcaaagggacttgtggggagcattgtacctgcccacatggttggttcagcccagcacaggtgagccttttccttatgactttcccttgagtgtctgaagaaagtgagagcaagttgtttaaggttagaatggcttggaaactttgcagagtaccacgggtatgcctgtatgtaaaatattaggccaagaaaaacctgtcattttcacacatgtttgtgggctcatacctctggtggcctgtgaaagtctagggatgccgtgctcagtttatttcactgacttttcttcaacttctctagtcctcaggttatattattttttatcatagtcttttagcagcccttttacttctaatcatttttaacttttgttctgtcctgcctgtttattattatttttttaaagagcagagaaaaaataaattttaactaaactttccatctctttaaaggcaaaagaacatttgtttctttagctatagaaaacagtgatttgaagtatgctattctaattttactcttataatactgtatgccttttcagttatggagaagaacaattatttacactaaataattaattttacaaagaaaaggaataattatgagcaaaacagaggatggttaaactcagaataaaagaattaagcacttaatttattcatggagaagcaataagtttatatcaacatctatagctctctttcttctataacgcatttctaaagcagatgtgcagatacctttaatttgattcctaggttattctagcccccagactactatcattttatcagaaataaaattggctcatttttttctctcttcatttaaaggagagaaaataacttcctgcaaatgctgtaaaatataaataaaatacacctgtagtcactgtcatacagaacaatgactgtttaatatgtattgaagaaaagctgtatttgcagaaaaattcaatctcaattttaatatgattttagcatagtggagaagtagatattgatcataaataaaatgttatggtgacaggtgcagagaatattttaattttaataatagtttttaaaaagtacttccaagaatgtcatttatcactggtcttaataatatagttacatatgcatagccatatatatggcctttgattgatttgcatggaattataagctttgcttagagagatagagcatctcagcctcctgatttaaataaaaaatacattaccattttattattaaactggtttggcttaaaatagaagttgacatttagaaatgcagttattatttaaagttaacatgaattccaaactgaataaaaagtcttaacagttgtgaacactgtatatactctttaacaaatacattcatttaaatgtctttagcttatatctctgtattgattacattaaattctcaaggctcacataggctaggaagcaagcctacttaatagcatctagcttatggttgttgcacagagcagagaaagcaaacttgctttattgttgcaattattttaatccaagatgtaacatactttttatttcgtaaatggtaatttcccaaacccaaatctctaatactaggttataataagcaaactctaaaaatattcatattttttcatcaactgagggaaacttttatttccttagtttttaacaatgcctcctacttgtctgaaacttacagccatttaatgctttcaaggattgaaatagaccgtatactgataattagagatccagtgacatataagaaggcaacaaattgaggtagccaccatctctccttattcttttgcataagcatttctatacattttccctcccattcacatgtactgtattattggctgggactaatagtgatccacaaatactggagctatgaaaccatatcttttaggattttcaatgttttaacacttttcacttaccagaaccttccaccctttaccatttcagtcctataaaagtgctatgctaaattgattaatccatcttcaccaatgcttgaaaactttcaaatacattatgttaaataatttcaattgtctctacacatacatacacacagactttaatatatgtattcaaatgtctcactatacctaactacttatgtatattaacatattttatgtatatttaagtatatatatgcatatatatgcacacatataaaaattagagttctatattatttcaatttttctgtcctagagtatatcagcttgttcttccaaagaatgctgcattctatccatataaagtattttttcatgtaaattttatttcctttacttctagtaggtcctcaaaactactgatatatgtatatttatagatctgtttccatttatatatgcatccatagcatacatctaatatctaaattatatagagatgtgttagtactatacacttacgtatattatcacaaaaataagagcatgtgtgtacctatatgtattcatgtgtccactaaaactaaggctgttttgagaatttcatgatactactttttaccccttaaattaactgggaatatcctgtgaaatattgtaaaacctaaagctggaggctaatgatactaaacattagaatccttgataaagcgtaaagaagaatagtgcatgttttaaaatagttcagggactcacatgtggtacagaatgtgccagagagttgttaagcatctgggagcttggatcttgccctcggagatatttgcagtattacgtggaactcagcagtgtgatttccagctgctataacagagggccatagtaatgacttgagttcctcctaaggctcttttccaaactcctgttatttggggtactgtgtactaacaggactctgtcattatgttgttcctcagcaggtctgaaaatcagcttctgtccctctcaaataagttttcattccatttggatctgtagaattaatataaccataatcataggtaaggaaatagaaaattatagtgcccaaaagtgcgttccaaaatgtacatctaggatgttagtgtcagccttgggaagaaacatgtccatcattgtttatgtggcatttcttcccagtgcagactaatctagggaagcagcacagaacagtggagactcagagaccagagttttgtgcatttgtctttctttcttcctttcctttcgtatcctctttctttttctttctttctttctttctttctttctttctttctttctttctttttctctctttcctttctttttctttttccttctttccttccctccttccttccttcctttctctctctctctctctcctccctccctccctcccttccttccttcctttcttcctctctctctctgtctctctctctctttctttctttctttctttgactatcatgtactgaatgcctactatgtactattctgtcaggccttgtgtgtataatattatagtaaacaggctgagtgtggtgactcacgcctgtaatcccagcacttgggaggcagaggcaggtggatcactagaggccagaagttcaagaccagcctggccaacatagtgaaaccctgtccctactaaaaatacaaaaattagcccggcgtagtggtgcacaccatagtcccagctactcaggaggctgaggcacgagaattgcttgaacttaggaagtggaggttgcagtgagtcaaagtggtgacactgcactccagtctgagctacagagtgagacttggtctcaaaaaagaaaaaaaagaaaaaaattggccaggtgcagtgactcacgcctgtaatcccagcactttgggagctgaggcgggtggatcaggaggtcaagagattgagaccatcttggccaacatggtgaagccccgtctctactaaaaatacaaaaaaattggccgggcgtggtggcgggcacctgtagtcccagctactggggaggctgaggcaggagaatctcttgaacccaggaggtggaggttacagtgagccgagattgcaccattgcacttcagcctggtgacagagcaagactccatcttgaaaataatactactactaataataataaaaaataaaaaataaaattgtaaagaaagtagatatctctcctactactgtggagcttacagcctataatggcctataaaatttagcaaatgatatgccatgtataccatgatatacaaataattatatcatcgtaagtcacaacttagaagcgaagcaaaatttcagagagtgctgcagataaccacaatgaatgcatattcagaatacagaggaaccacagagaagttaaaaaattgaaatacttggaaaaaaatactgcatctctttaaacttttaagattttctgggttttttgttttgttttgttcgtttgtttgtgtgttttgagatgcagtctcgcactggtcctggaatgccatggtgccacctcatttcacttcaacctctgccgtccacgttcaagcaattctcctgcctcggtctcctgagtagttgggactacaggcacgcgccaccaggcctggctactttctttttttgtgtgtatttttattagagatggggtttcaccatattggccagtctggtctcaaactcctgacctgtgatctgcccgcctcagcctcccaaagtgttgggattacaagtgtgagccactgcgcccagccaagattttctgttttataaaatgaggatataaataacacctacctcagagagttgtggtgatgaatgattaacaaaatgttagcatagtgctttcatatggtagatgctcaattaatatttaaggaataaatgaatgagtaaacattggctattactaatctatttcttaatacattttttgattgggaagagaagagaaatgaatcagtgagggcttcatagaggtagtgatactttgacggaattaaattgaattaaaaatgttgtacgtgtttgttaagcagataaaaagagagaaatttttgagcagaaatgaaaaatacagaaaagcatgtaacaccttggtgcctgtgcacacagttctatttgcccggaacattgagccctgtgagagaaggttcattaaaagagatgcctggagaggagggtggggcctggtcagagatagccgggtggaccttgatgaggacttcataaagtttgagtgcctgctctgccactctttatgtgttatgcttcatcatcagttaaccctttgagcctcagtttctctgtttgtaagacagctggttttctagatgaacacccaaatctcatccagtactaatagtatgtgactgtgtcaactgacacttattaattattgggaagcactttggaaatgttttatgcttaaaagccagacaatctcaaatttgaatttactagctctgtgtgatgttatttgcttaacctctctaagcctcatttttctcctctgtaaaacttgggataataaattcatgttgcagggaaatgttataagaattgaaaatacggtatataaaaaccccagtatggcacttagaacacaattactcagtaaatggtatttattattgttaatgatatctaaagtatgttttttatcctgaagaacttactgtccaggaaattcatcattcatattgtgctctttcattagaatttatggattttccactgaattttttgatgtcttccttataatgatgaaggctaggctaggcaactgtccagaaacttttggcatagtaccacatgatgctgatactgaggtgacattatgtccttcaaggttctcagcaatttacaactgtgcatgctagaaaaaaaaatcatgtaaaatagaattgtgttgatgaagtagcattcccataagcttgtatttagaggtaaggaaatgctgaaagatttcctcagcaaaattctgcaagaacaactgtgttcgaaatatttagccaagctctgtaaatctcccctcatagttcctttgcagcaactccagaaccagcagtttgcagcaacttgagtgcggaggactttttagtccaagaagtagggttgccctaggatgaaatcttaggctcagtttatgctcagccagaatgatctgacagcttgttttaactcagcacctgctttgacttactcctcttagaaaggcagccccttaccaaggaagaataagactttcttgtctctgggaaatagcagctgtcccccaggtaagggaaacagaagagagcaagtgataacacagaaggaattaaaattgtaagtattcctgtggcagatgtgaagccgtttggtcaacactcctagcactcttattgctggatgctgacataagcagagcattctctctgggatagggcaaggagaggccaagcacacagaatgggaaagaaaagaacaaaaatgacaatatttattgcataatcaccatgttcacaatgtgtgagacactgtgctaggaaatgacattagtcatttccttcaattttcccaataacactaacagagtgatgttgttatctccattttgaagatgtaaatggaacctaagagtaatgcttatgatcacaccactgataagggtagcatgcatttcacatgcaggtgtgtatgacttccttattctctccaccgcgtcttgcaaaaataagaccttttgaagtatgctgggaggtaaaataccctaaggagacctctataaatctctaatttaacagaaatttccttaatgcattgggatgttctacatggttgggagtactggcattcccctgcagaatcctggattcccttagcctactttattttctggtctcaggaaccctgagtgagttgggtctctgaagatcgcttccctcctttattatggttaagaactatgtagatctgaagcagctggagttgattcccacagcacttaacaccagaataagatacttgctgtgtaacttgtaaattgaattcaagtttgcaacatttgtggtatttgggaaccacctattgtaaatttaatataaatacaaaataaaagtgcagagagacactgtctttagtacaagagcatcatctcacattgctgagtgtgaatctcatacaaacgttctatctccctatgtatccatcatgccaagaatcaaatctctgtttgataccaccttcttcatggtctatcctctttttctgatattatttgatctcttacaagtgtagcctcacctggttttattctcattcattctctactttgttccattcttttggttttctaaaggaatctagatgttttgtaattatatcagaactgtatggaatcttagtagtcacctagtacatgttccaaaggagaaactgtaccctagaaaagttaagagaattgctcagggtcatttcagtttgtggcagaattggtccatgtccttaaactcggaattaagttttccttttattgttataagttgccctccctctcctagcccttctgtgctcatatgtagagtcattattgtcagataattatgaggcatgcaatttattgataattaactgttggacattatacaaaaagttacataaacctgtttttttactcagaatttagaccagtgattcccaaggacagacggagagaggagagcccctagaaattattttttaatgtttttcttccaactttgattttaggctcggggggtgcatgtgcaggtttgttacatgagtaaattgtatgttcctggggtttggtgtacaaattacttcattaacctggtagtaatgagaggtgacagcgtgctggcagtcctcgcagcccttgcttgctctcggtgcctcctctgcctgggcacccactttggcggcacttgaggagcccttcagcccgccgctgcactgtgggagccgctttctgggctggccaaggccggagccggctccctcagcttgcagagaggtgtggagggagaggcgcgggcgggaactggggctgcgcgccatgcttgtgggccagcgtgagttccgggtgagcgtgggctctgcaggcccagcactcggagtggccagctggccctgccggcccgggcaatgacgggcttagcacccgggccagtggctgcggagggtgtactgggtcccccagcagtgccggcccaccggcgctgcgctcgatttctcacgggccttagctgcctccccgcggggcagggctcgggaccatgcctgagcctcccccactccgtgagctcctgtgcggccggagcctcccctaccagcgccgccccctgctccacggcacccagtcccattgaccgcccaagggctgaggagtgcgggcgcacggcgggggactggcaggcagctccacctgtggcccccgtgcgggatccactgggtgaagccagctgggctcctgactctggtggggacttggagaacctttatgtctagctaagggattgtaaatacaccaatgggcactatgtatctagctcaagctttgtaaacaccagtcagcaccctgtgtctagctcagggattgtgaatgcaccaatcgacactctgtatctagctactctggtggggacttggagaacctttgtgtccacactctgtatctagctaatctagtggggacctggagaacctttgtgtctagctcagggattgtaaacgcaccaatcagccccctgtcaaaacagaccactcggctctctgtaaaatgaaccaatcagcaggatgtgggtggggccagataagagaataaaagcaggctgctcccagagccagcagtggcaacctgctggggtctacttctgcgttgtgggggctttgttctttcgctctttgcaataaatcttgctgctgctcactctttgggtccacactgcctttgtgagctgtaacactcaccgcagaagtctgcaacttcactcctgaagccaggaagactacgaatccaccgggaggaacgaacaactccagacgcgccgccttaagagctgtaacactcaccgcgaaggtccgcagcttcactcctgagtcagcgagaccacgaaccccaccagaaggaagaaactccagacacctccgaacatcagaaggaacaaactccagacacgccgcctttaagaactgtaacactcaccgcgagggtccgcggcttctttttttttttttttttttttgagactgcgtctcgctctttcacccaggccggactgcagtggcgcgatctcggctcactgcaaggtctgcttcccgggttcacgccattctcctgcctcagggccctgagtagctgggactacaggcgcccttcactgcgcccggctaattttttgtagttttagtagagacagggtttcaccgtgttagccaggatggtctggatctcctgacttcgtgatccacccgccttggcctgcggcttcattcttgaagtcagtgagaccaagaacacaccagttctggacacagtaatataatattcaataggtggtttttcagtcctcaccttcttctcaccatccaccctcaagtaagtcctggtgtctattgttcccctttgtgttcatgagtactcaatatttagctcccatttataagtgacgacgtgcgatatttcattttctgttcctgtgttaatttgcttaggataatgacctccagctgcatctatgttgctgcaaaggacataatttcattctgttttatggctgcatagtgttccatgttatcaatgtacacattttctttatccattctaccgttggtggacacctaggttgattccatgtctttgctattgtgaaaagtgctgcaaagaacatacacgtgcatgtgtgtttatagtagaataatttataatttatattccttcgggtatatactcagtaatgggtttgttgggttgaatggtagttcttttttaagttctttgagaaatttccaatctgttttccaaagtggctgaactaatttgcactctcactgaagtgtataaacattcctttttctcaacaagctcgccaacatctgttattttttgacttttcaatagccattctgactggtgagaaagcacttcagaagagcagagaggtacttaagtgttgttaaagattggaagtgatactgggatttaggggaagagggtcagggatgctagacaccctgtgcagagtggtcttgccccacaaataattgccccatgtactgcacaatttttagcgttccactagacagtcatgaatattaacgaaaaaagtttattattatctaagcctaaaatcaaactcaattttacaaacaagtatttttgcaaggattcaatgattattacattttctgggactataactccgcgaaaatcaagggaccattacactttgttctgttagcaattttgtcagttgttccccattttggaagaccatatccttaaaacataatgctgattttagtattgacacacctctcctgcatcaatctatgtgtatagatttcatctgcaaatatgcaagtaaagagatttgagactcctgttaatagatttggaaccaaatattttaattttttggttcaagttttattttatttttaattgacaaataataatttatatatttatggggccctatgtgatgtttcaatgcatgtatacattgtgaaataattaaatcagagtaattaacatgtcagtcatctccaacatctattatttctttgtggtcatgtgaaaaaaacgtgtgaaatctattattttaactactttaaaatatacaaaacattatcattaaccttagtccctagtgaacagaaaaggagtgatgttggtcacaagatctagaatcaaatattttaacttgatagaaacataaaatacagggatctcaccaaatttcattaataaagttgtttttaaaatattttatttgattgccataccatacattaatctttaaagcactttaaagcataataagaaatctatttgtgcaaattacttgacatcatcaagtcagataataaaactctgttttagagttttctgttttttcaatattattctgatattgtgtcaaatctcaaactcaacttgtatcaaaactccacttccccataagcccttaggtttcagagtttatatctatcattcctcattacctatcaaaggatagaattttagagtgctagaaatcaaatatatgccttctcatgagaaggaattccaaacaggaataggtaggtaggtaggtagataaatagatagatagacagataactagctagatgactctcttactggcatgccctattttgacattaaacatatcagtaagacccagtttatctgcaagaatgacacatttttaacttactcctaccatctgcaattttccttgttaaattatctgtatttcagctactaaagttatttcctctgacgttttatcaaatacaaatggtctgctattactttttctaacactaatttttaacctagaatttattgtatatctgctgttttattttcctgtaccctttgtaaaatatggtatctggtctttttattccatttaaatccaaatttattctttataaatatatgcaggcatttcactatctcattacattgtctggcatagtaggactcacagactgccatattttcatttttgtagcatcattattaaattatgtttttgtgccaagacttatctgcattatggctgtggagaacaggaactatgtgttcaatgcctatatgtcttgcaggataacctgcactatgttttcaacacactattttaatataaactactttttttttatttcttcttttactttggtaaaggcactacattttaaaaaatatgtgtagtcagttgtatcatctatgaattttatttcagatgaaaaaaggaggacattacaaaacattatcaaatggaaaggttgaatctgatagaatggaaccatttgttgagatattcaatattgttttgtataccattatatctgtgtgtttagcttgccttccaactagtccaggagtcaccaaactacagccacaggccaaatccagcctgatacttcgttttgtgtagctccagagctaagaattatttttaatattgaagaaaatcaaaagaataatatttcagacatgaaaatcatgagtaattccaattatgctatctataaataaattttattagaacacagccatgcttatttgtttacatattgtctgtagctgtttttgtgctgcaatggcagagttgaatagttgtgatagaaactgtaaggctagaaagtcagaaaaatatttattatccaacccgttaaagaaacaagtttgctgacctctgtgctaggttatcggctttccatttcccacctgatggaatgtccctttctgcccaacaaagcctatccattttttaaaaagtctggattaagcacatcttcctctttaatcctttcatttgagctctcaaagttgctatttaacatgcgatcctgcaaaattagagtattgccttacatcgcggttagtttccttctcagtctccctgattagagagtgtgagattcctcgtattcccagaatgtagcctaactcacagtagcatagctgttcaatcttgtggcctctttgtgacaattcatgtagcatcattattaaattatgatttggggccaagacttatctgcatttatgactgtagagaagaggaactatgtgttcaatacctgtatgtcttgcaggataacctgcacaatttatcactttttaccatagtatggataagtattgatacttttcaatatgtttctgcgccattaacctgaatttccttagagcatgacctgtcttatttacctgtttccctagtgcttagcacgtaacagtaagttaataaagtgttcttgatttctgaatgtatattaatacagggccttgtatataaaggcactcaatcagtttgaatttattattattactgattatgcaggtgtcttaagatcaagaatgacaccttctattcccacagtagctcaacttaataacaagcatattattttaagtttacacagatttactgttttgtttcctttgtttatttgttttgtttttagtttaactcagattcttattcaattctgtggtgctattgaaatattggaatcattggttagaaattagattccatattcaagtgggtcatactatttcagtgatgaaaggtagagtactatagtttgagaggaaatcggacaaaaattttgatcttacacagtatcatagtttaacttaggagtcagttgttctctgtaaggttgaaataatgtcacgaaatacattttataattagtttctgtatactctgttgtagactacatgacctttttcttcatcattttcatcattaaatataagtgcttggagtacagtagttaccaccattgcataaaaaatctatgattgaacacatttgcattttattctgacaggctgcactattcagttagcagtcaacattgactgttacagttatggttattatagttagttatccatgacattcattgtccaaagctcagtttatatactagctctaaagttgattatgtttacacactgatttttcatttctctaatctattttactcaatctctataatacctgttatcatacttaattacaatttttaaaaatatgtttccaacttcaagttttgttttattttattttattttttgagacagagtctcactctgtcacccaggctgaagtgcagtggtgcaatctcagctctgccctcccaggttcaagcatttctcctgcctcagccttgtgagtacctggaactacaggcacacgccaccatggcaggctagtgtgtgtgtgtgtgtctgtctgtgtgtgtatttttttttgtttttggtgtagagacacgttttgaccacgttggccaagctggtttagaactcctgacctcaagtgatccaccttcctcggtctcccaaagtgctgagatttcaagcatgagccaccatgcctggcccacgttttattttttaataaaataaaaactagtagttaatcataaatccttttagtttaaaactgaatattttagctacttaaaaaacaatttgtattatttagtttaaatataatacaagcttatggtaaaaaatagtatgaattaattatttttaaaaaattaaaagtcacctgtaattccacctagagttaactacagttaatgtagtaacaactttttagtccttttatctgtctctgtatatgtatcttcagtgaaagatacaaattttattgacacgtgctcacagatctagctaaacttgagtctcatttatatatgtctgttaagtgagaagttaagaatataacttctttttaaaaattagcatcatgttgcaatgttttttaaaaattaacatcatattgtgaacatttttctaagttagaaaaatatttttcttgttgacatcattttttaaaattatacttctgggatacatgtgcagaacatgcaggtttgttacataggtatacgcgtgccatggtggtttgctgcacccatcaacccatcatctacattaggtatttctcttaatgctatccctcccctagcccctcaaccccagcaggcctcagtgtgcgatgttcccctccctgtgtccatgtgttctcattgttcagctcccacttatgagtgagaacatgtggcgtttggttttctgttcctgtgttagtttgctgagagtgatggtttccagcttcatccatgtccctgcaaaggatgtgaactcatccttttttatggctgcatagtattccctggtgtatgcgtgtcacattttctttatccagtctattattgacgggcatttgggttggttccaagtctttgctactgtgaatagtgttgcaataaacatatgtgtacatgtatctttatagtagaatgatctataatcctttgggtatatacccagtaatgggattgctgggtcaaatggtatttctggttctagatccttgaggaattgccatgctgtcttccaaaatggttgtactaattttcattcccaccaacagtgtaaaacagtgtaaaagtgttcctatttctccacatcctctccagcatctgtcgtttcttgactttttttttttttttttttttttttgagtctcgcctgtcacccaggctggagtgcagtggcatgatctcggcttactgcaagctccacctcccgggttcacacccttctcctgcctcagcctcccgagtagctgggactataggcgccgccaccaggcctggctaatttttttttgtatttttagtagagatggggcttcaccatgttagccaggatggtctcgatctcctgacttcgtgatccacccacctcggcctcccaaagtgctgggattacaggcgtgagccaccgcactggcctgtttcctgactttaatgatcgccattctatctggcatgagatggtatctcattgtggttttgatttgcacttctctaatgaccagtgatgatgagcttttttcatgtttgttggctgcttgttgacatcttttttaatgactgccaaatattctttttctaccaaaacccataatgttgggcatgtaggttacctttctttaagttaatataaacaatagtgaagtaaaccttggtgtactagaacttttgactacacttctcgtgaggatatatttttagaaaaagaccaattgttgagtcaaagggtgtgaattttttaaggttcataatatttacatagtcattcagtcaatactcattcagcaattcattattaaacagttaacacaagacaaaacactaggttaataaatggggatatactggaaaataagagagactgattattggcccatggagcttagagttaattgccaaattgcttctaaaactatttgctttaccaatttatgattcccccatttgaagagtgtatgaacatgtctttctgcctgtactcttgatgtttttatctttgtaaaatcctttattaatttgataggttaaaaattgaagaacattgctatagtaatttgcttttatttggtaattaaaatgagtacctttcctatgactgtattctattacgaagctcttatgatgtcttctataatacctgccacaatagattactatgcccagttggcaatttaaaacatgcttaattttttgactggaaggaaggaatgaaggaaggaaggaaggaaagtaggaaggaattaaggaaataaatacaaataggaaagtagttcccatttaaaattcctagtaagataaatttccacctatcctaaatatagcagggtcttcttaaccatcgtcatgagtgatctatgcacctgtctttcttgtcactgaaacccctttccttgtgtctgttctctggaaggaaaagagctgaatgttctttttttttcaccctgatataagtgagcaagattaaattgagtgacatatgaaaaaatagttcatgcaacagacagaagtagacaggctatctgcctctatctgtagacagtttgcagaagagtgcaatatggacattaaattgacagtaagagagcttgaagaggaaaaacaatgtgactgatcagatgggaaagggaaatatcctggaaatttcctattttagtatgtttacatagggataggaattttatgaaatttgaatatagacatttaaagataagtttgagtctacatgtcttaaaatgtaggcagcctccacccaaaatcaaaaccattatatggttttgattgtataacattttatctgttacaaacacgttgttcttatactgctgattctaatatttagaataaaacttacagatgcaacaactctcttgactcttctcatcaaagctgggcaccttctggttgttccaaggaaaagtgaaaacaacatacctgcagcatgacagcagtctggtttctagtagaagaaacattattttcgaaggactgaatggaatgataacagttaaataggttgaagactgtaagtacgttgaggaaagagattcttttgagtttacaaaacaacccaacataattgggagttccctatggactcgtttttccaataactaaatcaaacgcaagtataacaattgactttaagatccctaccactctttgcagttcactcagagccttcagtctattttcatcattcttcttctttcttgctcttcattgcactcaaacctgttttacaattcacttagtgtgccaagtcagaaatcaggaagtcatcaccagatccattacatttctattcctagggccctcatgaattaatcaatcactaattgatatagaattatatccagagtgtttcaaatattttccctttttacatttctgctctccgtgcttgagttttggtgtgttatcattcccataaactgtttgcaataacctgtagcctcctagatctcttcaatccattatgaatattgctgccaaatttatcttaacactcagttctatttgtatcacttactgatttaaatgatttaacaacttcaaatcatttaaagaaggcttcactttaagtgtaatctgacttacacttacgtatctttggaaatgttaatgagtggtctatgttggattaaacatgttttaagcagttctctattttttatcctaggatttttcaaagctcttgggggcttatatctccaagagactggtaaaatatgtggaacgtttcttaaatgtgtgtgataatgaaatccctttttcgtgaacgtttatttatgaacatctcatagaaaacagattgccaaccactagtttacaaaataaaactggattccctagcaaagcattcaaggttgtcttcaatttggccccaatctgtatttcccgctccatctccaaccactactgttgtgttctggtcacacccaactattcactgttctctgattccctgaagccaccatgcagtctccagccaaatctttgctcatgcttttctctctctctctctgtaatgactctatttctgtgttggataaaatctttctcatcattcaaggatcatttctaatgttatcttatttgagggcttcatttctctgtgctcccacaaaatgtggaaaatatgcccactttacacttagcattgtagttacttacaggtctgtttcaactatcgtattagaagctttgtgagaaaacaaagtataccttatttatttctgtaactttattgccaggataggacctgaaaatgtttatgagtgattgaaagggtggtatctttaaaaattggtagaggtggaacagtgttatatttggcaaggcggggtcgcaaggggcttctttaggtaacactgtgattgggtctctgaacttcacattctgtccttttgaaagcccagacaatcattctaagtgtccagggagatttgaggccaagaaactgactcagactagttaaaatataccttatatcaaggtatgcaaaagtcattgatttgcatgaaacatataattttcacatgaatggaaacgcccatgttcataaaattcatttgtttattcatttgcaaacatatattgataatagatagtataaccaagaatccctgttctaggaacttgaaaacatagcaataaatacaacaggcattgtagtagagaaatatgaaagttaacaagtagacaaataagattacttcagacaggggtgtgctattacaaattaaattatggtaatgtgatatggaggataggttggagaggtgcttctttagatagacattaaagtaaggaaagtattaatgaggaggcaattgagttcctacttgagagatgaaaggtgaaaagggggcaaccttatgacaattcttgggtggtgttacagataaaagactagcatacgcaaggacctcagggttggaaaaagtttgacaagttattataatagaagaaggctagtgtggacaagagaaagtgtcaagaagaaggctgagaatagagtttggagggttaggtaaggctgggtcaggtagactgggggcatggaaggaagtcggcattttactcaaagttcaacaaaaagccattggactcctttaaacaaagacatgagatgatgtattgtatacagtgagaatgagtttgaggggaggggcaagaatggaaggagggagactagttagaatgatattttgcagtacttgtaaccgagagataatgatggctggactcaggtagcagcaatggggatggggatctattgtagagactgaggatatattttgtatgtagagcaaaaaggatggattaaatagtgtggattcctgaggcagaatatgacagtgagaagataagaaaaataaaggaagccaaaaataacttgcaggtattatatatctcttcctggagtcaaaacatcttcagaaaattttaattgcagcaatgtttgaactccaatgttcacactccttctcatctagtaagttcctagatttctagacaatacttgcctctctcactcactacccttgttcttttcttttattcttaacccttaacctcctcccaaacttctgattgattcaatttttcttcagacaggctaatatattaatcaatcatgctcgtctaggtgttttttttttttcaaattctttgaggttacctcacatgggtgagtattgatcttatgaagtcaattataatttaccacattttaagttggaaattgggagagtatcttaataaagcccccagatactgaccacaggctgtagatcatccccacccaatatctgctattgaccctttcccccctctttaggtcttgaccctttctctaatactttcatgaaagatatttggaatatcttatttaaatacagtggatgatgtatatcccagattcctttggaaagttgctaaaaagaatttggggggaatgctgagaaggaaatcatcaattcaccctactgaaaaaatattttagcttttttgagcatattatttcctctctctctctctcaagttgaaatatgaaatcataagtacagctgggcatggtaatcccagtgactcaggagggtaaggtgagaggcttgcttgaggccagtagttggagaccagcctgagcaacatagtgggaccccatctctacaaaaagtaaaataacatagccaggcatggtggtatacacctgtagttccagctactccagaggctgaggcaggcacatcccttgagcccaggagtttgaggctgcagtgagccgtgattgcaccaccactgcaccccagcttaggttacaggcaagaccccaactcaaagagagaaaaaaatcataagtacatctctggaacacatccattgggttcattaacaactcctccaaacgtgaaggagaaacagggtaagagattgagaacatttacagtggaatcctgtctgtttctcacaattaagtttcaagtaacaaaatcatatcacaggcctgtgtctgttgttcattctaagtattttatttcaagagtcgatattgattattttaattaaattctaagaggaattttgaaaaaaaaagccaaacattgctctaaaattttttcctcctttaaatttcagttcgattttaagatagtaataaacaagttgtgttttcgggaatacgtttcagccactgggaacagatattccctctgcaccttccagaccaattgactaaactgatgtagaaattgataaaccacattttgtcattatctgaaaatgtcctgtcatcatgagatgtctttatccagagtggcagtagcttggcataatatccattatcacatcactaaaattactgtatgatagaataccattatagttgccttgacagagtgcatagtcttctgaacagattcttgtttcagttctgtaagctgtgtatttcaagggtcgtggtttaattcaaagatcagcagaaatattatagtggcagattatatcaagtgatctgacccccccaatgtgaattcatgtttgaatttcacaattcagaagaaaatgagtgagtgtgttgaaatgaaaggcacagaagtagaaaccaggactctagtatctgtactactctggaccctgaatcaccctagtgaactcgcagaatcttagtgtctacatctcaactataaaatgaggaagttcaagtagatttaaaaaatgattcatgtttcactgtgtcagctccgattgattcctagtgattgtctggattatggtgctcagaagaatgatgagacttcatcaaggcacccccagaagagaatacagtgaaaattagtatagccatgcataagaaagaaaaaagtggcagcctggatgcatagtttcttttatagccctggcatttgataatgccatgtgctttatgtgatggctttatgttactattataattatactaacaactaccaactattaagcatttctcatatactattaatattattttaacataacccccaaaataacatagggagataggtcatcttatcctcattttatagatgcacaagtagacttttagaagcaaagtaacttaccttaatttataccatgaccaaggaactgatttgtaatcagagctcaggttctgagtccaaagagtcactgctttcatactaattttatgcaagcctgcattcgttgatgaaaatgatcagagaactatacttatttaggtaattatacagctcagaaattaattattgctgatgggttttctggaaatttaatatgtttaatgatgaagtaaaaacaatatagttttcaaaataattcacttacacctctgaaagttctatttaacgtttcttttaccttttgagacttcatcatattttattggggtaaatgtgtcaaattctgaaataaataaaatatttttgacctcctttgaaatttggaagacaactagatataatttaggcatactccacccttaccccaagctcagagcccagtgtggctaccgcagttctatccaaaggacagattggtgacctacctaacacagaagataacgttcattaagtccttaataaattattgctgaataaaaaatatggcgttatattcctaaattttgtctcttatagagagcaagagatgttcttcattttcatttatttattttttttgagacagagtctcagactgtcacccaggctggaatgcagtgccgcgatctcggctcactgcaaccttcacctcccaggttcaagcgattcttctgcctcagcctctgggatagctgggattacaggcatgcgccaacacacccttcttatttttgtatttttagtagagatggggtttcaccatgttggtcaggctggtctcaaactcctgacctcagatgatccaccgccttggcctcccaaagtgctgggattacaggtgtgagccactgcacctggccaagaggtgttctttaaaaagctagctcaatttcctaatttttacttatgcataataactttaagatattacttaataactttaagataataaactcatacaactcaataaattaaaaacagagtggttgtttagcaagaaggacctaggttagaatatggagagttaggccaacagctgcaatttccagtcttgctctgtatcttctagaacttacctcctattgtgttacagtgttacaaggtgaatggtgtactgtattatctttcatgaacctttataccctagtctgttatatggctgctattacatgcagactctttttctggtggtggcaatgcgtggtccagggagggaaggaaagatggcgttagacaggaggttcatgtcctccccattttgtttttttctgtagaatatctagttattgcataattggggaaatttagcttgccttttagacaatgttttttaaattaggtatgagtatttgtgatgagttctagattgtccatataatcatctcttcacttcagcaacggcttagtttaagagaatcattcttattggaactctcattatatgaagtttttacccatctgagcctttatgatatctttatttttatttatttattttttgagacggagtctcactgttttcaccaaggctggagtgcaatggcctgtgatcttggctcactgcaacctccgcatcccaggttccagcaattctcctacctcagcctcccaagtagctgatattacaggtgcctgccactatgcacggctaatttttgtatttttagtagagatggggtttcaccatgttggctaggctggtcttgaactcctgagctcaggtgatccatccaccttggcctcccaaagtgctgggattacaggcgtgagccaccgtgcccagcctatgatatctttaaattgtgattgaaaagtagggtgtgatgaccttttgtcttatatttcatggaatctaaaaaaaaaagttgagataaaaaatgaatcaatgactaaatctacttgcagagatcttgcctggactattagaactgccttttaactggctttttgcctccagtgcaccacaaaatctatccacctaaagctgccagaatacttccaacacacaccacccgccccacacccccacacccgacacacacacacactgccttgtcattctgcttaagatccttcattggctccacactgctttcagatacagaccaaattccttagtgtgacagagaaacccctataacttactcactgaccaactttaaaccttaaatcaagcttgtccaacctacagcctgtctgcccaatacatatttgtaaactttcttaaaatattatgagattttttgcaatttttttttgttttttagctcattagctattgttagttttattgtattttatgtgtggcccaagataattcttcttcttccaatgtggcccagggaagccaaggattggacccccctgcctttacatctaatttatctcccttcccacttctgaagtactttattcttctgaaaaaataagaagtaccaccttttggatatagtatgtaatttctcgcatctaaactttcattctctatcaagtttgacaaggcttaatagagtcttttttatgttaaggtcaaacccagataagatataggtgccagattctgatagcttataaaaatcagaactactactgataaaaagctagcttggaagaattggctatggtaggcagccaaagggcttgctaacatacccctgaactcaatttacccttcaaattatcaatttctcttgcagaagcatagcttctcctagctaacctcatcttacagtgaaaagggaatgctaggctctagcaggcaggctgactcccaggaggcaggggtgagctgagctttcctagtcccatttttcaaacttacctagcataaaactcccatcttctggggatggggaaagaggtccagagaattagcctggagaagtctctccactggtaactataggcatgaggtgagaataacttaccacatatgtcgttactctgagcctggaaaatcatttcctctcttgtctttctgccaaattcctgccgcctctgcaaatccagcttcagtgacatttctttttgtctgtagctttccttggtctactttttcccaacctcgcctagacttccaaccaatatggccatgttatttttcatcacactctatagtcattccgtcatgatgtcaatttagtgaaatgattagctactgtagtctgtgaaatccttaaaggcagggcagtattatgtgtcaccaatacctaagacaaagtttagaacctgtaagcatttgataaatagagggggtgttttccaaaatacttaaaagaaactattgaagataacctactttgatgattccctactaaatgacaggagctaggctggaaatttattcgtattaacttatctaacctacacaacaactgtgtgagactgaagatattagttccattttacagatgaagaaataggtttatagaaaaactttgcctaattagctaattatttgtgctaccaatatttaataacaaattgacttgtttttacatgaacccttgtgcctctctgatctttgtgtcatctgtcagctggaattacttttgtttttctgcatataaatcaaacggagataaaggtcattgcatgaggagaaaaactcatgctctaatgtgtttttgctttatttaataagcttatataaaacagttaagggagaatataaatttagagattaggactttaatactgactttttcatgttttcaatgaggggatatatactccatattgtttataatacataatgtaaattatactactcattaatgataactcaaaaggtagcgtactgtcagttgagatagttaggatttgcgcattgcccatttagtctaacttggcaatattcttttttgtctacctaaccttattaattctgttttattttaaccataacttctcaccttgtacctgattggatttatttcttttatatatctaagctaacttagctagcctttaattgtttttggtcaatggtcagtcatatgtaataaaaactgcctcatctttagaatacacagagtaaattataaaaagttatgagattcctagataatttactgaattggttactaacaaatttaaaaagtagtaatttttaaacaatagtagctaacatgtattgaatgtataatgtatgccaaataacacttttaattgctagatgtgcattttttttctagacatcttcacaaaaatataggggttagttacttttcttccccatttttagatgagacaataaaacttcagagagagtttaagcaacttactcatagcaacactgagtgattttagcattagaattcaaaccttggatgactcacattaaaaccttgcttttttaaacaatgtactaccaaaagaacaatttctactttctgggagctgatcactgtctttggagacagacaaaattgaatttaattctatctctacaaatagcaagctttaagaccctagttatgttactcaatatctctcccacttccttttctcacctcttagatgggtacaatgcctatatcacagggttactttatgaaaagacctagtacatgaagaatttagtgctgtacctggtacttggtggatattcaatcaatgttaaatcattttccctcacacacaaaaactcatttctgtgtttccaaaaatgttttcacgttttgtatttgagtctcagaagaaccctgcgataacagggattattatccctgtttctcattagagcaaataaaggctcagaaaaaccaagaggctttcttttggtcatacacacctcataagcaacagagcaaagacttcacatttctcacttgttttcattatagcatgtatgcctcctggaaaaacatgtaaagtgaaggcagaaagcagaggatgtcaatgaaatctaaaaggcgcctatgtgaaaaaattattttacaaaaacttttgctcaatcttctgtccctcctgtccctgagaggcaataatatagaatgaaataaggttatattgcattagaaatatttttgcctttgctcagtgaagaccatgatctgagttgacatctaatcatattatttcagcgctatagatactcagcctttaccgaggactgctttataataggctagaggctacattgggtaataccagaatgagcaaacttagttattgggagtgatcttgttggtctttgttaatgaaatctgcaagccccttatgtaatgcattactatattctggatctggttactactttgaggggcctgaccatccagaaaacggtactttcaaacaagttttctttctctgatcatcacacagtatcctaaaatactttgcacgcataggctggaagtagagatagtcaaagcaatctgctcatcatcttgcagtttgcatttagtctttcagaactatttctcccacttctgccttgtttacgaacagagtgagacagtcatgcctgggtggatcatctcccatgtttgcctaggaatcctctctttctctactaggcttcaggaggttagactgtagctttaaaggttttcctgtgagtcagaatcttggggtaaagcctcacttatttagaagaacttgcttctaactctatctctagacctaaaagaattacctttactcatactgagagagtgagtcatgtctcatttcccccatgagctgagatgcagaggccatttttctctctgtatttcaaaaggcttaaattccaattattttttgatccctcactgtcagtgctacaatgaaatttttctgtattaaaaaaataggtcaatgaaggccaaggtttggctgattcttgtaattttcctaatttcctcataaaagcttgggccaatattttttaattccaagtttgtagctttatcacagaagcattgttcgttaatgactgtgctttgtttcccatttttgaaagagaaattcttttgttacatttgaaagaacttaaacatgaaaaacttaaggattaactttttaattagatataatgattagaaactcttcatcatggcagttttcctttcattatgaaaggaagttgacagtttctgttcaattagtgttcactgaaatgtttttaaatgaaattattgctgagtaaaggactccaaaagaatatgacatgattaagggccttgcttttcgactttttaatgaagagattactgatgaaaaaagaattcttgcgaagttcacaaaacatatttctgtgcatgagcaatatttaagtctcagttcattataaaagtaaatatcacaaaagcttctccccactataaatgtttgtgatccctacattaactgacttttaattatgtcaacatagttcaatgaagcaaagtttgcaaggcctattttggtggaatccattgtctgtgactatggtgctttggaagagtttacatatcactgtcttgacttcatagtataatttcaaatgttttatttcgtttcatttaggggtttttctgttgatacattagcattctctatgcaatttcatttgggggtgaatagacctagatctcatgagccctggagatcaatgcttttaatgactctgagatttagttacacatcttattctatcttagaagtacttggttctttcaaataaattctaactgaactccctgaatctaaatacttattttaacaaataactgcaaaatatcttttcagtcataggtattctatcttcatagcttcttattgcctaaagtatcaaatagaaatctattatcaccctcatcttggaggccttctatacttgtcccttcctgatagcattaataaaataataatactgttgacaatagctaacatttatttattaatctttagtactttcttatactctaagaaatatttaagtgtaagtattcatttaatcctgacaataatcctaggagattaatattattattaattattattcacaatttatgagagagaaaactaaagcttggtgatattaactaaattttccaaatgtacattgtaaataattaatggattgttaattatttaatatcatatgatatcaatttagtgaagtgaatagctacccagactcatctaccttccctcagaaatatttttaattaattattattgttccactgcctacaagctttactagaatcaaggactgctctctcccgtttccatactatttttttaatccaaactccatttctttgctttttcatttaatgcatgacctttccatgcactagtaatccaagttcacctattggctctcacctgatcacagttgtctcattacagatgttggaaacctcaaagtcattattaatgacaccttctccttctatatgaaatagacgaataaagtatttgtgtgtgtgtgtgtgtgtgtgtgtgtgtgtgtgtgtgtctaagagagagaaaaatatggagggagagaaggagagaggtagaagtaaggaagagagaagaaaggagagatggagggaggaagaggtaaagaaggagagagagatagaaacagagacttacgcaacactgactaaaacatgcagctgctacccagtgaagatacattgattagagcagggagtagggagaacagattcccagggagctttgctctgaagtcattttaatatcctaaaagtgttaagacaagtcttacttgagtctgtgaaaattctatggtttgaaaagaaaagaagagtattcctaagaagtccaaagctttagccctggccccccaacactatctaattgcataatcacaggcacagtccaactagtctagatctcagtttcatatctgtaaaatggatataaccatcccgacctcctaggattgttgtaagaatcaaatgtgatacttttatgatgatgaaaatgtaatggaggttaggccctaaaggtgcttgtgaattagtgagatgataaaatctgggatatgggcagagcttactaaaacaccaaatacttttatttacacagaaatagaaatatgtacatgtaaagaagacagataataggtaacaattattatttggtacttattttatgctggatgcatgaatcaactcatttaatctcccacaacaattatatgacataaacatcattatcaaacccactttacatatgaggaaactgaggcccaaagtgtagagtaatctggtcaagatcagacatttaaaaagcgttgaagttaggattctaatctggaaagttgacctccagatcatgtacgcttaactatcctctctgcttctgcagagagatgggaaagcttaggcgtcaaccccagcctttggtaacagtaaagggattctaacattacaaagcccaccagcacagctcctttccatggctcaggggcatctctgagtcaaatttacctctcaacagcattccctgtcctcactcagacacttgttgaccattatggcccttaggctattgaaaaatagtttatttgagggaaaaaattgagtgtgccatatagatcttgctattcaaaaccttggaacatggaagtgcattagcatgctaaaagtaccatttaagagaattctcattttcaaatgagatttttctgcttggccatacttaagcagcatgaaagtaaaagataattttagccagccatctttaaaagttattccatgttctagttaacaatattgcaatggcttccttaagattagagtatcttaactgtttactagagtagaccacaagactagctaagtgtatgatgaaagcaaatttactcaggagagctattgacttttttttacccccttgcactcctattacatgagaagccctaaccacctctcttatatttaatatgctgtgagtttttaaaagcagcagagtggagcatcactggaagccactgtaaagtctgagcttttcagcccttgatatagagctaggtgtatatttctgtgcatggactacaaggacaacacgtgataaagaacttggaagagaaaggagatgaagtaatctgagaaggttaaaaacatggtaatggcagtaaaaggatacatgctggtaagaggaattgagagtgataaaacctaggttaatggattcctaggtctaccgtttattgatgatgtgattcaggggcctctcattgaaccactcagtgtgtcttctacctcaatttagaaatagggttgctaattctggctgtgcatattccatagagtttgtatgagaatgaaattcattcatttatccaacaaatatttattgagtacctactcatgctggacactatctatatatagatgatacattgtaagcaaaagaactagtttttatccataatgaagtaattcaggtatgtaatgtaaacatcacacaatagtcacaaaagaggtttacaaactagtttccatgaaaagctataacaggatgtcgtgagtaaggtatagggcagtggtgctcagctgggcctacttttgtttccctagggggcattaggtcatgtctggagacctatttaattttcacatctggaagaaggaaggattactggcatctagcaaatagaggacagggatctggtaagcctcctacgatgcacagtgaagctaagatttaaatgataagtgggagagcattctggagaacaggtgggagaagatttgaggcagaagaactggcatttgcataggaaccaaaatgagaatgggatgtattatatcctaaataatggaagagggcctgtggggctaggtcacagagaagggggagatgggccaagctgaccctggtgacagacaggtccaaattattccatcagagggtcttgatgaagtggttgtgaaggctcctgagatttaacttgagaaatggagtgggcggagctgggatttactggatgaggaagttgaaagagaagcagatttgaggagggaagaaggaggatgaaagctcagcttttggagctgttatatctgagaggtctgtgagatatctgagcagagatgaccagcaagcaacaggatattcaatttaggagagaaatctgagccaaaaaaataaacaagggagccacttacataataatgtttaaatgtgtaaatagggagaatgtgaaaagtaacagagaagtcctagttataaaagtgttttgtcaatcgaaacatgctctgcaaatataaagaattcctaacatcaacatcaagtaaaacattttctacgtccacctatttatttaagaaacctttggtgtcctttgttatatgccaggcaatgcactaaaggctgagaacaagctgataaatatgattaacacctggccttgaaaagtgtcaagaaagcaagtagggggagaggcatattaaattcttaatactgccctacagttgagttcaggtagctttccttctgtcaagaaagtccagtagagaatggctgagggctctagatggggaagaagatggtgaagacacacttcatctgcctcacggttctatctaggttagtcctggcttgactctggtctgaagtttaacatgctgtgatctagcattctgcagaactatgtgcaaacaagacctggggtcccacctacttcagtcaacttctctcaggtctcttgttttctttcccttatagtactgggcatatgattccagagactctgcagtgtgtgtaggatatcactgtaatacgatgactcgcgtctcttaagcaggtttgagacatgactgaatgattgaatatgtagcacaattttatattatatggacttcaatacaccacaggtcatataattccccttataaaatatggcatttgccattttgccatggcacagtcatgtgagtcttgcccatcaaggtatcactctctcaaataggaaaaaatgggtcagatgccaggtttgattttttttgagacagagtttcactcttgttgcccaggctggattgcaatggtgcgatctcggctcaccgcaacctctgcctcctgggttccagtgattctcctgcctcaacctccagagtagctgggattacaagcatgcaccaccacgcctggctaattttgttatttttagtagagaccaggtttcttcatgttggtcaggctggttttggacctcaggtgatacacctgcctctacctcccaaagtgctgagattacaggcatgagccaccgtgcctggaccattttttgtttttttgtttttaagagtcatggctgaattcaccatagatctttttaatacagaaaatcctggtaaatatactaacatatatttttgaaattgtaattagcttttatctatttaggccccattaatagtaataatatcaagcaaacctttaaagagtcttatattctaggtactgtgctggagctggctgtacattggcttctgctctctgagcttacagtttagtggaggaggaagaaaattaaaaagtaaatactatggaggaaaaggaagcaaataggattcagggaggaagaaaactaggaggttacatcctttagactagggtgtaatggtggttaggaaaggtgaatctacaattaccttatataattactgatcactggtcaaatgtatgttggactaataaccaaaagatgtgaatttaatcttagatctattacttaattcttacttgttaaataaatcagtaaagttaaattaatttcataaacactaataatagtgcttactatgtgccaggttctgctctaaagttttatcaatattaactcatttaatcctcaacaatcctatgagataagtactattatctcacaggctctatttacagaaactatggaacttggccatggtcacaaggctagttagtggtgatgtcagttactttagcctctgtgaacctatttctctatctgtatattacgaataagaccttcatggggatgccatgtgggaaagtagctttttaagcagtaaaatgatagatatgcattgttataattttagtgtcagttgtaaagtcaatattacaatgatgtaggctctgaactttaaatactatggggaaactagaaattttaggatagaggacctcaccctccagagagtttactctatcacaggagagagattaccagcatatatgacatagtacatacttcaaaattacatgaagtggttctgctaaatttagggccatacctataagtgctgagttgtgaggaaaatgggattgttgatgtttaaaatatacctatagatcattgagttatggctctgaaagaacttgagagttggttgcatctaatcctttcattttaaaattgagtcattgaagcatgtcaaagcaaaatgactgaaccaagatcttacagctaaattagagcaagaaccataactagaagtaaggtcctggatggtaaagtcttggtctttttctctgattaaacttatccatatcctctgcctcccttcctgctggaaggtcattgctttctaagcttttttttctcccccaacccctcttcaaggagacagattgaactgcaagattacagcattaaatgatgagtgcttatcacttatgataagccccaggagtataagacttcctgatggtttctctagaaacttaaaaaaatttaaatagcttcactgaggtacagtttgatgagttttcacatatgaaaccatcaattcaagatactaagcatatccatcacccctctgcaaatttcttcatgcctttttgtaatctctccagacttttgtaatccctccctccaactaccttatcctacctgctctacctccccattcccagtcaactattactctcctttctgtctttatacattaacttgcattttctataattttatataagtgagatcatatagtatgtactttttgtttgtcctctttcactcaacatgattatttaaagattagtccatgtttttgcatgtgtcaatatttcattcttttttattgctgaacactattctgttgcatgcaaataccacaattgtttaatctattcatcttttgatgttatttcaagcttttggctattacagataaagctactatgaatatttgtataaaagtctttgaatagacatgtgcttttatttatcctcagtaaatgcctaggagcagaatcattaaatcccagggtaggtacatatttaacttaagaaaaaaatactgacctgtttccaaaggggttgtacaattttttatattctcaccagcagtgtatgagacttccaatcttccacatcatcaccaacacttgatatggtcagtctttttaaatattaaccattctaataggtatgtagtagtatcttactggggttttaattttcatttctctaacaagtcatgatgttgattatcttttcagatgcttatttgatacctatatcttcactggtgaagtgtctgtttaaatctttggctcatttttgggtttttttttctgattgaattttaagagttatttgttttatcacatggacacaggaaggggaacatcacactctggggactgttgtgggctggggggaggggggagggatagcattaggagatctacctaatgctaaatgatgagttaatgggtgcagcacaccagcatggcacatgtatacatatgtaactaacctgcacattgtgcacatgtaccctaaaacttaaagtataataataattttaaaaaaagacaaaaaaaaagagttatttgttttttagaaacaagtcctttatgagatgtatgatttgtaagtatctcttttcattctgtggcttctctattttcttaacaatattttttaaagaacagaaatttttaattttaatgatgtctgatttatcagtttgttcttttatggattttgctttttgtattctacctaacccaaggtcataaagatcttctctcatgtttttctttagatgctttatttaggttttacatctaagtatataatccacgttgagttaacatgtaacaagaggtgtgaatcaaagtttgttgttttgcatatggataaccaattgtccctgcatcatttattgaaaatattatctttcctttattaagttgcctttgtaccttcattaaaaatcagttatctaggccgggcacggtggctcacgcctgtaatcccagcactttgggaggccgaggcgggcggatcacgaggtcaggaaatcgagaccatcctggctaacacagtaaaaccccgtctctactaaaaatacaaaaaaaaaaaaaaaaaaaaaaaaaaattggctgggcatggtggcaggcgcctctagttccagctactactcgggaggctgaggcaggagaatggcgtgaaccagggaggcggagcttgcagtgagctgagatcgtgccactgcactccagcctgggcgacagagtgagactccgtctcaaaaaaaacaaaaaacaaaaaaacagttatttatagatgtatggttcaacccctgtagtcactatctgggattcagttttcagagcatgaaatcttaatattatatcctcttttttctttttttgtagttttcagtgtacatgccttgcacactttaaaaatcagttttatataatcccagcactttgggagtcagaggcaggcagatcacctgaggtcaggagtttgagaccagcctagccaacatggcaaaacactgtcactacaaaaaatacaaaaattagctgggcatggtggtgtgcgcctatagtcccagctatttgggaggctgaggcatgagaattgcttgaacccgggatacaggggttgcttgggtgatagagcgtgactccgtctcaaaaaaaaaaaatcaggtttatccctaagttgttaatatttcaaaaatttgtcgtaaattgcattattttttattttaatttctatgaatttattgctagtatatagagacacaattgatctttggatattaatcttgtgttctacaaccttgttaaatttgctaaagattctactagcatttctttagaattcatgagattttccacagataattatgtcatgtgtaataaaagcatctttatttctttgtttccaatctgtatttattttacttgccttgttacactgtttggaacctctccgacaatgttgaatataagtggtgagaagggacgtacttatcttgtcctaagagttttttgttaaaaccagaaatagatattggattttgtaaaatgttgtttctgtgcctactaagataatcgttaagttgttaattagttttgtttctttaaaaaaaagttaataaatgctcctaattctatccctcccttagcacccccatgccacaacaggccccagtgtgtgatgttcccctccccgtgtccatttgttctcattgttcaactcctacttatgagtgagaacatgtggtgtttggttttttcttcttgtgttagtttgctgagaatgatggtttccatcttcatccatgtccctgcaaaagatgagaactcatccttttatatggctgcatagtattccatggtgtatatgtgccacattttctttatccagtctatcactgatgggcatttggattagttctaagtctttgctattgtgaacagtgccacaataaacatacatgtgcatttgtccttatagtagaatgacttataatcctttgggtatataccgagtaatgggattgctgggtcaaatggtatttctagttctaggtccttgaggaatcgccacactatcttccacaatggttgaattaatttacactcccaccaacagtgtaaaattgttcctatttctccacattctctccagcatctgttgtttcctttttaatgatgaccattctgtcttgagatggtatctcattgtggttttgatttgcatttctctaatgaccagtgatgatgagcttttttcatatgttttttggctacataaatgttttcttttgagaagtgtatgttcatacccttcacccactttttgatggggttgtttgtttttttcttgtaaatttgtttaagttctttgtagattctggatattagccctttgtcagatggatagattgcaaaaattttctaccattctgtaggttacctgtttactctgatgctagtttcataggctgtgcagaagctctttagttagatcccatttgtctattttggcttttgttgccattacttttggtgtttttgtgacgggttgatgggttcagcaatccaccatggcacatgtatatctgtgtaacaaacctacatgttctgcacatgtaccccagaacttaaagtataataaaataaataaataaataaataaaataatgtttactatttcataattacaatttgtgaaaatagttaacgaggtgttcaacatatgaataaattcattatttaattttcaggaaaagaaaacttaataaatttcattggttcatttgtaaatgttaaaccaatttcgtattcccaggataaagcctacttggtcatgatgcattatcctttttatatattgttcgattaaatttgctaaaaaattttttaagaatttttgcttgtatattcatgagggtttattgatattagcttttcttgtaatatcttcatctggtttgggattagggtaatgctggcctcaaaaaaaaaaaatgatctggaaagtatttgttcctcttgagttctctgaaaaattttgtgtagaatcgttattatttctttctttaaaatatttagagggaatttatcagtgaagccatctgggcctggagttctcttagtgggatgattttaattacaaatatctttaatagcttatgatgtgactatgtaaagtacttatttcttcttgattagtttgcatctttcaaggaatttgtccatttcatctaaggtattaatttttggggggaaaaagttgtttataagattttctcagccaggtacagtggctcatgttttataatcctagcactttgagaaactgaggctggaggattgcttgaagccaggagttcaggaccagcctgggcaacaaagtgagaccctgtctcaaaaaaaaaaaaaaaaaaaaaaaacttagccaggcgtgtggtcccagctactcaggaggctgaggccagaggactgcctgaagccaggatttcaagtcttcagtgagccatgatcataacattagactgtctataagaataaataaataaatatatacctacatacataaagatttccttattagctcctcatgtttgtaggattgtaggattggcagggatgtcatcttcctccatcttgattttgataatttgtttctcctaatcagtcttgctagagtgtcatcaattttattgatattctcaaagaaccagctttcattttcattggttttcctctatcttctgtgctgttattttttatttcctttcatttgcctactttgggtttaatttgctatattttttttctcgtgaaagatggaagctgaagtcagtaatttgacactaccttcttttcaaatataagcgtgtagtgatatgtatgtttccttaattactgctttaagggaatccagcaaattcaatatattgtagtttatgttcattcagttcaaaatatattctcatttttaatttttttctttaaccagtgagctatttggaattgtgtcatttattttcttaatattttgagagtttccagagattgttctgttattgattttcaacttagtcctattatagccagagattatatttcctgtgacgtgaatctttttaaatttatgaaaatttgatttcaagttaaaaatatgttctatcttggtaaatactatttgagcacttaaaaatgtgtacattttgctgttgtggagtaaaatattctataaaggtttattagctcaaattggtgcctagttttatacaagtcttctctatctttacagattttctatttgttctattaattatttaaaggtgttgatatcttcaattataattgtggatttatctatttctacttgctgccttgatcttcccagcaaaccaattctgtcttctcaacgcaacaagtccattggccacaactggattcctcctttctggaatatggcctggaagttaaaggctataagaattagaaatcacagggcccaccttgtttgtttcttttctctctgtgttcattgttttttgtctcatgtgcattcttgaaacccattctttcctacattgtgtccttttgtttggttattttaggtgggaatgcaaatccaggccctgttactctatttttactggaagtgcaattgtcatgaagttaaatttaaaccattcaccagcagaaagcactcaacgtatggtagtcccaccatacaaaggtaccgttaggtattctgaggtctgcagtctaagttagagcatcgtgacatatttagatgtgatagacatgtagcctagtgactgcgtgtttaatggaaaaaaaatggtagcaattacttatcaagcatcgtgctaacaggaagaaaatacatatgctccacttgtgggcagagacagttgcacactgagtgatagtagaaaagaaacagaggattgacataatattacatttatctttgtgttctctatttctagcacagttcttggcacatagtagagctcaataaatgtttgttaaactgagtcaaattgaactaagttaaatatttgataaggtaaatattggatttatagtggaccccacttgaacttagaaagtaggaagtttagaacttatgaaagtgggcaggaatacaaaacacgtaatatttgcttaatgaaaaataataagtaatataacctaaatgattgagccacctagggcctccaaacgtatatcaatgtgcctatttcaaacagtgaggaataaacacatagaacttatcacctcaagaggtttaagaagattttcactgaatttatgaacatgaattatctgtgagttggttaaaggtaatattggttagcatcaagaataggaagctattagttttcaatcaagaataagctcaaatttggtctaaatcttaattttaagctgggtaatcattgatttacaatttttttcttggtgtcacatttcttccaaaacaataatcaatgaagcctttcccaccctgtgcctttgctgtacctttcctttctcagaattccccctatatctgtataactaaatactaccctaacaacagactctagcaaagtgctaaatcttccatgagcctgccctaatgtccaccatggatataatctcttctttttcattgctttctaaatagtttatgctacctcttttatggtacttacacgtttttaaatttgcctttttgttatttgtgctgatttaccatcccttctgttagattctccttaaaggtagaggcaacatctgatgtattcatttgtccaaagtactaccaaaaattatagcacggctgggtgtgtggctcatgcctgtaatcccagcactttgggaggctgaggcaggtggatcacgaggtcaggagatcaagaccatcctggctaacatggcgaaacaccatctctactaaaaatacaaaacaattagctgggcatggtggcgggtgcctgtagtcccagctactcaggaggctaaggcaggaaaatggtgtgaacctgaaaggtggagcttgcagtaagctgagattgtgccactgcactccagcctgggcgacagagcgagactccgtctcaagaaaaaaaaaaaaattatagcacatgggagatgcttgatatgtttgttggatcaatgaataaatgaatgaatgcaagattcaaagggcagtttttaaaactgtttccacacacaaagactatgaattctttacctttttttccccaaaaactaaagagaagaggatttttaggacatgctctttaaaggaaagaataaaggaacctgataaacaggaggttggaaaagcctcacaagacccagcaagtggggtctggaataatgataagcatttgcttaagaatttcagagaggaatgactgggattttggaaggtaacttaaaagacagctttttattttcctgttgtttcctgagaaattcagaacatttactagtgaaggaatattttctgaaagttgtgggctggctggtcgacaatgcatggagaagaagcatgtggctggggcagatgggagactataagggcaggaatgaaggcagaggagggactgtgggtgtgagctgaacagaacaccatgaatgagaaaaagagaaggttggttgaattgatattgaaaaacaaactgtctaatggcaatagccttatggtgtgtgctcgtgaagtactaaggaaaaacaatttccctacaaattaggtaaaatttacaaattaggtaaagattttgaaagatcagttctacttttcattccttcagttcaaaattgaaaagaaatgaaggtaagaggaaaacttccctggtgtcagcctttgagactttaacactacaagggcattagtatgaaccagtctaccatcatcagggtacaaatggaggaaaactaggtaacccaaatcatgctgctcttccaaaaataatacagggaaaatatttcgtgtatgttatcaaactgtttcctacaatttgtaccttgtttggtcttccttggattttctaggtcaattaaatgcataatttattatgctgtgagtttctctccttttgcctcttacctcttgacatgcttgagtaaatatcaccattgttgactgtgcaaccagcccttagagtacggattcctttggaacttccaagtgctctgagcatcaccttccaagatgccttacctcctagcaccttctagctcagcaatcctacagagacattagggactggtggagcctcacctccctgtgtgggtactgtccttggtgaagggaattgagaatatgtccctaaattctgttcatattttatttcatgcttatacgagtcttttttgttgtcgaagtgcacatgcatatttctttggaattaacacattccagcctactctcatttcccgagaacatttaaagacacgattctccttgtattatctatgtaaattttatctagaataaggaataaaagtgacttttcttcaatatataggcaacataaagttcttctagttactcttacattttatgatgccttctggcttgtctttagagataatcccagataaacaactcatagtgccattaagacagtaatactctgtaggtgaagaatatgtcacatctagctcttaactaaactgagaggagagctggacatattaaatgacactgtgagtatgcatgtatatagttgtatttctgacacagcaaacaagtgctgacatctgtatatgtacatatatgtgtgtatataaccgactcccttcaatgttactacttttcacaagctacttaaattccaccaccatgacctgccacccaaatcttctggtaggaatattttttcacatctctcttcttcctacttctttccccctacacgcttatggtatgtgccatttcaccagacccgtgtgaagacaggagagcactgatgggattgcttttcacaagtgtaggaatgaaaattcttcccgatgaaaacatctgtctctgttcaagtcatgcccagttatcccccaaaagaaatgttctgattaactttttttttaagtcttaagatagcagtttgtgtagcagatctaattaagaagtttatgtaacagatctgcagggtttttttttttttttttttttttcctcttcaactgggttctgtgagctcagtttgagtgttaccagctttcgctatgcaacggccaagtgtttctcgggctgagaattatcagcttttgtgggatactattgcttccttaaaacaatgtgaacaagctatgcaacatgcatttattccggtaaggaaaattttcttttattttcctagggattcttttatttattcttcctttttctcctgttgtatctatagagaaatgtataaattctgtgcatttgatgatcatagttattttctctgtagttctcattcaggctaaatatatggtttttctctgtatgaattcctaattcttaatatgtccaagcattaatcggtgagaaagaataaacagtggtccaatcaaactcatcccactgaagacagtagtttctaatagtggcatgtactaaagaaaggaaacaatattgatattccatatattaatgtttgaaataaactgcaatgtttatttccccattggttcccccagagctacttgaatatcttttgcagttaggtttgatatatagatcaagaaaccaaaattgctattctttactccaagtaaaacccaccaaaaaagttatcttgaaaagtataattgcttctttagtaaagtagtgatgcaatatttagattttgtaaaaatttctgacagaagttgtgtatagctatgtaaagtgaattagtgaatcagtgtcattgtgttttattttggagaaataatgtttgtgtttataatttatttaaccagaggaatcaggctggcaacatttgataggccgagataaggtaaataggactaccaagaagaatattaaaatgtttgattattttcattagatctactttgaagaattgagatcaccaattagctatgagagaagagtcttaaaaaataatctctgctaaaatttatttggtaccttctcaagaaaaacattatttctgacatagaaactcaagagatatgcttctttcaacagttggaataaatcttccttgaagttcatgttattttcaagtgactcaagttagatgccatcatatttttccctgtaacttcgaaatcacttaaatgtcacaaactctgggctatatttgaagctcttctaattgaaccactatattttagttggatcacggtaagttgatcttgactactaaagccataaagcttatataatttttgtaagaagtctaaaaaactaatggtgggaaactctctaaatcattttgctataaggatcctgctttgaactagaatctagaaagtatagtttgcttctcctatgtttatgagacttctcttcctttttttttttttttttttttttgttattatcaaagtgtgatattccttgtggacctcaagtatttcctcgttcacggagccatcccttgccaggcagggttatcttcccccttcttgatttcttgtgtgcatctctgatttatcacctaacattttattcttaagtgtttcctctcagtctctctaattatattgttacttttggggtaaatgtgaataggaaagtaagttggagaaaggaactaacatttatttgtttgtgttgttgttgtcttgtcttgagctccttaaatacagaagtgcatctattcccagtgtctagcacagtgcctggcacataaagagtgcttggtgagcaagtgaggaatgactaaatcaaccaacaagcgtctccaatttccaattaatgcttgacagttttcattattagctttgtctttactgatctcataaaattatttctattaaagtccatctggagaaaactcagaaccttgactatagcattgtggtggtgtagtggtaggggcagggatgtgttaatacatggaatagacccctatgtgtccagttaaccttggattcaattctcataattcgtgggctactctgtctttgattccagtgtgtttccagttttgcttaattcacacatatataaaatcatgcccaaattatcattcaggtttgctttagttttgactgctctaaatcttttcagaacatattgggaatttgccaatatatctcaagcatcttccaagtctttattaaacatatgattatatcatcacaatttcatgagagcttcttttagaaattatagccattattaaaatattatcagttaagaataactctttataaactgaccctcaatttatttttttgtcagcagaaaaggtactctatgtattccctgctttatgcactttttaacccaatgatatgtatttcatgtacacacatgtattttcacttgtatggaatttgtactaatgatacacttcattgtttacagtatcgtaataaatcctgaagtatacatatcctatcatgctgagtctattatgttaaatcagtgacaaatatacggctcaaataattgcctcctttaaaataaaccttgttctcttttaaatcaaatacttgaaaatgaacaatgtctataaagtatagtcacatattgatgtcgttaatcttaggagaattgacctgaaaaggtcgtaagcaagtaaatgctcttctgtgcatctactgtgagtgtggattcctaacgcatcgttagaatgcggagccacctagatggtccggatcatctcactcacacaccataagctatgaatcacaactggtttttcagtcaatgtagttctgtgaactaacaataaacctgacataaaatctcaagtcatgatataatctgcccccagggaacctcccatataaaattcatattggtgaaaggaaccttaaagtggctgatacctggatagtgctgctcaaaacagtcttcagagaagaaggaaaccaaactatgaagtccttcaaagtttcaggatttgatttcacatattagatcctcccctagagttaacaagatgtaaataaaatctggagtctcaagcaagttcatctgctgatccaagagccacaagtgcaaaacagcaacacagaacttttcttatcttttagcctaagtgtctggcgaatgtaagctcctaaatatttattaaatgcatgaataataaaaagttctcatgaagtattttaaattggttccatcattggaggcataaggacattcttctaggcagtcagtatttttggatattaggcaaatcagaggctttgcaattttattcaaatgagtagatatgcttataaaaacagtctcataattagtagttcttttcatagagactggcctgtgtttttattcgtttgttagttcaatcagctcactcacattttctagagcccctactatgtgtcagacactattctagacaggacaagtgcccaaaagtaaacttaaaacttctttgtgacatcatcactttgtaagagagatagtattaccaaatggtgccctaatatctcttgctgcaatgtacaaatttggttttccttatactgctaacaatcatatctggatttcataaaaacattcacacagggatcagtgggtcctaagtacagttcttatgctcatcttgctgctagacttggggcttctgtcagtcaaaaagaagtcgcaatactattaattcattcgttcattcatctcagaaaaacttattctgaccctaatgtgaaggttatgcggcttattaagcattgggagagatataaacgtgtataaatcaggagaacccctaattggaattctgcccccaagaattttcaaattgatttgcaaatcactgtaataccatatgcaaaatgtagagtatcctaagagtctatgaattaccacaagaattcagagaaggggcaagcttcatggaaggctgtctcagctaggtttgaaggttaaacagaattttgacgctcagtaatgatggaagaagaggacattccaagtggaggaaacagaaaaggcacttgtaaattgtgtaaacacagtctatttttccatgtgttcgtctattcaatgaatgcttattaaataccttttatgtgtcagaaattacgatatgcctggaacatctaataataaatagggcacagtcaaaccttgccctgggggtatttaccttctagtggtggggacagacattaaataaacagttacacatgtatctctattacacacttgaatactatcctatgcaagttgtttacagtgtttctcacaattgcaattcaatattacatgtatacatacacagataaacatcaattatcagaaagtgtagcaatagtagatactttctcagtcactacaaacaaaacaaaagaaataaaacatcctcccaaatatgctttagttttaaaatataattcatttatccagcaaacaacacatcctgcttgccacaccctgggctaggtactggcagttcaaaaagtgatagttaatatttactgagtaccaattttatgccatgcactgttccaagcattttacatgtattatctcaattctgtcagcaacttctgatgtaggtactatcatctccattttacaaactgtaaaaaagagatgggccgggcgcggtggctcacgtctgttatcccagcactttgggaggctgaggcgggcggatcacgaggtcaggagatcaagaccatcgtggctaactcagtgaaaccccatctctactaaaaatacaaaaaattagccgggcgtggtggcatgcgcctgtagtcccagctactcgggaggctgagacaggagaatggcgtgaacctgggaggtggagcttgcagtgagccgagatcgcgccactgcactgcagcctgggtgacagagcgagactctgtctcaaaaaaaaaaaaaaaaaaagaggtgaagtacctttcccacagtcacatagttaataaatggaatgactggtccttgaactcagtgttccaacctcagagagcgttattcttaaccacctcattagagtaagaagaaaacactaaaaccaagaaaactatattgcagtgtgattaggagcagcaattaaaagatgtacaaaccatggtaaatgcagcaagggaagagtgatccatctgcgtgagatggaaaggaaagataaccagcgaaggctagaaaaaggagaaaagtcttgagacagttttaaaacaggggtttacaagatgagggaggtgagaggttaaaaacaactggaacaaagtcactaaggcaagaaagagcagtatgaaatgagagtatgttactaactttctccaacttgtgatctaacactttgagcattacagaagcaaggtcagaacaaccaggatgagagttgggtcatatttaaggtcaggaattatacaggtaaatcataaaaacaacactaaataattcaagcccacagacaaaggcactggagcctcagaagagaacctcaagaaagagattattttcagaaacctggcttaattgtccctgctatgtgtggcctgacctacaggttgacaatggtgcctagaattgagtatatccatggagaagcagagaacgtttgtgcagaaatgtaaaagaatgaaacaaatgtagaaaaagaaaaggaggtgagaaactatgtggtctcaaagaaagacacagagaaatgaggctgaaaagaactaagagaggctggactgtgactttctgggtcccccaaaactcccagttcttagttccagtttatcagacggcctgccctgctgtgcttcttgtccttttagcctgacaacaaattccaaattttgcttaagccagtgcaagtgagtttctatacccacagccacagaactttaagataggggccagttagtgactagtggtacaggaataggatacagtgctaaagaagatgaaggacggagttgaagagaagataaacagatcagctgaggacagtggtcttcaaagtaaggttgtatccttcaggacttaactcctatccccttccacaagcctttccttatgcctagtaaccagaagacatgccttttccctccttacttcaaccctgattaacatccccctgaggaaaaataagagtagggaaatttcttaccaactactttaatctatacttttgtacgcaatcatcacaataccaacatgaaatggatcattgttattatctacatttcagaggattagtggggttaagtaccttgtttaaaatcttgtggccagtaagaccaggaaagaacctaggtcttccaaccgtaatcccacctgcctttcttcatgcctgtcatgggactttgtccctatttctctcgtgcatttttttctgctttggattataagcatttgggaggtttcttttatctccacatgacattatgaattccttgcagggcaagactatgcacttctcctcttcctactttctgcagtgccaagtatggtttcttaaatattatgtttcctaagtaaatctgcatagatggaatggtgaatacttaagaagggagaatttaggcaacaatgaaacgataatgaggaaatgatccttcttgcctcagataaattcttaaactatgtctcctgagctccagcatcacatccaccaactctgcctctgtggtccctggatgtatagtttgaaccatcatatgttgaggtcagctctaaataggatttgttcagtgatgactttcagtcccagttcatggtgttccaagtgcgttttgtcctttctggattctaaatagtacttaactcatcatcctcaatcatgttggattcatttccctgtttccttcctcttaaccttgctttgcatttctgtttagtaataccccaatttttagtccatttccttctgaagaatatgaacaaggctattaatggaatttctattagtataggaataaagatgacacttaatctatggagatgttcaatttaaggcagagaggggaactacaccagaagcgacctggataattacaatagcttgggactgcaagaacatttgcagattgctggtaaagtggaatgaaattgtcactttaggtttttaacaaaaaagcaagagcctgctatctttatatcttcctcacttgtgaagtttgcattttctttgactaccggtcttgtgatgcctgtgcatacacatctggaggccacgaaaaactaacaccaggtgcagggtgccttctttgtattccagtattgctcattataaaatgttttgatgactcattaaaatggagtattagcactgatatagttattgtacaatagagtaaagcttacattctgccacttccactttccatacccatcccagaaattgcaaaaatagaacgccaagcttatttgttacagaacagaaaaatagacagctgttcagagttaataatggcagtcctcttccatgtagcaaaccaaaatttaaaaatatatacacattaaaatctgaaaagctttaatgagctaatactagatatgccatagtttttgaagcttcatttagatatttttatttagcgagaagatgcttaggagcaatgggaattctcattttcatcatgtagagttgaaaaaattacaccaatgtttttactcttgctgctgctgctgctaagactacctctactactactactactacctatcttccttatatttatttatcttgttacaattttcaaagtagtataaactagattacttctcgttacaactttcacaattaggcaagacgagttttatcatcttcatagtagttatatgaaaattaaagcttagaaagttgaaatggccaggatcagaaatggttaaacagtaagacataatgtagtaggactaaaatccgagttcagtttttattctgattcagaatttcagctacttgaaggatccttcttccaccatttgctatcttgggtaaattactcaaattctctgagcctaagtttcatccaatgtaaaattagatgttatatataactttttagcattgttcgaagtctaacaaaatcatgtgaattgaactcttaacacagtgcctgacccaaaagtgtgcctggtaaaggttgttattactgttgctgcaaatttttaaatattttcccaaatatatacatttacaaattgcataatgtcctcatatatggctacatttgcttcttgaagaaccacatgatattgatgaaataataacttttaacatctatacatgaatagaaattttcagagagattaaattaattagctaagaccattgcagaagtgaggagaaagatcttaaatcccagacagataatccaagttctaaactcttttattactacttttatgatattcaaaattagactagtattaaaatcaggaatcatacgattctcattatagttgtatataaccttagaaataattcagagagttaagtgacttgactaagttctacagggccacagccagtcctagaagcctcgtctgctaaatccaagtgcaggactagaagatgctcatcctatgacataaaagcataagatacaaatgttcttatccagtaacggtgggtgaggagcagtcacgagatgattgcaaatatattcataaggaagttatcatctcctttctagttggttaggaaaaacctttataaaacaaatgaaggttccagagtacctgagattacaattccaatggaaaaaggagtctgagagcacagaagagagagtcccagcctgggaatcatcatttcactctccaacttgtgacagagtccccacataccagaaaacaacctactccctgtgctccttctctttcattcttttttcttgttatttccccatctctcctctagcccacagcaacagataatattcctccttctttatgttaaacacacagttgtagcattatgccaggcctactaggaggtaaactgaacaagcagtatccttgctttatagaataatttaaagtaagaaagccaccagaaaactgagaaagcaagagtaacatagacactgccactgtgggaagctagaacagctgtggggctaggaactggttggcattttggatccagagatttgtaggctcttggcttggagaacaaagacttcattgcctagttgatgacaatatagaaacacatctgcagagtatattctttggcatcagcaaatgccagcagtatttagtgaacctctatgtttctagtccccattcacgtctcctttttatctgttatttttctccatgtttttcctcattggaaatgtttccaaattgaacattaattttgaagaaaaatgggttgaggggagattcttagacttacagatgttatgagaatttaaaataagggaaaatgaaactaaaatatcctgtaccctgttcgtcttgtaatgagcgcccaagtgccattgtttagaaacaagtcttggaacatcctccaggcccaccataaacataagcacattacagattactgatggataacagcaaactaaaactcatacttcatctttgcctctctccctaaaatttcttctcacacaaaagaatcattctagatataaaatattttaagactttctgtatagcctcacctgttatgtttcaaatcttagtgtatgatctagtgtcaaattatggtgagtaggggaaaaatgaaggcagagggattttttttctggagttataccttatagaaaatggatagaggcaataatggaagaaagagcttggtaataattctcagcttcacttcaaatcttttttactctttatatagaagagaactccttgctgctgattacatagttcttaggccagaaaattaacctgtttacaagaaaaacaaaatatgaactatgaacatagaacaacaggaccatatatagatttttgaggtgccttgtctaaggcatacaggacattatgcttcagccaagtcattagaaaccaatttctataattgttccttatcaaatttaacttttgtcttttatttctgcatgcttttcttaatgtcctgtctcctaactttctatgtctgagtggtaaaaacagagatcatttcccagaatgaaaagttatacagcatccttgctttctttacagtatttcctagcaggatgaactttgcaagagtaaaattagatccttgatgagaagtggactttcagaagccatttccctctttattccttaaaaaataaaactaactggggagactcagtaaactgctgaattacttaacttactgggtctgaaactaagatctcctgactccctagttctgccatctttatattaggaacataattccttgactggagtgtggttatttccagggagacagagtgcctgattttttatagccatgcaggaaccacctgggttgtcaggttgattccattatcaatgactcaaaactttatgtttctattaaaaataggaacactatgcagccataaaaaggaatgaattaacagcatttgcagtgacctggatgagacagtagactattattctatgtgaagctactcagaaacggaaaaccaaacattgtatgttctcactgatatgtgggagctaagctctgaggatgcaaaggcctaagaatgttgcagtggactttggggatttgaggggaagagtgaaagggggtcaggggatagaagactacaaatatggtgcagtgtatactgctcgagtgatgcgtgcacgaaaatctcacaaatcaccactaaagaacttacttgtgtaaccaaataccacctgtaccccaataacttatgaaaaaaaagatgattatggagtaaaggatgaaaattgcattcatttttaatataagacatgaggctttgaataaatgtctagttttgggtaagtctttggggatatattctcacattttatctggaaagtttgagaaatgctgtagatgtcattttgctttgtcgtgatttttgagttcttagttttttctccaaatcccatacttcctcccacctaacttctcctgaaatgtacagtggaataataagttagaacaagtaacactgccagcagctaccatccttgttccatgcagggtaatggtaagacaagaatatggatttggagtcaagaggagtgagccttggctccatctggttattagtctggtgatcttgggtaagttgtgttacaggtccatgcctcactttccttatctataagataatcataattggaatatgtacttcatagggttgcaatgaggaatagggaagaataagcacaaagtaccagtgtataattagcatagaggagtctttctgtttataattttccttaattttcatgctctgcagtgaatagcatggtctggagtgcatgacaggctccagatgctcacacatggacaccatcaagcagtgtggtataagagctcatcaccagagggcagcatgcagttacccctttctacccattgtatctaattctgttgccccaagagtttctcatgaattgtaactcctattgctgtggctctagtccaataggtctaaaaatcaattaacaattactgtttgagtgtttgagtgtgtgttgtatgcccagcactgttaggagtgtaggtggagtggctgatgaagaaatagagaggaggaccctgacttcaaaatgattacaatttctgcacggagacatgaatatcacacatgaaccaattagctatcaacatgtataaaaatataaagaaatattcattcagaatgtcagggtttagtgctttcacataacttatttcctttaatatttaaaattcagtgtgatctgaagtaatacaaataatgagtgctttaaaatgtggggaataggatgtatagattgagtcctggagtgatgatggggaaagtatcatgaagcatctggaactttagattgtccttgcaggatggaaagaatttggttagagagataagattgaggactgcaactgatttaggatgtaggaaaaggaagaaatgaaaacaaagacattgcggtaggcatgagcaaggtatgtgcttggagtagtaaggatccttgcctggtgggaggaaaagagagaagaaggatggaaactaaatagcaataatttagtgatcccacattgtgtataaaaccattatccatgtactacagaagaaataagccctaccttaacctaaagaaccaggttattggcagcttgctctgaattctggcacctaaatctggataatacaactgtactgctaagattatagctctttagtagcttagcaacgaggaacagatggtatccacatggatctttccaggaatagcaccacatagagtgaatcagtgaattaagtaggtatggttattatggcatggggcacattgactaaaccacatttgagatttgagctattgactccattttttgtgggatcttcagaaatcatttgcataaataaagcagatttgtaaaagctcggtgtgagtcagtggggtttgaggcattatggcctaatggtgaaaagcaaagggcttagagtcagaacacctgggtttgaatctcagttttgcttccttctagccatctgacattttgagaaattcacagaatcattctgtgcctctgtttacttctctatagacaagagaaagttccgtcaatccttctggggttctgtaaggagtaaacaataaaacacaagtaaaaagcttaccatatttgcttggcacacagtaggtagttggttaatcaatgttagttccctttcctctcactatggaaattaaatgattgaatgtgtgtgatatactttatatagcatgacattggtggttgatataattgccaatttgtgtttcagtgttgatctgtagatgtagttttagtgagtaatttattttagccttttatactaagtgtaagtacgtatatggcgagcatgcaggatggagatctgaagaatcttcatactaacagttcaagcaatccccatttcttcatccaaataggattgattctagaaaaaacttataaagtgaagaaaattctgtttggcatggggcacattgactaaaccacatttgagatttgagctaatgactcaatttttttgtgggatctactggtctctactttctgtgcttcattctccaggctgctccatcatttctgcactagaaaaaaaagggaagaccaactcagcctatctgaggtctttaggatattcataggatattcatttattttctgcaaaatattttactactttgtattttaaaggaggatcaaacagagatggtaactctccagtccaaggggataaaaaatactaatggtgagtgttcaaggataagtaagacaaattgtgttgactagaacagactttacttatcaaatcttaatagggtgcagaagcaaatgtattgcagtggttaggatttatccactttggagccaggctaccgttgtctgactcttggtcctgctattaccagctgaatgaccttgggcgagttacttactgttattagttttgttatctgaaagtgagggtaatattatttttattattaagagttcaggcaagcagagtcaaattgatttcaagccaaaacatgaatcttccatcctgctaccttgttttctgagctaggctggtgttaagctaggtaggtaaccatccaggcattttattaaatgctagggaaagggaccacaatcttagcttcctccaaagttgcttcctttagacatcctgacacagtctgcaggatgaactagccacgccctcaggcactcacatagtttattcagcactgttcgtgtctcagtaagtccagcggtcttatgtctccgtagagcaggggcaaagcaggtgacaagccaaagccactggatgatattagtagtgatgacttagagctgggctggattgaactgcacccacctagttgtcttgtagagaaggaacttaaaaggagaagaaaatctaggaaagcaaaaagtaaaaactaatctccagtaataagtataataacctaagaacctttttttttttttttttcgagacacagtctccccaggctggagtacagtggcacagtctcagcttactgccacctccacctccaggggttccagccattctcctgcctcagcctcccaagtagctgggttacaggcacccacccccatgcccggctaatttttgtatctttagtagagacagggtttcaccctgttggccaggctggtctcaaactcctgacttcaagtgatctgcctggcttggcatcccgaagcactgggattacagtcatgatccactgttcctggcctacacatgcattctttattcagctaaattcttgagaaataggttaactggaaaatagcactgtcccatttttaagtgggggtttgcaagacattaagggacccagaaacctctgataactggggaattgaatctaagtcagaacggtgataaatttctcttcagactgtaaaagagaaactaacaagtttccaggcagaaaataattgcattttcagtctggtcgcctagaaaaactcaggcaaaaaaaatcaaatgttggagttaccattatggactctggggttagaaagacatgggtttaaaaactgcttgtggcacctcttagatttgtgaccttaggcaagtgacttgctcagttgggatcttcttttcttcctttcttctctcctttctttctttcattccttccttctttttaatgggaacaataatgttttccttagaacattgtaaaaattaaatgcattcatatatcttaaagtacttatagcattactgaaacataataagcaccttatatatgcttaatactttattattgttattcttgttaacctcagttttgatactatgtaattgtgagatctgggttatgtcatattctttgtattcattttcatatttatagaatgtaagagtgtaattaaaggttccttaagatctcagctttaaaagttctatgattctagaatatatttgttcttcctattttgttcttcctctcttacacaaccatcgatgtgtctttaatcagtcaattacccatttatttggggcttgctcaaagaatgcctgaatcagtcagcctgggtatgctggggccatcagccttttcctaggcatgcctcctacaggcctcttcttatgacacactgggcctcagcaactacaccagaggaaggaggggaaggttcttgggccagccaagatcaaggcacattaaataaatttagatttgaactggcttgtaacttgttgatcaacagcaaaaattaggatctggctgggtgcggtggcccacacctgtaatcccagcatctggggaggctgaggcaggtggatcacttgagtctaggagttcgagaccagcctgggcagtatagcaaaaccccgtctctataaaaaatacaaaaattagccaggcatggtggtacatgcctgcagtcccagctacttgggagtctgagatgggaggatggcttgagcttgggaggcagaggttgtggtaagccaagatgggactactgcactccagcctgcatgacaaggtaagatcctatctcaaaaaaaaaaaaaaaaaaaaaaaaatccagagataactggtgaaatctgttttcattctaaggggcagtagaacatggctctggagccagattgcttgggtttgaagatttaccagctatttaccagctgtgtgactttgagaaagttatttaacctctgtttcctcagctctactttgagaataacagtgtttgtctcatagaattgtgtgaggattaaataagttaattcacataaagtatttgctatataagtacatacacttattattatctgtcccagtattaatatatcaggggatttaggtgtggcagggtcataatactacaaaccttcaggtagtgataattgtaggttccaagtaaatcctccaaataggagtagggtcctactagcacctagagatgtggaactccagcctaaaagattgtggaaaagaaggagaggaaagacagagtttcgttccaatggagaactaaaatgtaattcaggaaatgaaggcggaagtcactcccccaaccatgccacattttttttttccagagtaagccaacataatagagggttatgggggaaaatctaatacacaatacagttatcctgtgttcaacactcagcatatctaatccggtacttaatgttagatgtcttacttcaaagttgatggggtatgtgcatagtaaccccaatattctacttccctagccaggattagcatatggtctgactggggctcatcccgatggaaatcttctgtgtgaattgtgaagcaaaaagtttgctagcatgctatcttgtagctgccagtctaaaacagctaatatttaccttgaggttctgggatctccacctctcataatgaaatcacacacatacacatgcacacacatacacccacatacaggactcattttcaaactttcagtggcttccattttgtttcaaaatgtcatgccataccatatataaaagtcatttatagggcctgtgtccctctaaatagacaagaaatcttgcccactcagtaatcctgtcctgtaaggctgataagataagccaaaggtatccaaaaacagctcatatgttattcttgcactattttaccacctatttaaattggcgtaatgacaatcacctgccttccatttgcatgtcccgggtcagctgaaatccctgcatagttcctagtaccatgagtgttactgttaatttcttgctgatctagttctctccttttctaccttgcttcttaaaagtctaggtactagattaagtcttttgaccttcccactgattagcctacacttctcggagctaagctacatgagagtgtttcttggctgactagctactctacatttcctgccaataccttgcttgaggaggcttcttcaccatagttggcttcatgaccacctgtccacatatgtcagaggcatttcccatatctgacacttaacacatatcaaaaggtaaccacattagtcagaatcaatgaactcctttgtaaagttgcattcattttgtcagattattttttatttagagtctcttggaagcaagcaaaaaaaaaagtgtatctattactagtataaacaaaattgttcatgtaatctgagaacatttgtatgtcacatgaagcccaaggataggaaggtggctgacattcattaataacttgatctatcatttaaattatatcagtattccttctgcttgcttcttgcttctctgtaattagctgtactagtcccttatgctgaaaactggctttctgtgcatgaaagagaatgtcatgtaaaaggcaaacaacacaaaaaaaggcttcatagtttggtttacttaagaaagaatttttttttcttcatcccttatagtttcaaaaatcttgcctagatgtatataaagataaatcttgaattttctgattaaagaaagattttgttctagatttttcataaatctccttccagttaatggaaaaaagcatattaaagaaggacactagaatctgctgagtcaccagtttgatttaggcatccaattaaagaggatatccaaaaggaagaaagagagtgtatggccggacgtggtggctcacacctgtactcccagcgctttgggggccgaggcgtgtggatcacatgaggtcaggagtttgagaccagcctgggcaacctggcaaaactgcatctctactaaaaatacaaaaattagccaggcgtggtggcaggtgcctgtaatcccagctacttgggaggctgaggcagaagaatcacttgaacctggaaggtgaagtttgcagtgagccgagattgcaccactgtactccagcctgggtgatagagcgagaccccatctcaaaaataataataaaataaagagggtgtatatggcagggcagtgtgaaatgtggagaaaatacttggtgggaactatcaaagcaagtggatagttggtttttaggactcagaaacaaactagatcaaactagtcatagcctctcttgactgtaaaagtgaacaaagaatcaggagccagatgagctaaaggaagatttggaattaccaactggtgagaagagcacactcataggccatgctcagaattcatctatgctctgtgtagtctggggtgggctgtgaaggtcctggagcagggcagtgggagagtcttcagagagcctggtgtagcagcacagtggggtagtgtgtcattcagaagagcctaccgtggcatctctttggcagtcacaccagggcgttaccaatgtcaggtgtatgtgatatatgtttatttttacacaatcttgtttgttcatgcatttttaatgacttttagagaggtaggtgttagcagtggcttctggatccctttggcaccaagaaggaataataaactttccatataacatagattccacataacatagatcttatccttcaaattcttgtcctctacttcaagtggagtccattcacagactctacatcctagagttatgaaattattaattattattttataaaagctgaatttagttaagtaatagtaactaaacaaagaaagaaagtgatattggatattggaaaagtagtcacagtcttggtatcatgagattttggggttccagttctttagaagtgctttacaaagctcgtaaagatatattactttcctttatacctacttctatactttatcactacctttagtcaataaattctaagtatttctcagtattctttgagctccttctgtatacccaagtgctgtggagaattctagaaaagtatacaatacttgccaatttttagacatacagtcttcttggaaagactaaatttacattaaaaaatgaaaaatagcaacataaacatacaaaagttttaaatggcattacataggaaataggcgtatgtataaaatttattcccataacacattattataatctgtaagaaaaaaagcaaagatgggatgaaagccccaaataaaattaatacctatttattaatcaaagctatactagaaaatatggggaaatacaagaattacatgtgatattcagagagttttcagtctattcttggatatgaggcacacttttgtgagtcatggaaaccaaacagaaagcataggagagatgtcatcaaaactaaaaacctttttaaaaatacatactaaggcttcaccagactgtgttcaacgtctaacctgcaatatccttaggcatcttttgccttcagggtggtctttgctttgtctagttcttgtatggtactctagtatagggctgacatatcactgcaagactcttgtgatagaaccacctagatactgggattatgaagcagcttagtggggaaaaatgaattttgaggtcagaaaaaacaatattcaaatgtcaaatctcattttcactgagcctcattttcctcatatataacatagaaatagtgataataatgcctcatcagtaaggttttgtggagattaaatgaggatatatatgcttatgtatatatttaataaatggtaatacatacttaataagcagtaattattgttattattgcctttgacatgagctgttttagaaccacaatctaaacaggcctcttattagtgcagttgtagccaccaacatagcattgagatctctgcagtgtaaacagtttacaagccatccaataatatatctttacagtagtctatcttaagagacacttactactaataatatttaacattaattctgaaatgtactgtttaccaagcacactcaactatatcacctcatttgatcttcaacctttttggaaagttgttactactattcccattctacacggaaggaaaattaatcagagagggttagtggacttgccctaagatcacaccactaggaagtcactgagcccccaaatcatacaatcagaaagttgctaaaccaaccttgagcccatgtcttctgactgcagacctcatacctttttctcttctctacatgcctcttattatttttttttaatgagatccagtaaaaactgtctttctccagagtctttatttacccacaagatacgtcccattgagaatcatgaaaatattatgactaactagttgatccattatatacatatgtatgccaaggttatgttttccatgcccagtgtttttggtaaagacatgaaattttgttttgtaaaacctgctggattgctatttgttttatcatttgattaggattccacagaatagattgacattaaaaagctgttaactctgttaactccagagggcacagctaatgaaataccccaaaatttgagcactttccaaaaccaccatgtcgtatagaagagttctctattaatcaagatgaaagtatgtcctttatctaaatgaaatctgtaatttgagacaaagatgaaagatcctttggaggataaagcaaaagttgttgtgaaaattctagaaactaaaaagtaaagatagctctactcaatattcatgaagttagactggtgatgcaaatagagattgcaatctcttattttctagtgatttgccttgtagcactcctgtatcagttttacacagattcccgctaaactttaaagagaattactgcaaatcgtacaatttttttaaaaaaaagaaagttgaacatatccaatatgattttctgtcatatttgactgtcaatgttctatctagggatttagaggtttatgattagaggtgcataaataataaaatatggcagggcatgcttgttcacgcctgtattgggaggctgaggcgggcgaatcacgaggtcaggagttgagagcagcctggtcaatatggtgaaaccccgtctgtactaaaaatacaaaaattagctgggcatggtggcacatgcctgtagttccagctactcgggaggatgagacagaagaatcgttgaactggggaggcagaggttgcagtgacccgagtttgcaccactgcacactccagcatgggcgacagaggaacacttcatctcaaaaaaaaaaaaaaaaaaaaaaaaaaagaaagaaagaaaatacaggatacagcacgcataatgtgtaaacgtagatgttgataagtgaagcctttttgtattgaatatagcatactctcaaaaggcagtttgaagagaataactatgaatattggtttaggtttaattttgcttccttgagagagaaatcaaattcctttagcaaagtcatttcataaagaaatgatacaggtcgagtgcggtagctcatgcctataatcccagcactttgggagtccgaggtgggtagatcacaaggtcaggagatcaagaccatcctggccaatgtgggaaaccccgtctctactaaaaatacagcagttagctgggtgtggcggtgtgtgcctgtagtcgtagctacttgggaggctgaggcaggagaattgcctgaaccaggaggcggaggctgagtgagccgagattgcaccactgcactccagcctgggtgacagagcgagattcttgtctcacaaaaaaaaaaaaaaaagaaagaaaagatacaagttttaactcttacccaatttattagaaatccttgccttacacatagcagaaatcctcacctcctgcattgttttgtagaatgtaagagaaaatgaatgtaaattatatgaatgcttacttaatttctttatgtggtaaatgtaacaaatatttgagttgggggaaggtacagaaactcttagtcattttatttaccctactaacacttgacacggtgcctgtagaggtcctcaagaaatgcctgttgagctctttgttaaataagttaacagaaataatctgtctcagaatacactattcattatttaattttttttctatttcttttttcaggccagtcctgctcctataattgtcaacacagatactttggacacaattccttatgtaagtaactttttcattactaccttcttttaaaactgtggtagaacttaattggctgaatttaaattcaattcacatttagtttcacccaaactaaataatcttatggaatgacatgtagttttgtaaattttcttttaataatttctaaatcttgtcttagtcatcaaatatttccctctttcattcatgttttgtaaaacacaagggcccattatgaaacaaaaataaacaacgctgtttaaatagtgttagtttgctaagtggctcactgaaaagagactgaattgctcatagacactagcaaacttctttgggtttcttataaaaggaatattcaagtcaatttctgtgatagtctggaacctaaagtaagtaatcaataaatatttttatggattttattgggcttctaataagaagtggccaaaagtttcgtgagggtagagcctatctatatataatgaaagttatggttttatgaaagcatgagcatgagataataggatcaagcaaaccaatgaagcctaggattctgtacctgtaacacaaccactatgatggcaaaagttcttgaagatagagtctggctgggcagggaagattggagaccagctataggccacaatgtgggtgagtggttgacattatggaggtccaacaaggctttgtgagtgggcgctagctgatgagtggaggatagtgatcaaacaagatgggatagccacagatgcatgctagacagggggtatgaagctgagaagaagggctacaagggtaatggacaacaacaaacagattcctggcctttgattaaatgagtaaaacacagaaagcacttagaacagtacctagcacaaagtaagtgcttggtaagtactggctcttctcagttttagcccacagcctcaaatcccttcaatgaccaagcaaatcacagaaacaaatggagcagtcagagtggggcctgtggggaatagaaagcacatggccatttaaagagagcaactgccacttggaatccactggtgccagatcattttacaaaataagatggaaatttgtacatgtttgcaatttctaaatacaggcaactaattttcaaaagtgcaaacactgtgtctgccaaacaaagtgtgtctagtccataggctgccttttgagagatgttacctcaaatacctcaaaagaactggcggtcctgagcaggttctggcggtcctgagcaggttctgcaatccgggactcagccacaggggagcagaatgtcagaactggagtacaaggttgggacttgattataagaatgaggaactaaaactgggacacagggtcaggacaagaataacagcaagcttgacttaatgctgaatcacctgaactactgaactagggcttcttaaatctttctgaacaagaatagtttgggaccagaccggaaacaaggttaggcttactggaaggagccaagagaccccaacactggaaagtaaagggctctgtagaagcaaacaaagcaatgtcttaaaggtacctacatccactattctcttactcttcctacctttctttacttaccaaacttctgtaacagtgtatgcctaacactgctgtaggcacttaacaaattttaactcatttaatcctcataacaatcctatgaggtaggtactattaatttctctatttttacacttgggaaaaaatgagtcataaagaggtcaagtaactggttcaaggactcacagtaagaggcagagtcaagagtcaatccagatagcttggctgtagagttagaagtcttatttaatttctaacatgctgttacctgtgtttctttcttccctcccttgttttctgcctgtcagcttgggaacatagtttccttacttactcccctgatacatgcagatttggatgagagataacttgtcacagaagcttcaatatattcaggacagggatccatttatatatgaaggaatcctatgtcccaaaaaatctcttcactatagccattgtcaaagcatgtaagcagtgctctcaagaagtaggcctggagcacagagagctgattttgtaagtaagaccactttcttgtggtggatctaaattatttcaaagcctcctattagggttctggtggcgtaactgccagatatcctcatgtagaaataatttatcagtaagatctaagggtcttttgtagacatgttcaattggtatcccaaatgattagctagtaaaatgagtcgcaaataacaaattcatcaaaattcttcccattcttccaaataccaggtttgtatctgactttgagtccttcaaaaattatttttaatcatcttttttgttgttgctgttgagacagagtcttgctctatcacccaggctggagtacaaatggctggagcctgatcttggctcactgcaacctctgcctcccaggttcaagtgactctcttgcctcagcctcccgagtagctgggactacaggagtgcaccaccatgcctggctaatttttttttgttttttgtattttttagtagagacgagtttttgccatgttggccaggctgatcttgaacttctgatctcagtgatctgcccacctcggcctcccaaagtgctgggattacgagtgtaagccactattcctggcctaatcaactttttcatacttaatgtaacccactttgtgcttccttaagggtaaggatctttatagtggtttgtgaggagcttgatatgatgaaaatggcccaattatcatggtagtatgttcttaagtaatttatttaatctctatgcacctaaattaacctataagagaggacttataatacctgcctcagagattttcttagcttctggttgatagcagctaaagtatttatcatttttttgaaaaaaaaaataaacacttatgaggtaaaacatgctaaattctaggagaatggtaaatatgaataccttccccgatgtagaaaaaacatgaatacattatgtattgaaaatggcagatttagtgcatactcattaatgtggataagctttggttcttggcagagtcccaactctcccctttgttcctgactcacggggtaaccttgaacaaattactgttcctttcacagtctattttctcattccccagtgttctatactttgttttcctcttttcttcctcatgttctagttgttcacataatttcagctctatttaatgaaaaaacgatttcagagttccctagggcattttagtcatgttgcgtaagaacatttccttcttaaaaatattatcagaatgccaagctttaacatatattaaagtctttctaaaaaataatttcattgcaagtaaatgtattaattttgctaattagcaaatttgatttttgatagaaatggttcttgtgaaaatggttccttggcacaaatgcaaatgacaattgaatagctacaggaaatttctagggccaaagggaatttttatgtaagtgtcaaacaaaagtacaaaatatatttaaagagacttctttttattaaggaaggtaagttaagagacattagagcttgcattaatgaaggggtcactgaggttcttacatgaaaatgccttaagtaagctctgtcttatatgaggtcatgatatattagggttgggtatgaccttaaatgtgacatagtctagcttctcatgcaaagcaggaatccctatatgaaaattaaaatcacccaagcagaaacaaggaaagatatttttccacttcaatactctctagtttctattttttgctcaatatttttattcttccccattacatgttgaatagtgtttcatgccaggtactgaaagtactttgttcttagggagctcagagtgattagagcctgcttgtgaatccagttccctgaaggttgactcagccaaataataatgctttactctctggtactctgcaaccaactgacattgcgctctcctctcctttcagcagacactttagagttcaatattgaacagcaccctaacaaatagtattctttatgctttagaaaataaaattagagagattctagaatgcttttttattttgctctaaccttctctaatattctttttatattttggtaatattctgacctctttgatagaaatgcactgttgagagaggtatacttgagaatcatgagttttccatcttgttaaatatcttggagttcaatgaacacaaacctttcattttaaagatatggattttctatctcaactagtaaatggtagtgcttgatctaccatttactgttacctcatgtaattgccaatttttggtgtgtaaccacaaccaaaaaaaaatcagcggcaataagcatttttttcttctctatcagttagctaggacagctgcttcaggctgcagaatacagtagtctcaccttatccatggatgacacattccaaatctcctggtggatgcctgaagctgcagataatgccaaatcctatatacatgaattttccatcttaactatcaggcactgtggccataacttttgcagtttggggtgccacagcaaaactaacatgattatatttttccttcttcacaatatcatggatgaaagattcatttttactatagatcttagcagcttcatcatacaatgctgtctcttttcttttttcttaagtcaggaattttcaagttttcccttaaaggaaacactttagggcttctcttaagcatttctgaattgtcagcatcactattcttgtgctttggggccattattaagtaaaataagagttacttgaacacagaaactactataccaggatagtcaatttgatcacccagacagctaataagtgaataaagggcaggtaacatctgcagcacagataccctaaacaaagaaataactcacatcctggaagagatggagtgggacagtgagagatttcatcatactactcagaatagaaagcaatttgcaacttatgaattgtttatttctggaattctccatttaatattttcagacaatggttgacagtagataactgaaactgcagaatgtgaaaccacgaataagtgggtgagtggggtgccattgtaccaggttggctggggcatctctgcttcagaagtttcattctggggaccaggaggtgggacagtagctatccagggtatgttttcatattgtgatagtcaaaggacaagaaatcaagcccgtgacacaaacacagttaaagcttctgctcaccttacatccaccaacacccaattggccagaataagtcatgttgccaagctcgaattaggggaagagtgagtatttgctaaacaataaactagtacatcagggccttaaataaagggctgagaatctgtgtatgtccctttatgagaataaaaaataaaaacaaagcagatataaaagaaaaaatcttgtactttatattgtaggtcaatggcactaaacaaagtgtcagagggacctggttcaactgatagggagagtgaatgtgtagattattgtatgttgtctaagggcaaacactgagaagtaaaagaaacatctagcaagtactggcagtacaatgcctttactttcctataagacactttgttgctgaaattttgtttctagaggtagaaataatagtggagacaagggagaagtttcaggtctcttgcttggaaaaccctcctaggaaagtaagggagagagaaaagtagaagaaaaagagaacacaaataagagttaggttatgaagaatatgagtgggtccttagtagtatatcccccattggatttggctgccaagaaagttatttatgtaaaagttatttgtggacaattataatatcatataatatcagcaacatttttacagagtgctttcaatgtgaaaaggccattggatgcaaacaaaactatgattctggggccaaggacaagagagtgaactaaagggaaaaagatgaaccaaaaaaaaggctgaacacatgagtgtcagtgacaagaaaaaggatactatgggttcagtgacatagagacacaattgaattagcaatgagcttcactcaggagccagagaatgggtttgtgtctaagagatgttttaagtaacatttaaatggcactgctgattgataccagcatcaggaagctgaggacaagagctctctgagaaggaagttgccatattacagaagtgaggtgaccaagcacttgttgtaggtctgtacatttagacattaatttatttgagtgtaaataacatattcttatgatttaggctatgattcacttttgattggaccattttccataattgcctctgatgggaaagaaaggagaaatatgtgtgttcctttgaaccatcctggcagtgattaataatggtatgatattttggaagaatttgctgattttagtacatttatctttcaacaaacatgctttcttctttttgtggtttttcccatggacattgttaaaactatattgttaatgttttcatctattgggaatgcagttccaaattttaaaatccttacttaccaggaaacagctttattttgtctcaactactcctatgaagcaataggaatttagcaatagaggcaaagctgtcaatatttgctctggtgtcaaacctagccaatctaaattcatttctcaactgccacaatcagcagaatccctactcttaactgcttgttgctttgctttataagcaagaggtgggctcacgcctgtaatcccagcactttgggaggccgaggcgggtggatcaactgaggtcaggagtttgagactagcctggccgacatgctgaaaccctgtctctactaaaaatagaaaaaaattacccaggtgtggtggtgggcacctgtaatcccagctgcttgggaggctgagacaagagaatcacttgaacccgggaggcggaggttgcaatgagctgagattgtgccactgcactcccaccctgggtgagagagtgagactccacctcagggaaaaaaaaaagaaaatgaagtttctgattcactaggtctgggatgcgtcagtctgcatttctaataagttgccaggtgaggttgatgctgcttagttgtacatcatactttgagtaacaaaagagtataaagagagaaactagcctttggctttatgcacgactgggttgtaaacccacctctgccagttagttcttttcttgagttttggttaagtcacatcacctctctaagcctctgtttcattatatataaaataggaataatactacctgccttgcaggggttgttatgaatactcatcctagtatgcagaaggggcttaatgaatattcatcgtgagactgggggtaaggtgggtgtatctatgataaaataaaacatttctctgactgaatcttgaactggtgagtcaaaatgagaagccactgctagttcaggagttgggccagtagcagttacataggtccatggcttacctacatctagacctttgctgctcagagtgtgacccatggactaacagcagtgatattacctgggagtttgtgagcaatagaatctaaagttccaccaaagacctactaaatcagaaactatgttttaaaataaaaacttcagtgatttgtatgcatatttaagtttgagaaacactgctcaataagaaacttattttttggtttggatcctgatgttttgttccttcactacatgttttggcctgcagttgagatagctaccattttctaactcttttactttaaacatatacacatctataaggaaagagctctatttattcaacaaattgaacacactatgaacaactactatgttgtcctactttctagacctttgctttccaaaaaagtagttataagtcacatatggttatttaaatttaattaaaataaaataatacaaaattacaaattcattcctcagttgcactagccacatttcaagtgcttagtagccagtagggctaatgggtattgtattaaacaatgcagatatggaattgtccattattccagaaagttctatcagacagagctgttgtaggcaatacataataagaaagaaatagaagagataagggagctaatttgttatcaagaaatgattatactctaggttctttatatgtgagagtgtatatatatatatatatatatagagagagagagagagagagagagaacctaattaatcatcaaaactatccttccaatttttgtgtgttggtttaatttcctccttttttaagttgactattttcaaatcttctaaatagtcagcactctccaggaattgtgggatatgctcacatggagacatgatccctgttctcatggctcttaaaagcttaactttgaagactcttaaacatgatacacatggaggcaaatgtcagcaattactgaaagctttcttaaaagttcagtgattcatcattttcttattgtaaaattataaaattcctattttggccaggtgcggtggctcacgcctgtaatcccagcattatgggaggccgaggtgggcaaattacctgaggttagaagttcgagaccagcctggccaacatggtgaaaccgtgtctctaataaaaatacaaaaattagccgggcacagtggcagacacctgtaatcccagctacttgggaggctgaggcaggagaatcagttgaacctgggaggcagcagttgcagtgagccgggatcatgccattgcactccagcctgggtgacagagcaagactccatttcaaaaaaaaaaaaagttctatttagattgggatgattttttaaaagccaagtcaaaacaaaaacaaaaacaaaaaaaaaccaacagaagacctgacctacttaccattcacaaactaattcactttttttgccttgcattacccttgcagagggcagtttgttgactactgtactcatagcttctcatttactgggaagcccttacttaggcttgtcattttggatttagagccaacgggaaaataaaacggttgtccaagtgaagaatgtgactgttatgtgaaagtagcaatattggcccgtctttcttagaggggttcccctaaaagccttacctacctggacagagaaaccactcttattccaagaagtgtaacctagcagagcacttttaagaacaagggggaaataatcctgaaaaatatttgtgtagcttctcaagcataaagctgctcaaggtgcagtctgtgaactggcagcgtcaggtctcacaggtcaggttgttagaatcgtgggatctccagctcctccccaaagctatagaatcagaatctctgagagtggaaccaaaaaatttgttcttaaaagtacctcaggtgattcttaggattgctgaagtttgagagatgctgctctacaatttacaagagatttttaaaagctagtgggagaccttaagcagctctagttgctaaactgaagtggaggtgaaagtaggaaatactgcatacaggaaggacaaaataaacatatctaaggcacaatgatcagacatttagcatgaatctgaatgagtgtttaatcctggtgggttttttttttcttctttttgaatcacttgggacctttaaacacattgtttcctagtctaatgaatagacatgttaatgaaaatggataatgcatggtgaaaagcacatgttgttaaacacgccttgcttatctctgcctggcttattcttacatatcctaaagggttcagcttaaattatgcttcttctaggaaagtgagattcagggtagagttcctcttaggagcttccccgaaggctcttcttcctatcaaggtagttatcacactgaattgcagctatttcattaatagttgatctttctctctagaatgtaaacttcatgaagcacaaagaaaatattgctttatctttcccacagttatacctcagaaaccctgcacatttttactgactggtggaaggcaggcagacaggcaggaagggaagaaactacaataataagccatcctatttcaaggaatcagagaaagggagaattttgtctagctcttaaagaataaaaagacatttctaggcaaagtaggtaaaaggcattccaagaagagggaagtgcaagtacaaaggtcagagttcaggcaactcacatgtcctgagtttcatccatatggagcacagagcaatagcataatatgaggttgggttgagtctgattgtgaaggccttttttgcttggtatcggctttggactttaacatgtaggcattgctggtagcattatcttctcatatatttaggatattatgacatctgattttatcactctatttctaggtcttaatttttatctgctatattgtaggtgccctgaaacatattttgaataaagccaaagacttaatagtgatcacctaagaacaactgacacaagctcctcttgagccttttctacattttcctatatccttacctttgttcaccctgttcaattagtccacaatgccttttcctccattcccatcttttagatctcaataaactgccaccaccatcaggaagcctccatcaatccctccaggtcatattaatgtctccttcctccttgattccatagtatttcaatcatgggagattgttattttagtagaaagagaatggagtctgggctcttttgattcaaccatataccagctggataactaaaaaaattaacttctctgacccttttccctcagctgtaaggagagacaataaaaactaccttgcatattgtattctttaggagacaggttcagttacatataacagagaccaaaataatgatgtgtttgcaagataggaatgtatttctttcatatatgacagtccctaggttagctgtccagagctagaatgtctatgctgctccacaaggtcttaaaaggacccaagtaccttttattttcttttttaccacccttgggggttgcccttgcacatgtagtccaagaggcctaccaccatgctgacgtgctaaatagcaggttaaaagaagtacagagatggacattgttcgtccgtttaaagcaatgtctgaaaagttgtaagcatgatttttccctcatacctcaaagattaggcacaaagccattcctagatgcaaagggagactgagccatataacctttattctgagatgccctgggctcagataaaagtgagggatcccgttattatgggagaaaagggtaatgaatattggggagaagcagcggtttctaccacacaacatgttagtagtattcttcaatgtcggaagcttctgcccaggggatgctgaagcagatccatcaagtgctagcctttatagtttttcatcatttctaatttcaacattttatatataaaacactgtattgttgcaattgtatcagtatactatatctatacagactagcacatatcggggagcacgcttgcaaacattttactggtaggaacactaaaaaattttcagaaaccactggttgtaagcattggagataatatttagacattgcttggctcataatagatgttcaacaaatgatggccattggccattgttgcagtcctaaattagtatttaccatattcctctctatttattaataattcttagtacttgatattcaccagatacaattgtgctttacttatctttaaattccaggctgggcatggtgactcatgcctgtaatcccagcactttgggaggccgaggtgggaggatcacctgaggtcagggagttcaagagcagcctggccaaaatggtgaaaccctgtctctggtaaaaatacaaaaattagctagctgtagtgatgcctgcttttaatctcagctactccggaggctgatgcatgagaatcacttgaacccagaaggttgaggttgcagtgagccgagatcacacccctacactgcagcctggttgacagagacttggtctcaaataataataataataaaaatgataaaataaataaattccataaatagccatagtccatgcatgtagtgggatttcaataaaagtttttttcaatgttacactcaattgtttatttgaatttgactgttttaatagagtgaatttttatttgaaaagtaattcatcaggtaaatatgtgtgttttaatttaatctacatgatcatgtggatcaatgtgcatgtgaccacctaaaagtgggctgcccaatttattggctctttatagtttaacttgctcatagataagcactcttttcaaagtgtggtcgtttacaaatgcttttttctttctcaaatatatatttgaaagaaaatgtaggcagtcatagatgatgacagggaagacagtggctagttgagtgaaaagaaagaggaagagtgacagttgagtaaaaatcaaggagaggaaatgagactggagtaataaagagaaatggcttaacatttttatgttactttcctcaattttaacagtgtaatatttggattgagctaaaaactctatttccaaaaaaaaaaaagcaaatactaaaacatatttctggggccccaggaactttatgtgatgcttggggtaatttataacttcatctctcccttgttaaatcttgcttggcttttttttttttctttttcttttttgagacagggtctcactctgttgcctaggccagagtgcagtggtgccatcagggctcactgtagcctggacctcctgggctcaaacaatcctttcatctcagttcagcctcacaagtagctgggactacaggcgtgtgccaccacatccaggtaatttttgtatttttcatagacatagagttttgccatgttgcccaggctggtcttgaattcccaggctcaagcaatccgcacacctcggcctctcaaagtattggaatgacaggtgtaagcctccatgcctggccttgctgggcttttaaattgactttttgacactgatattttttaggggccagttcctgagggataactataggtatttttctctgtgaaatcagacagctaccttgcagctaccttgtttcagtgactgacttccctctagtgtctttctttttcttttcttttctttcttttttttttttttttttttttaggcagagtcttgccctgtcgcccgggctggagtgcagtggtgtgatctctcggctcactgcaacctctgcctcccgggttcaagcgattctcttgcctcagcctcctgagtagctgggattacaggtgccccaccaccacacccggctaattttttctctttctttttagtaaagacagggtttcactgtgttggccaggctggtcttgaacgcttgacctcatgatccacctgcttcagcctcccaaagtgctgggattataggcataagccaccatgcccggctgtgtctttccttttctaagtgtatcatatctcagccctaaattacttcccctcagttgtcacttggaagttccaagtttgtttaaatacacgaagagctggatgaactttgatgaactttacttttggtgacaaagtatagtttcctcttcatgaacagcattaatggaaatgcattttgattatcctaatttctaccaagtgccctaaatgatgttttgcccccaagtattttattttggaaactcagtagcataaaactgaaacattaccaatctaatgagctgtcacatgaaggaaaagtagtaatgaaataacaaattcagataggtcaaatggcatgctgagaggaacgaataaacaatagcgcattataatcagtatctctttaaagacaatctcaggaaattttcgtggttttcttgtttttaaagcaaattgctaatacttttgctgatgtctcaaagcagtggctctcaaccttgcccccacattgtaattgcttcccgcttcaaaaatactgatgctgggctgggcacagtggctcacacctgtaatcccaggactttgggaggccgaggcaggcgaatcacgaggtcaggagatggagaccatcgtggacaacacagtgaaaccccgtctctactaaaaatacaaaaaattagccgggggtggtggcacgcgcctgtagtctcagctactcaggaggctgaggcaggggaatcgctggaacccgggaggcggaggttgcagtgagccgagatgatgccactgcacactagcctgagtgacagagtgagactccatctcaaaaaaaaaaacaaaaaaaaaaacatactgatgcttcaaccccaggaataaagattcctgtttaatgggtctgagtctgggtataagaattgggatgttaaaaaatctctccaagtgataaataactaaataactaagttaaagcatctagttcttctaacctgctaacctactatgattctgggaaggccttccaacagaaatgggtggttgggttagtgtgcttattatataggcaataaactgagctgccacctgttaacttggtaacagacacagctactgctaagaaagctagctagctatgcaaggcacatgccctcaggctcagacttgatcaagttaatgaaacacccctccaagggttgttctgctgacacatgtcaccatttatgagttgtaattgggtttattaaaaaaggagtcatggcctgtgctttagcagtttggcctaagggcccccaaaaatactgagagaagaaatttgcaagccaaactacagctgaaaactagactggggttgaccttgaggtaggttattgtagaacctgaggctcaatgtaagaaaaaaatcaaatatcaaaaccctgcccaagtccaccagaagctttctctgacaaccaacctcactgatatttccctgtctttgaatgtctattgcacatactttaagaaggacaatggccaaaagtttatttaactcaggtttattcgatggcagtttgatttaataaatttatgctttgatagtgaaattatctggattctttaaaatggaatgttattttggtatggccaagggcacagacttggcatctaagagaactaactctctcttttgtgaacttgaggaaattacttaagctctctgagccttagttgtttttttttttttttaataaaatggagaaaggtggaaatatctcacagtacagatatgaaaatgatctgaacaatgtcattgtaggaataaaaatagctattactgaaccatactctaggcactattaaaattttgtacatatgttaatttattcaatcttcacagtaaccatacaaagtatattattgttacttctataggtaagaagttgtaggcaaagagattaataacttatccaaggtcacacagcagatagtaaggggcttgtaataagaatagcattatactaccctgcctctcggtagttgtaataaaagttaatttgctaaattatttaacagactgaaggagacacttaaaagcaactaaggtccagcacagtgttgttgaacacttcattaataaaaggttgaagtgctacaaagagaaacacattgttcgagattgtggttgacaggaaatttgcgagtatacatgttgtgaaagtttaaagtcaacctgggaagagatttttttttttaagacaggttctccctctgtcacctagactagagtacagtggtgctatcatgtctcactgcaacctcaagctcctgggctcaagtgatccttctgccttaggctctcaaagtgctgagaagagatctttaaaatgcagttagtgtcatcaaaaagggtcaaactctgtaaagtatttgaagagatttattctgaatcaaatatgaaacctacggccctcgatacagctccaggagaccctgagaacatgtgcccaagatggtcaggctacagtttggttttatacattttatggagacataagatatcaatcaatacatttgtttgttcagtccattggttcagtccaaaaaagtggaacaacttgaagagagtagggggtgggctttcagttggtaggtggattcaaagattttctgattggcattggttgaaagagtttatctaaagacctggaatgaatagaagggagtgcctgggttaaggtaagaggttgtggagaccaaggttcttattaggcaggtgaagcttccaggccgcaggcttcacagcgaataatagattgtaaatgtttcttatcaggctttaaaaggtgccagactcttagttaattctctcttggatcatgaaaaagtcctggaaaggggaggggattttctacagaatgtagattttccccataagagaaaactttgtgtggccatttcaaattatgtcaaataaatatattttggggtaagatgctttaatttctttcagggcctgctctctgtcatgttggtattttattactctaaatagtcagctttgtcagtcttctattgtaacgttaatgctggtcagctgtgcctgaattccaacgggaggaggaggagggattaatgaagcatgtccaaccacccattcccatcatggcctgaactagtgttttgggtttactttagaatgcacttggcttggaggaggggtccatttggttggttggggggcttagaattttatttttggtttacattagtgatgtcactttgtctaatacataataattagaagttgagagtgatctgggacacatggggtgaaagtcctgaaccaacgcactttcgttagcagtggtgaatccatacggggttctgcagcaacctcaattcttgccttctcagaagaaagaattcaactgatgggcagaaggcagaaggagggaccaaggcaagttttacagcaggagtgaaagtttattaaaaagctttagagtgggaatgaaaggaaatacacttggaggctggccaagtgggcaatttgagagatcatgtgcacggcttgatcttttgacttggggttttatatgttgttggcatcctttcagggtcttgcatctcttcccccatgattcttccctcggggtgggctgtccacatgtgcagtggcctgtcagcagttgggaggggagcaggtgctgcatgtgaggcattcttcccttaccagcccaatgtccctagaaggtcctatgccagttaaaatgccactttgcctcttaatgtgtatctttgagcccactctgccagctcctaagatcttgtcaggaagctgctgatcaccagtgtcaggtttttgctatttattgggaagctgcctttccctgacactggtgaaacggccttgttgtctggagtaacaactgagatttactgtctcacagatgacaaggatgcagacgcacaaaaagtgagattgagagtggaagtttaataggcgaaagaaagagaatagctctttcctgcagaaaggggttccagaaaagtgggttgctggatctgtggtgaaatgcattggggttcacagatgagctggtgaggaggcagtgtctgatttacatagggtgcaaaaaactggttagaccaggtgtgccatttgcacaggggatgaattttttgtaggccccaccctaatcttttatcctgcaggcaggttctctgcctgagctatgccatgttacccatttctttgttcctgtacatgtggtagcaaagaaagggaagatggagcatccatgttggacatgcctggcccccagctagcccttttctattggcacagctgccagcattcccctgtgcaagcttccagcttgcttatttatgttttcagcttgatttttcaggctgctctttattaggagaaaaataatttcttgggctgcgttttgctagaagggacgctctgccaaggactctttgccctcactatctgcctaaacaatttctttctacctcctgtatcactgactgtgaccaattattattttagagtagcggttaactacctgaccatcacctgatggttacctgacatttctagtagtaggggttgtggctagggaggaggtctctcctgccctgctcatgtctgactagctacctactataacactttcatccatgttactttaattagttctcaaaattgtggaggaagctatcgttttttagctaaggaaactgaaaggtgctttgaggttgtgaagtttccaagttcatatcattttgtaatggcaaattggacttgtgctcaggccctctgattcctcccacctaaatggttattttctgttgggcaggtctttatgggcattgctggaactaagcttccttgtcattcatcagatgggggagctctcctatatcatggccttgatctcttcaatattttattcttatttataaactctcttttagttcagactagtatagcagaatactgaagactgggtggcttaaataacataaatttatttcttatcatgctgactgggaagtctgagatcagggtgccagcatggtttggttctggtgaggcctgtcttgctggtttgcagataaccatccttctgctgtgtcctcacatagagaagagcagagagtgggaagcaagctctttccttcatcttcttctaagaactctaatcccataatgagggctccacctcataacctaatggtctcccattgtccccatctgaaaattctgttgggaattaggatttcagtatatgaattttaggggggtaaaattttagggtgattcagtccgtagaaatctctgaatttcaaacaactccaaggtaatttgattaactcatgtaataaaagttcttgaatgcctacttgtgccaggtactgttacctaggtttactgtaagcaagacataatttccactcttgtggaaattatgagctttcattcttgtcaaagtaggtaacaaacaaaaaggaagctataaaatagtaagcgctctgaaaaaaatgaagcaaagtgctttgaggggagggaagtgcagtggcttctttagaaagatagtatggcaaagatctcttggagaaggtgatacgagaattgtaacctgaatacaagagaaatcctactgcgcacagatccttgtgttgcagtttttcttttatatatatttttttccttatttcacatagtctggctttagtttctatgttgtttgtttctcttccttccccatcttggtggtaaattacctcactatcaactcaactcacattacatttctgggagtctttctgtcctggtgtgtatgtgatcagtaatccttacatagtatgtttgctaaatgtgtcctgtctctgtgctatcttcttcttcattgtcaagacccttggtctactactctcctggactccctcatttgcctctgaacttgtctctctgattttgattttccttcctcctgtccacatagctctctgagttcttattccagaaaactacctatggtcccatcttttaactacctgaaagttttcagtggtcttgcattgactcataaaatataaactcactagtatgatatttcagagtttttactggtgccttatcttcctccattcctttcacacaatattccctatgattccactacacagttctcccagtttcctgaatacactgtattcttgatgatttccatgaacacaatagcccttctttaatgcccaatctcttattttgtacctgataatctcctacccgtccttcagtatctacttcaaaagccagtcattcttgaagcacttccccatttctgtagttgtatcactgagaattaggatcagtggcatacaactcccaaagtaagagtgacaaaatcagtgagaaaaaatgatttttttcccctcatgtaaatgaagttgtaagctagacaacccatggcttgtaaggtgctccatagttaagatccagcatcattctatttaactcttctaacatcatagcttgaggctcccttttgctaggttacctaatggttcaaatagctgctgtagcgccaaccattatattacatttcaggaagtaagaagggacaataagaaggttgtgctcttcacctttaaggacacttccagaagttacccagaagaatcaattcatccattggttgaagacaatcccgtgtctatacctagctgagagacgctagtgtgtttaattttttagcagggtaacaatttctaatgagaagaagacaatgtatattctgaggtagttaattgtctttgctacattctctgaacagtattattagtatccttcatgaagaagtttattctttttattcttcaagttcttgtatttccactataaccaatactgctatagaagatactcatgttgtctttatgatttggaccttgccttgtctccactgttaatttccagtgcatatcctatctaaggtttcctgttcgtctcactgtttcacacttttgtgaaattgcataattttttttctttaactggaaagctcttatttcactcccacctctactttatgagctctttccttattcatccgctttccatatggagttgatcatgtattcagttttgtgctcacatatctttcccctaagtagaccataagctccttgaacatactgtgtcttatgtatttaaaaattcccagcacttagaaccaggaaaaaaaatcacagctactcaatgcattcttgaataaattaataaaatgtacaactaaggtacatattcatttattttatacttttacaaacatttatttattactggcataacaaatatcatgcggcaagctagatgctgagatatagcagcaaacaagatcaacattgcccctccctcatggagtttaaattcatgttgagggatagagataataaacaacagataattatagttgtgagagagaataataacagagcaggaagaaaacaaactactaatgatgctgtggggctcctagtaggttgtatcttagttattttgtaaacatatttagttcttctttcttaatgaaaaaggtagatgaagaagtttactgttctatcatgacaggctcatgcctttgtgtatggctaccaccaaaaaaattgtaaattaccttctttaagttcattggcttgaaaaattataacttgcaaagcttcacatgtggagatttatgtgattcttgacattaatgccttaaaataaattattgtgctgaattaaacatgattaaaattctgggatattcatctctcttgactagcttaaatgtttataatgagaaaacttcacttaatcataaaaatcatttatatttattgagtgcttactcagtactgggtactgttttacatgctttacatgtgttaattaatttgatcctcacaaccaccattatagttagatattgatcttatcctcatttgatgatttaaaaaatgatacaagaaaaagttaactaatgtggccaaggtcaagtagttggtaagagaaggagccagtactcaaacccaagcagtgactgtgctctaaacccttactacttgagagaggggtcttcaaaccagtggcattagcatcacttgggagcttgtaaaaatgtaggatctgaggcccaacccagaccttctgaatctgcattttaacaagatccctgcattttaacaagataccacataagtgctcactcagagagtctgctttccatttctcttattctatatcacaacgctacatcaattctgggaatctgcccacttattgagatttaattaaaatattagtcagaaatattgaccctgttgacctctgtttctgtaaaccacttgggttacgtggatcaagagaaatatggtatcatcgcttcattaaagtagttaaaccatgatactggaaaaaatttggaagcaggaggttagatgccaaagcaagaagaacattttaaatcctccattgattttctttctctgtgttcgctcttttttattacagggatacctgccagcatcattttcttctttttctggtttataacttttccattaaaaaataatttgaaagacaatatggccaaagaattttatctggacctttcttacaggactttgtcattttgtctctcagttatttgagtgcttaccaggatataattataattcccagcatctatagagtacatatgatatagcaggaactgtgccaagtggtttttttccttagataatttatttgatcctcaccacagctttttaatggagatatgattgtggacctcattcaaggaatgagaaagctgaggcccagaatgtttaaaactatacccaaggctcccagtttaggcacactgaagctaaagttgaagccaggcgacatcaatacagagcccaccagctttaccaatgtactacactggcctgccatgatttcattacaagcattgggctgaaattagcataagcagtagtagggtagtcctttaaattttttttctggattctaaaagacagttattatcttacctgtgtttatgaattttgattttggtctctcaaaattatgctttgttaaaatgataaatgtttccagcattttaatgttcaaacaacccacttttctttcatgtatcatatcacatccgaatgtgccaactttatttagaaatatgtgggcttcatttcttaggatcacttcaccaaactccaagaaccacttggaattatttttccctgaattggcatgagctacatataaattggcaatacatagttgggagtaaaattctgattaaagtcttgttcccgatagataataactaacaattgagcagctgccaaacagcaccaattgaataagtgccaatgagatccaagatgaatgtgtcaaggactaatgtactgagaacaattagtccctaaatcccttttaatcatagtaagtccatgaccaatgcagttaaaacagccatgattgactctaaccaaaaaaagcaataggggaattccataaaatgtttccaaataagcaagttcagtggaggctggagatagagtacggaagagatggatagttaagggcattagggaaataagagagtccatcatgtcagtgatgcaaccagatgagtcagagttttagaggaaaccaatcatgaaatagtttgtgatactgatttaaatatatctaacaccagataatcagataatacaacattccaccatagatccaagactttgagtccagattttgtggtgtgaaaaaatataatttactcagtcaacatacatttttttttttttttttttgagatggagtctcactctgtcgcccaggctatagtgcagtggtgtgatcttagttcattgcaacctccgcctcccgagttcaagtgattctcctgcctcagcctcctgagcagctgggtgtacaggcgtgtaccaccacagctagctaatttttgtatttttagtagagacaaggtttcattatgtcggccagggtggtctcctgaccttgtgatccgcctacattggcctcccaaagtgctgggattacaggtgtgagccaccacacccagccaatatacatattttttaaagcaccaactctgcctggcacagggctagctgttgaaatactgagataagtgaggtagtttctgccctcaagatgattatagtttaatataagattattgtgaacaaataactatattcttacagatgctgtgattaaagaaaataaatggctcagtgggggcacaaacataagggggttcaatcctctttgcagttttccatgatatacactcatgacctcctctaaggcctggtttccttcatatccattgtgtgtctctcttcctaggccttattccctctgatcacacagaatttccttttgcaattctctgatcttttctacctgtatgcttttgcactaatttttgtctacgtctaatatgtctttttctttcatttcacctgtcaaaatgtggtttatttttggagtgggatctcctgaaatgccacctcctccatgaagcctcacccctcctcctaccatgtacaccctcttccttgttctgaggtacttttttaaaattttaattaattaattaattaattaatttttaagatggagcctggctctgttgccaagctggagtgtagtggcacgatctcggctcactgcaatctccgactcctgggttcaagccattctcctgccccagcctccggagtgattgggattacaggcgcccaccaccacacccagctaatttttgtattttcagtagagacggggtttcaccatgttggccaggatggtctcgatctcctgacctcatgtgccgcctgccttggcctcccaaagtgctaggattacagatgtgagccactgtgcccagtcattccaaggcacattaaacttgcacacatcacatcatatttgtttatatatctgtaactccctgaggcaaacactgtttccttatctgccccaggattaaacagacttgtagtaaattgtttttatttttgtttttttgatagttaaaaggattaaacaaattgatttaaaatcattcttgaacctaattactttctgggcacatagtatgagtagtcagtttatgaactgtacaatgcatatgttattagaaatagtatttttatttgatcctccactgacctatttgcaatttaaagtcctgtttgtttgacctaccttcacattgttagggatttatgtgacattttgatccctgaattaggatgtgtgagtcgagtcctgtgtgaacaattaactttcttaaaacttcatgctacttttagggagtacctgtttaaggtagctgagtggttagacatgctggcagaccactctgaagagctgaattaacagagaatctgtaatctgctgttacaaacaaatgaaaaccaagaagtaaaattaaataaatatcatccctagtaacatcatagcacaaaaaatatttatgttagggacttaaaaaatgtgcgaaccctggttaaaaattagttagaagtctaaccaaattttaaataaaagataaacaataaactatccaaagaaaatgtttaggctgggtgcagcagctcacgcctgtaatcccaacgctttgggaggccaaggcaggcggatcacttgaggtcaggagtttgacaccagcctggccaacatggggaaactccgtctctactaaaaatacaaaaattagccaggcgtggtggcctgtgcctgtaatcccagctacttgttaggctgaggcagcagaattgcttgaactctggaagaggaggttacagtgagctgagattgtgccactgcacttcggcctgggcaacaaagtgagcaaagcaagactccatcccaggggaaaaaaaaaaaaagacaaaagaaaatgtttcatgttatatatttatttaagaaatatattttggagtaccttctctatatagagtgtgattaatggtatggaatgcataaagatgaaaaatatagagaatttttgtcctctaaagaacatacattggggaaaaggacacgatagggaggaatgagagtttaaatgtcctgtcactgttcttattctatcacagtggcatcactgatagcaagagagtccactaaaggaaacgactgcccttgaatgatattctagtggaataatcaatactagaatattgtgagcaccatcgagcaggtcattcaggacaattaaaaatcgtgacacgagatcttcctggttttgggaacaactgtctccagatatacagagcaggattttaagttggagaaactgtgaccaacttccctgaacctagctttctcagttgtcaaatgaagctgaataatctctgttgtacagtatgtgtgtgtgatatgcatgtttgtctacttagataaataagggaatgcatagaaaacatattagaagctctcaaatgctattcaaatatgttattaataatccattaatgtattacagaaatattcactgagggactttactgtgtgccagaccttagctgaggtactgatgcaacaaagaggaatgagatagagactatggcttcaagaaggccttagatttgtagatgataaagatatgtaaacagaccaacaaaacttagtatggtaactgtgaagagggagtaagaagtacactggaatgcaaacaagggagtaattagtattgtttaggagttcaggaaaggcaaatcatctttgtaaactaaatttaaagggcaagaaattgtcttcaaaggagaggggacttgggggaagaacaatccatggggataagacagtcatatacaaagaaagatcagatacatgaaaaaggataggtaattcagtaaactgttttcagtttggtgtttcaggaataagatccgtaagattagaaacagtgagaggatgcagaacaggtggctgttcctgcagcagtagagcgcatggtataatagttaagagcattgactcaagccaaactgcagggatttgaatttaggttctgcaacctgtgtgaccttgagcagggacttagtttctttttctgtgagttgggggtaataataatatctatcacataggattaagaatgacatcagttaatatgtataaaatattgagaaaagtgcctggcacatagtacaaagtgtatgtcttagctgtcattatcatgattttccccagccaattcctaggaaatgatgtacacagctgcaagaccatttatcttttattctgacattctaacttactattttattcaataattcctaagaaaaatgtgaagtagaaattgaaagatcaaacaaacagcctcttaagaccttaggaggtttgtcaggctggttcagtgtaacaaaagcagcctaggattgactggactcaactggggcatctgactgttagctggctaagcttctcactgatgcaacttcagtcaatgcctggacctctcaggaatctggaaataaccgctctcaacttcttctagcataggtcagaactctctgctgcatccttcctcaaagtcttcataaccttatagccagttatgtctggggaacagtggggacagacaatgtgggaggagttaggggaaggcaggaagttgcatgggtggggaagcactctgtcctccaccctctacgtctttctgccataaacctggaggcctaaaccctcacccttgagtggaaaggcaggcctccattaaagtaggctgggttccttaatgggctaatataagcatgtgtgccagggaaggagtggaagagaggatggggtctttatatttgtgcatgattaaaaggtgcataatttttgccagatgcactggctcctgcctgtaatcccagaactttgggaggctgaggggccagatcacctgaggtcaggagtttgaggccagcctggccaacatgccgaaaccccatcgctactaaaaatacagaaattagctgggcatggtgacatgcgcctgtagtcccagctacttgggaggctgaggcaggagaatctgttgaacccaggaggcggaggttgcagtgagccaatattgtgccactgcaatccagcctggatgacagagtgagactctgcctcaaaaaaaaaaaaaaaaaagtcacataaattttcccaattaatgatcttatgagaaagacatgtgtgcctctgagcacaggcagaaacaggaggttgtgatgggctggctgtgacccaccaccaagtaacatgacactctggtcattgtacgtagggtaataaaagtggatcttagtggctagaaaacacagagaaatatcttaccagcagttaattttttttagaaaatatattgtttagaatcccatgcgcagaaaaacacattattctctctcaatcaatgtcttatcaagggcaaaagcattttactcgattccatgatgctacttggtctgactactctcaactcctacctcactactggacagtaagtcctgtttttagagagccctacacaaggaagcatgacaaatcctgttgacatcccatctcagtattgaatcattccttataagtcccagttagtgcttatcttaatattatttgggagctgaacaataatagatcctactacattttggcctgtccaggaacctgacccagttgtactcaccacactggaggaaggtttaacaaccaaaggacgagctataagttgctcttatgcaaacatgatgagtttcacaaaatatacccaagtattaaactcattaacatcttcattatgccacacattagccaaggattttatcactttttttgttcatttgcagttttaccaaattggtgatctgctcttagtatctttccaattaataggatttttaatagtcagtaaattagttttaaacctatctttctgcatccatcattaagctctagagtgaatttttataaattgatgagagtggggtaagtggaagctacattgtgtgactttgtacacatccactgatctctccaggtgagcctcaggttctcaggctataagagcagaatactgctactcatcttccaagctgtggtgacataaggttaggtgatacatgtgcaaaatattttgtaaaatttcctgctcagaaaagattttagatagtactataattgttgttaagtatctaaggaagagaaaatcgacattttatagccctttcttatgtcttccttgtcatatgccttatttatgaatcgtatttgaattctgaattgtagtcatagatgtaaaaaggtaaaaaagatattatagtacagtgtctcaattaaatgtcatcagaaagtaatatttatataaataccagaacttggccgggcatggtggcatacacctgtaatcccagcactttgggaggccaaggcaggtggatcacctgaggacaggagttcgagatcagactggccaacatggtgaaaccccatctctactaaatacaaaaaattagccaggtgtggtggcacatgcctgtaataccagctacttgggaggctgaggcaggagaatcgcttgaacccaggaggtggaggttgcagtgagccgagatcgcaccattgcactccagcctgggcaacaagagtgaaagtctgtttaaaaaaaaataaaaaaaatagaacttaaattttacctgtaatacattgctatgttaattttaatatagtattattatgctaatattgttactattagtttttagtaatttatctaataacataatatctataaatgcttagaagttataaaaaatattaaatataattgtgtatatatttcaattttaatgttatctgagggccaaatttatctatcattccttcacttagtaagcacttgctaagttctttacatgagacaaacgtggcagtagtcactgtggataagcaaagagagtccttgccttcaaattgtaatgctaaccccaactcccaattcacgtaaaagaaaatattagctgatattttctttaaaagttgaacattcttcttgataataggatctgacatgataagaaaattttcttaaaatgctgtacaggtgacttaaactgggcagccagctagaaggaaacttttgatagaaaatggcctggaggaaacaaagaaactttgctacttagcactttacatagatagcattaattgagaatagctgcttcttaatattattattattattatttgagatggaatctcactctgttgcccagactggagtgcagtggtgcgatctcagctcaccacagcctccacctcctaggttcaagcgattctcctgcctcagcctcctgagtagctgggactacaggcgcgtgccaccatgcctggctaatttttgtatttttagtatagatggggtttcactatgttggccaggctggtcttgaactcctgacctcatgatccacccaccttggcctcccaaagtgctgggattacaggcccactgcgcccagcctaacattaaattttaatggttacacagatacaggcgttttgatttgtttgtttcacccaatcaggatgcttaagttcatgcatgtgaccaggtgcagtgcctcatgcctgtaatcccaacactttgagaggttgaggcaggtggatcacttcagcccaggagttcaagagcagcttgggtaacacagtgagactctgtctctaccaaaaaaaaaagtaaaaaaaaaaaaaaacatcagctgggcatggtggcatgcaccatgcacctgtagtcccagctacttaggagactaaggtgggagaatcgcttgagcctggaggtgaaaactgcgctgagctgtgatcatactactgaatttcagcctgggtaacagagctagaccctgtcaaaaaaaaaaaaaaaaaaaaagaaaagaaaaagaaaaaaaaagcacgtgacactttttaagctcttataaattcttagtcatataaatggttggtattcttaatcccctaaactcatttggtagctgtaatttttatacataattgagcttttatttctctttcattaggaaaccttcttaagtgtgtaattgttatccatgttagaagattgatgttattccctcagcacataaaattatagaatagcattgcccaaattatagttttgttttatgtatccctcttttaatttttaattgagtttgctagcaccaggagtgaaacatagaaaccaacataagtaagttttggtgtatgtgtgtgatttgtgattctgtgtttagagtcattaaggtaattagaaaacctatggtaaatagtaaatctctagcttctgtgtgaagcagtgagtattatagatacttactaagcacttactatgtgcagctccaggttctgtgagaggagtacataaatcggtaatctgtggtctagtaccataaggaattttgtctaggagatataagagaagttcataaccagagttcaagttatgaagtgatgagtctcagtacagagcctgatacttaatgaatatttgtggaatgaatatacgaacacattaatatacaaataaagagagacactaaggagagtggaaagtccatagagggaacgattatttttagcagctatgtcagggacattttcagggtaaaagtgagacatttggtagagtggtaaaatttagatatgtaagtattcctgacaggtggaacaatgtgagattttgcctgtgctgcttctttgtttccccataattgttttttaaagcaaattgatttaacatcaacagccaaaaataagaaccaagttacagtacatgtatataacacagaggagcaactttaaaaccaatacaataaaatgagtgaatgattacaaatgaagcccaaccgtaagctggctgcaggtcttaaggggcacaaagacaagaagatggccataagtctgagtattctgtgcaggcgcacatatgtaagctttggggaggaagacagtgcttgaacaacttagagatttcccactcgctgaaaacactccttctagggaaagaaaacatctacctagatggatccgcaaatagttcagtgaaaaaatataggtcagtaagcctgaggcaatgcacatttctttttccctaataatttgttacaatttcatgcgaatttaccatatcccaagaagtatattaattctaaaaaataatctaaatttaaaatttttattttacagttgaggccaaactcagacacgtactttgtggtttttctaaaattatgattttattaagaatcaagactatttaaagataggtctcttcaattctcaagttcaaaatctccccgtaacaatagagtacctctcacacattggtgaatgagtacaaaggatttagatgtagaaacttgacttcaagttctagttctgtcactgcttaatgttgtaaaaataaccaagtcaactagggacaaaaagttcatttaggaaattattgtaatacctcaggaaagaggaaatgcatatcttagtaggattgtgccagctaaaacacagaggttggaattacattcagaaattctctgaaggtagagtcagcgcatcttgacaaccagtaaatcatggtatttacaggattgattatgtaatgtgttttccctgaagtatggtccttggaacatcaactctaggagatacaagttaaggtaccaatagctgccataataaaccccataatttcagtgccttaatacaatagaaaaatatttttctctcacttaacagtctaaattgtttatcagctttggccctattgatacattggataatttgttgtcatgaagagctgttctatgcactgtagaatgtttagcagcttccctggcctctactcactaaatgtcagtaatgccaactcctcagtagtgataactaaaaatatttacagacattgccaaatgtttcctgagggacaaaatcacaccaagtagaaaatcgctggtctaatatatgtattcctgatcactgagaactttcttccacacagtgacccaggatcctttcattttaagggtctgccaaacttctttctactagcagagaaaggagaaagagatcacagacaagggataccgttttcttaaaagccttgcttcaggcactcatatgtcttttgctcaaattccaatgtcatgaacctatcacccagtaatatgtagatacaagaggagccaggaaatacgctcttatttggaagcttgcttcccaggtccatccttctgtcaatccttccttccttcctccctccctccctccctccctccctttctccctttctctcgctctctctttccttccttcccttctttccttctctttctttctctctctctctttctttctctttctctctttctctctctccctttttccctccctccctccttccttccttccttcctttccttccttccttcctttctttccttccttccttcctttccttctttgtttctttttctttctctctttcttcagcagagcctgcactgtcacccaggctggagtgcagtggcacaatctcagctcaccgcaatttccacctcctgggttcaaatgattctcctgcctcagcctcccaaatggctgggattacaggcacatgccaccacacctggctaatttttgtatttttattagaaatgggatttcaccatgttggctaggctggtctctaactcctgacctcaagtgatctgcccaccttggcctcctaaagtgctgggattacaggtgtgagccactgcaccaggccacaggttctactttctactatggaaaagagagcacaaaatttgttgaacagctagcaacctctgccatagtctgactgaaaacatgtttcctagccaaatatttttggaaactcttcagattaaatatctctcttaaaaactcacaatgaacattagcactttaaagtttctgagcaatccagcatggaatgtgtctgttaagttttcttgaagttaacacgcctgaaatttatttgaccacataatcccttctcccccattttgttgttgatttttgtttttgagataatattagtgtgctattgatggttgtattagtccattttcatgatgctgatacaaacatatgtgagactgggcaatttacaaaagaaagaggtttaatggactcacaagttccatgtggctggggaggcctcacaatcatggtggaagatgaagggcacatctcacttggcggcagacaagagaagagactttatgtagggaaactcccctttataaagccatcagatctaataagacttattcactatcacgagaatagcacaggaaagacctgcccccatgattcaattacttcccgccaagtcactccaacaacacatgagaattgtggaagctataattcaagatgagatttgggtggggacacagccaacccatataaatggtcatgatatttctgacaccttatttctggcttctttcggaggtgttagaacctgtaccagagaatggacagaaataaggaaagaagttcatattgatggagagtttgaacatattcattgaccagttagttttaggaaacattctgctaagtcttatctattgatttgatataaactaatgacaattagtggtttttaaataatcaaacttttttccttccattcatttattttttaggagctaaatgtgagcttgccactttgtatacatactgtccccttgaatttttactatattttcatgattccataatgccagctggtaaattcagaaaaacaaatacactttatttattataatctatttaggtagtagggaaatcaggaaattcctaccatatttaagcttcttagtacctgaattactatgagcaatataacatttctttgttgctaatgatttatattatagcccactatatggtctctccaccaattgctagtattaagtttgatgtctccttcatgctttccattgcacatccgctgctccttttattctccttactcttagccctatttcctactctttttcgttttccctcatctctaggttggacaagcttattctttataactttctctttcttattcatcactcatcccaacccaaatccattgaaagtatgtgtccattttacaatatcctgttagataaacaaaatcgttacatgtaaaacaaatattaggcttaaagattcctattatagtgtagtaggcagatttttgccccccgtgatctctcctgcttggcgttattcctttggttatattacataatgcagtcaaagggaatttgcagacataattatggttgctaatcaactaaacttaaaatagggagattatcctggattttctggggggattcactgtaattacatgagccttaaaataagaagagaaactcagaaatattcacagcatgagaaggactggcctgctgatgcttgcttgaatagataggggcccacaaagaaagcatgagaaggaaattacttcaaccagtgagcttagacccagagccttatattaggaacacagccatgggtgacactttgatgtaacctagtgagactcagttgagaatcccattatgtcatatcaaacttctgacctacagaaatgtgagataattaatggctattttttaagccactaaattgcagtaaggtgttatgaatcaatagaaaaccaaaacttaccgaacaagtcagttcttccctttccaaaaccactacttctggaattcattaagcagtgagcaattggaatgcattcaatttataagctgattctaagacattgtccaatacatcatttttctggactatttctacactaaaaatgacctgttcatgaccagtgatgttatttttttatcttttcatctcagagtatgtccttatctacctactttcctcagagaggtttgtttctgatgctgatgctggaccctctataggtatcatctaacatatgctcactagtaacatcattactgcacctcaatatctggttttcctctctttcatgagcatgtagatgggacactacatttcctagctcctttgaagttaggcaggatcttatgttttgttctaggcaatggactttaagctgaaccagcaaaaagccccttcttgacctccagctctttgttaacagcctggaaactgctcaacttgtagaagatttttgtaaggaaaaaaaaataattgatagtgttaagacactgaaatttaggtgttaattttgctcaacagtgtaacctagcctatcctgattaatccagaaacagatacacgctcttcccagtgacaatattttactagatttctggattatccttcattatgtagcattcagaccaagatactatgcctactatgatcaggtggaagttttctaattcagctcatgttgcagagaaaattcagagtatgatttttgaaaaggaaaaaataagctttgacgtgtttcggacctatgtatcaactaaaacaggtacatgcttaactccaccagcaacacgtctactgtgattcatattcttctttctgtgtttttctttgaagttactttattcttttgaagttcaccttgaagaactgagcaactctaagacagtcattatttcttcaccatgacatgactaatagcttctgccataggtgacagttctttgcaatctttaatttctctttctattcttcaagacttgcattgaaatgtatcttcatcaaatggatatatttataccttttcctacttaatcacatttctgatatatgattgctctttcaatagattacctaagtgcctgaaaagataactactcttaaaattgagccaagatcattttatctctttttgcttgaaaaattccagacagttggttaatctgcttaacaagagggtgtggaagtggactgtaaactgaatatgctagttatgtttctctcatgaaattaaaactaggtgagttgtaatttacaacctgagatttcatttgacacatactttttagaagctgtactgagagtgcaatctggctaaatttaattttacgtaattttccaagattatttcttcatctcaagtttctgagatatagaagcattggtctacaaaaactgaggttgaactcttgaggatttgtttataaaaacatacatatagatatactcagacatatatgtttatacatatataaacatgtatagaatatacatgtatatataagcatgtttacacatatataaaacatatttatatgtatgtttgtatataaacatatacatatgtatgtacacataaaaacatatataaacatgtatagaaatatatattctctcatatatatattcatatatgtgtatatatattcatatatatgtatatatatattcatatatatgtatatatgtattcatatatatatgtatatatatatgaagaccctagttttggctctgaattgatagctgaactttcaggttagtatttgaaatattcatcatcatttttcactaattctactaagcttgggctttttaaattactgttttaatttgttaaggaaaagaaagagtaagcaggataatagtccattgggttatttgccctctgtgggtgtgatcagcagagccaaacatattaataaccaataatgaacaattgtgatgtataaaatgatatggttcttggtagagtcctccattcaagctagtgcaataacaaaaaccacagtgtttctcagactttattgtgtataggaattacctagggatcttacatcctttttttttttcttttttttttttttttttgagacggagtctcgctctgtcacccaggctggagtgcagtggcgtggtctcggctcactgcaagctccgcctctcgggttcacgccattctcctgcctcagcctcccgagtagctgggactacaggtgcccgccaccacgccagtctaattttttctatttttagtagagacagggtttgaccatgttagccaggatggtcttgatctcctgacctcgtgatccacccgcctcggcctcccaaagtgctgggattacaggcatgagccaccgcgcctggcctcttacatacattctaatttagtaggtcttaagtctggaaattttacatttttaataaactcttgggtaatgccaatgctactagttcatactttggatcataccttgagtagcttacctctaaagcagtcattcattaatttattcaatagacatttgttgagcccccagtgtgaactaggccttttaagttcatagagcatttcctgctcttaaggagctcacatcctagcaaagtcaggctcatacacagataactaatgaaaatgagaaaagtgatataatgagatgactacaaagggtatggaaggttagatgggggtgattaatccttcttgtggtgtagcaagggagttggggtggcaatggaagatttcctctgacctaactcttaaggactaggagttcttttcattttgaagatttatgtttgctggaacaaggcctagggagttggtaaactgtgtaagcagctcctcctgaaagtaaagaataataacagtgtggctcacacaatgtggcagcatggattttcagacgggaactatctacctaccccgtctcataaaagtgaaagtaaggccgggcgccgcggctcacgcctgtaatcccagtactttagggagctgaggtgggcggatcacgaagtcaggtgatcaagaccatcctggctaacaaggtgaaaccccatctctactaaaaatacgaaaagttagccaggcgtggtggcatgcacctatagtcccagctactcgggaggctgaggcagtagattcgcttgaaccgggaggcggaggttgcagtgagccgagattgcaccaccgcactccagcctgagtaacagagcgagactcttgtctcaaaaaaagtgaaagtaagtaccgtacttgaattcagtcaaatgaccccttagaaaagcatcattagccactggttttcaagtcaattacgaaaactcaaaggcttatttgttagtttttaaataggtttaaatggacaaattctttgatctactgccactacttcttaaaataaaattaacaaaggcagattttcctttaagcaaatgaaacttagaggccattcatttgcatggctctttccagtgccccaagggggattgcagcaattgtgtttttgtaattttatgtcatttttcttaaataagaggtccccaaattatataagattcaagccccacagaacctggatccagccctgcaaacataccttctattgtgagaatcattatgcttttagtgtttgctttaaggaatatgctctggtatcactataattggtaaattatgtttaatcaattttcatacagttgagctctgcaggtaataacccaaagaaagacggtctccagggatgataaaaattatctcttaactcatgaatattccatttgctcattttctacagatagattacttcatttgaaagtaatagaaaaacacagaacggcatgcatgctgcaaacagtgcttagtgtaaatgtttcataatgaaaccagcgtcttggcataactgtttatatgcaatgcactgagcctttccagctcacacttgagggaggttatatacacatctatttatcctcttatatagaatagaagtatagcatatattctaagtttggaaatgttggagccatctactctaattttgataaatatatcttatcttcacagcaaaaaaagtctgaatataatcagccattattttccctttaacaaaagggatttttctgctgagttaaatctgatcctatagactgagtttcctataggtgataaaactaaataaaatagttttaaacatagttataatactaaggaaagtctattttatcttgaattaaaattttgtcttccattttttagtattgtttttacctaaagcaatagggaaaatttgggaagtgggcatgcatttattatatttacccataagctttccctttttaaaacctgttacaaattaaattggctgggtttggtggttcacacctgtaatcccagcactttgggaggctaaggtgggcagatcactggagcccaggagtttgagaccagtctgggcaacatagtaagacccaatctctctcttaaataaataattattcaaactaattttgaaagcttctcttatagagaatatggcactggtctcaatctgagcagggaaggaggtgaactacaagtataataggataatactcaattacctaggctgaagtgggttatcatttgcattcatctctgcaataataggaatgccataagagaggaatacagcaatacagaaagtacttttgtatcaccaatatgagagggcttaattgcaatcaggagagtctgagatgactataatcactttttacagtagtttatgctccagtgagaactaacagatgtcatatatttctgttatatctgtttctacagttgttttgtttcttttcatccaacgatatactttagaaacttgattcaagagttcaagtcagagcttttcttttccttacctaaatgtttaagtgaagtacaattatatacagcaaaatgcacagatcttaaagtgtacagattgctgagttttgataaacgaatacgcttgtgtaacactttaaactgagatatagagtactgacatcaccctagaaagttctcttttctttttttcagtctgtgccctcccagaatcaaccagtatcctgatttctttcttcattacttagttttgccgttccttaaactcataaaaatgaaataattcagtatatacttgctgtgtcttctatcactcaacatgttttttaagattcattcatattgttatttgtatcaagaacttgttcctttatttctaagtagtagtctattgtttaaacatacaataatttgtttatccatgttcccaataatagacatttcagttgtttgcagttttttgcttttctgaataaagctgcaatgaagattctttttttttttttttaatttaagttttagggtacatgtgcacattgtgcaggttagttacatatgtatacatgtgccatgctggtgcgctgcacccactaactcgtcatctagccttaggtatatctcccagtgctatccctccccgctccccccaccccaccacagtccccagagtgtgatattccccttcctgtgtccatgtgatctttacaggacactttgtggacatatgttttaattaattaattaatttaattttttggagacagagtatcactctgtcacccaggctagagtgcagtggctctatcttggcttactgtaacctccacctcccaggttcaagcaattctcctgcctcagcctcctgagtagctgggattacaggcatgtaccaccatgaccatataatttttgtatttttagtagagatagggtttcaccatgtttcccaggctggtcttgaactcctgacctcagatgttcttcccgcctctgcctcccaaagtgctgggattacatgcatgagccaccatacccagtctaatttatttggagtagataactagaagtagaatttctggatccttagataggtgttatgtttaactgttataagaagatactaatctttaatcagaacctgcccaacattttggtacagtggttgttctagtctacatttgcaccagcagtgtataagggagccagttcctctgtatcctcttcaacattaaatgttgttcatctttttaattttagctattccagtgagtggcatctcattgcgcttttggcatgtgtttccactaagactaaagattttgagcatctttttcatgtgtttattgtttattcatatatcccatcttgctaagtgttggtccaagtgtttgtccatttcttcacgaacaaatttttttttttattttggaacaatcttagatttacaggaacgttaaaaaaataggaaagagaatttctttatgcccgtgaaccagtttttcacattgataacatattatattaccatagaatatttgtcagcattaagaaaccaactttgatatattactattaactaaactccaaactttatttggattccaccagtgttcctattaacgtatactttctcttctggaattcagtccgagattccgcattgcattcatttgtcatgttactctaagtcctccagcctgtgacaatttttcaggcttttcttatttcttgcgaccttgattatctttagaatactggccaagtatcctgtgaaatgtgcctaatctagatttatctaatgtttttactttaatgatcagactagttttatgagtgtttaaaaagaatatcacagaggtcaactgtccttctcaatacatcacatgaggtgatgtgtaatatctacttgacgtttctggtgacgttaacctttatcacgtggttaaactagtgtttccagattctctcaagggacaaatctaggtaatatatgtatgtatattatcctatgtatacacatatatctataatttttaaatctattaatttgggtgcatatatgagtctatatttaaacatgagttcatattgatgtctctgactatactccagttctattctaaccttccttttctgcttatcggttacttccctctccaaaagtgagaagctagactcccactttctaccatccactatttacttaataccagtatacatgtaaactggtttcaaaacttttaaccttaatccctatgataaacaaatttatcaattaaagtacagtgtttatgtacagtgtacacttccttttatctttaaatacatagttttcagccaaaacaccattttctttatttttctttcattattttttattttaaaaagtttattctggccaggagtggtggctcatgcctgtaatcccagcactttgggatgcccaagtgggcagattgcctgagttcagtagttcgagaccagcctggctaacatggtgaaactctgtctctagtaaaaatacaaaaattagccatgtgtggtggcgcgcacctgtagtcccagctactcaggaggctgaggcaggagaatcacttcatcccatgaggcagaggttgccgtaggctgagattgcaccactgaactccagcctgcatgacagagcgagtccatctcaccaaaaaaaaaaaaaaaaaaagtttattctgagccaatatgagtgaccatggcccacagaaacacagtctctagaggtcctgagagagtgcaccaaagtcggttgtgttacagtttggttttacacatttcagggagacaggagttgcaggcaaagacataaatcaatggaacaaaattgtaagtcaagatatagtgccataaatatatagtaaaagtaaaatacaaatactaatgtatacatgaaacgtatacattggtttggactgcaaaggtgagatatgttgaagcagaagcttataggttagaggtggattcatagatccttttttaaaaaaacttttatttcaggttcagggatacagaacactgttttctaaagttactcaggtgagccttttttccccatgtaaagaaatgagctatttacttttttattatttatttatgaaaattgttttgtatattcaagatgcaaatctttttcataaacatgttttgcagttctgtcccagaccgtggcttacattttcactttctcaagagtgacttttgatgagacatttacatttttatcatgttgtttataaaattttcttttatggttagtgagttggattctaaaatacctttgcatatctctagatcacaaagaattttaaaaatgttttcttttatgaactttatagttttaactattacataatggtttttaatccatcacaaaatacttgttgtgtatgatgtgaggaagatgtcaaggttcaatttttccaatagatatccaggtaatccagcaccattggtcaaaaagatgtttctttcccctctgaatgccattggcgcctttgtcaaaaattattttactatatatttatggtactatatctggactcagtattttgttccagtgatttatatgtctagcatatgccaataccatactgtcttagtaagtatagctttataataaatattaaagtcaagtagtgcaaattatctgattttttttttctttcaagattgtattggctatcttgaccctttatatttctttatacactttggggtcaacttaccaaattctgcagaaagcctgctatgatattcattggcatttcattgacttttcaagtaaacttaaaaataatttacctctctacaatattgagtcttccagcccataagcgtggtatatttttccatttatgtaagctatctcagcagtattttgtaattttcagtgtaggagtagtcatatatacatacatatatatatatagagagagagagagagagagagatttattcttatatatcttgtattttttgttgctgatgaattggcattgattttttaaatttaattttccaacagttggttggtaatatacatacatgcaaataactttttacattgaacttttatcctaagacgttactgaattcccttattaacctaattttatatgaattttttggtatttgtttgttttagatttgggggaggtttctacatataaagttgtgtcatctgcaaacaaagtcatttttatgcattattccccaaattttatgccttctatttattttctttgtccattataatgtccatgctaaggtctccaatataatgttgaatcaaagtaatggaagcattatcacaaataggtataaagatactgtccgattatttttctgtacctattgagatgactatatgaattttctcttgtatattattagtatgttgagttacactgattgatttttaaatgttaagcccaccttgtattcttgtgaaaaattccccttggtcctgatgtattatcctatttatatattattagatttggtgtgctactattttgtttaggaattttgcatctttgttcttggaggatattgatcttttgcttttctcattgtgttcttgtcaggttatattatcagactaaccctggcctcaaaaaatgacttgggatgttttcctttgttctctattttgtggaagagtttgtataagaatggtgttatttcttctttacatatttggtagaatttacaagcaaggccatgtggacatggaattactttgtggagtttttaaacttcacattcaatgttttcaacagatgcaggacgattcaggactatacaagactatacaggactaaacagttttctattccttcttgaataagctttggtagtttgtgtccattgaaaagagtttctatgccaaagaaactgcaacttagatgaaatattacagtatttcatctaagctgcagagtttactagcatagaaatgttgataatattgccttcatttctgtttaatatatttaagactcgtaatgatgttctccctttattcctgatattggaattgatgccatctgtctttaaaaaaatcagttttattaggtgtttatcaacttcattgatttttatcagagtactaccttgtatttggtgacatcttctattgtttgcttgctttctatttcactgacttctgtccttcattattttcttttagttactttgaatataccatcttcatttttgtagctttttaagatagaagcttagatcattggtttttgatcttttttgatttccattacaagcatttaaggcaatgaatttccttagcaccactttagctgagtccaaaaaaatttgttatctattatgcttttattatgctgcaaatcaaaatattttttattttctttatgatcttttatttgactcacaaataattaagaaatatgttactttatttttgtttttttttttaatttaattctgttattctcagagaatttagtctatgttttcagtcctttgaaatttattgagatttgttttatggcccagtgtagtcttacttgatgagtgttttatgtgtgcttaaaaagaatctgtattatgcatatactgagtgttctataatatatatagtgccaatttggtcaatagtattatttgaatcttttatattcttactttttatttacttgttcactcaattactcaaagaggaatattaaagtctccaaatatatttgtagatttgtctatacttccctttagttttgtaagtttttgctccttctattctgaagctttatggttaggtatgaatacagttaagattgctttgtctttctgctgaatctgtcttttagtccttatgaaatatccctctttttccgttttgctccttgttttacagtctacatcatctcctttaataacgcagttcactattattatgatttgtgttagctttatttaccatcctcttaatttctatctatgttttttaatttaaagtacatcagtggctgctgggtgcggtgactcacgcctgtaatcccagcactttgggaggctgaggcgggtgtatcacctgaggtcaggagttcaagaccagcctggccagtatggcaaaatcccatctctcctaatcatacaaaaaaaatagccaagtgtggtggcgggagcctataatcccagctacttaggaggctgaggcaggagaatggcttgaattcaggaggcagagggtgcagtgaaccactccagtcctggagacagaatgagactctatctcaaaagaataataacaaataaaataaaataaattaaaaagtatatcaatggcaagcattgtagagtgtttttattaatgtctattctgatatctgccttttaattgaaatgtctttcatttgcatttaatataaataataattataatgtttcatttaagtccaccattagtaatttatctgtttcttctgtttttttgtttctttgatcttcctttccagccttcttttggaataatcacatattttgtagtattttatcttcctgtattgaaaatttttcttgtattaatttttagtagttgcactgaagattatactatccatctttaacctattacagtttagatgaatcaataccgtgccctgccacatataagaaatttattgtactgtatttctctatttctattttttgtgttactcttacctatgctgtacatccccacaaaacgttgtttgctttaaaaatcaaatatcttggcaggcacggtggcttacgcctgtaatcccagcactttgggaggccgaggtgggcggatcacctgaggtcgggagttcgagaccagcctgacaaacatggagaaaccccgtctctactaaaagtacaaaattagccgggcatggtggtgggcacctgtaatcccagctattcgggaggctgaggcaggagaatcacttgaacctgggaggcagaggttgtggtgatctgagatcataccattccacaccaggctgggcaacaagagcaaaactccgtctcaaaaataaaaaataaaaaatatttttccccgacttttattttaagttcagggacacatgtgcaggatgtgcagacttgttacataggtagatgtgtgccatggtggtttgctgcacaggtcatcccatcacctaggtattaagaccagcctctattagctgttcttcctgaggcattccctcctgtcacccacaccctctgacaagccccattttgtgtttttcccttccatgtgttcatgtgttctcatcattcagttcccacttataagtgagaatatgtagtgcttggttttctgtttctgtgttagactgctgaggttaatggcttctagctccatccatgtccctgctgcaaaggatatgatctcattccttttttttttttttttttgagacggagtctcgctctgttgcccgggctggagtgcagtggctcaatctcggctcactgcaagctccgcctcccgggttcacgccattctcctgccccagcctcccaagtagctggaactacaggcacccgccaccacgcccagctaattttttgtatttttagtagagacggggtttcactgtgttagccaggatggtctccatctcctaacctcgtgatctgcccacctcagcctcccaaagtgctgagattacaggcgtgagccaccacacctggcggatcgcattcctttttatggctgcatagtattccatggtgtatatgtaccatattttctttatccagtctatcattgatgggcatttaggttggttccatgcctttgctattgtgaacagtgctgcactgaacatacatgtgcatgtgattttatcatagaattttttatatttcttttggtatatacctagtaatgggattgttcggtcaaatggtatttttgcctctaggtctttgaggattcaccacagtgtcttccacaacagttgaactaatttacactcccaccaacagtgtaaaagctttcctttttctccataaccttgtgagaaactgttgttgtttgacttttaaataatagccattctgactggcgtgagatggtatctcattgtggttttgatttgcacttctctaataattggcgatgttgagctttcttttcatatgtttgttggccacgtgatgtcttcttttgagaagtgtctgttcttgtactttgcccactttttaatttgtgtgtgtgtgtgtgtgtaatgtttgagttccttgtagatgctggatgttacacttttgtcatatgaatagattgcaaaaatattctcccattttatatgttgtctgttcactttgatgatagtttcttttgctgtgcagaaggtctttagtttaattatatcctatttgtcaatttttgcttttgtttcaattgcttttggtgtcttcgttaggaaatctttgcctgtgcctatgtcctgaatgatattgcctggattttcttctagggtttttatagttttgggttttacatttaagtctttaatccatcttgagttaatttttgtataaggtttaaggaaggggtccagtttcagttttctgcatatggctagccagttctcccagaaccatgtattaaatagagaatcctttcctcattgcttattttcatcaggtttgtcaaagatcagatggttgtaggtgtgaaatctcatctctggattctctatgctgttccattggtctatgtgtctgtccttgtaccagtcccatcctcttttggttactgcaggcttgtaggagagtttgaagttggatagtgtgatgtctccagttttgttctttctgcttggattgtcttggctatttgggctctttttggttccatataaattttaaaataggctgggcatggtggctcctgcctgtaatcacagcactttgggaggccaaggcaggaggatcatgaagtcaggagttcgagaccagcctggccaacatagtgaaacctagtctctactaaaaatacaaaaattagtcaggtgtggtggcatgcacctgtagtcccagctactcaggaggctgaggcaggagaatcgcttgaacccgggaggtggaggttgcagtgagccgaaaccccaccataacactatgcctggatgacagagtgagactccatctcaaaaaaaaaaaaaaaaaaaaaaaaaaaaagaaaatagtttcttctaactctgtgaagaatgtcaatggtagcttaatgggaatagcattaaatatctatgcacataaactagaaaatctagaaaaaattgatacattcttggacacatacaccctttcaagaccgaaccaggaagaaattgtatccctgaatagaccagtaatgtgttctgtaattgaggcagtaataaatagcctaccaataaaaaaaaaaaaaaagcccagaaccagacatataaacagctaaattctaccagaggtccaaggaagagctgatacgatttctactgaaactgttccaaaaaactgaaaaggagggactcctccctaactcattctatgaggccagcatcatcctgataccaaaatgtggcagagatacaacaacaaaaaagaaaatatcagggcacgatgcttgatgaacattgatgcaaaaacctcaataaagtactagcaaaccaaatccagcagcacatccaaaagcttatccattacagtcaaataggcttcatccctggggtaaaagattggttcaacatacacaaaccaataaatgtgattcatcacataaacagaacaaaagacaaaaaccacatgattatctcaatagaggtggaaaagtgtttgataaaattcaacatccctacatgttaaaaactctcaataaactgggtattgaaggaacatacctcaaaataataagagccatatgtgacaaacccacaaccaatatcatactgaatgagcaaaagctggaagcattcctattgaaaacaggcacaagacaaggatgccctctctcagcacttctattcaacatggtattagaagttctgccagggaaatcaggcaagagaaagaaataaaaggtattcaagtagaaagagaggaagtcaaaccatcttgtttgcaaaaaaagtgaacctatatttagaaaaccctattgtctcagtcttaaagcttcttaagctgataagcaacttcagcaaagtctcaggataccgaatcaatgtgcaaaattcactagcattcctttaaaccgacaacaggcaagcagaaagccaaatcatgaatgaactcccattcagaattgctacaaaaagaataaaatacctaggaatacagctagcaagggaagtgaaggacctcttcaaggagaactacaaaccactgctcaaagaaatcagagagtacacaaacaaatggaaaaaacattccatgctcatggataggaagaatcaatatcgtgaaaatggccatactgcccaaagcaatttataaaattaaacatctttcaatgaaattgggaagcattatcaaaagtcttggatatttacatagtgaaacttagtctctgctaaaaagtcttggatatttacatagtgaaacctagtctctactaaaaatacaaaaattagtcgggtgactaatttttatgtgacttttaaaatttttctgtaaatctgaaattccaactgctattatttttctttcccctgaaatgtttcttcagtgttttatttggtgcagacatgctggcaattaatgctctctgatatgatctattgtaaaattacttattgactacattttttaataatattcttactcatattgaatactaatttgactaatttttccttcccttcgagtactccaaagacatcactggtttgtcttgtgcattattttttctaagaagttttcagtcacttttataatagtacctttgtatgtgacatatctttttattccttagtagtcttgggattttctttcttttttaaaatttataatattttgactagaatatttcttggcatacttttccatatatttatcctctttgtaattcattggacttcttagaactgtggtttttttcatcaaacttggaaagttttagaaaaataatttctcacatatttttgtctttcccactttttcttttctgagactccagctgcatgaatgttagaccacttgatattgtcaaacagataactgacactgtaggtttattttgcagtattttttctctcagattttatcctgaataatttctattgacctatattcccactgagtaaacccttctttggtgattcattcattcttcttttgaaccctttcagtgtattgataatttaatgtatttttcatatctacaattttgattttgttctttttaaaattattttcagtttactgccaagattcctatttgttcttccattttttctttattattatgtaaattttgaacatatttgtattagttacttcaaaaatctttgtctacttgttccactattttggtgatctatggattgatttcttttggatcctattttcttgcttttttgcatgtattgtattttattatactagacatgttttataggaaaacgtttttcccagagagtgagagctctgccctacatttggtaacaaaagggaggcagtaataattcagaaattattaatatcgggtgagtgtgtgattgagcctcaactttaagcagattatgttcaattttgtttatgtcaacttcaatctcactgtagtagctgcctaggaaattgtctttttgactagtttgtgagcctagattcaaagctttctagcactcttagaaatacatactctcttaagaatacatacattctttgttgcttttcaagcctatcttcacttcccttttctcagtaaacttgggaaagaataaggtaggaagactttttatgacgtgcaaataatactgcacttgagaatttttcaaatccatctttcctggctgatcctaccgttatccatagctctgttgaccattttttaacaaggtaagtttcttgatcattggcagatctccttttctgttccctgcacctgcaccatttgcccctgaaagctgctgtaactcaccacatatcagtagtcctacaaaatgtatgtcttttatactctctagattttcttggtgttaccatgagtgcaaagtcaactatctatgtttctttacattctaaatcacaggcagaatttttctatttgacttccctctctaagtccttgtctccccaatagtgataaagggttagcactccactttataatttttattttactcatattcaggtataccatttatttgactaattgtagataattgtcatggttttatattttttcttaagaatacatgcaatttacttacaaagtataaattttattttggtattttgacattacattacctggtaaatataacattgtaatagtatttatttccttgtgcttccccacaacaaaaataaacttttagctagaggccatttagtatgcttcaattttttaaaataaaattaagaaaaattgattttccttttataaaatatatttccctaaagctattgcttcttttgagaattactataagaaacaaaattccaataagtataagctctaactttgttactcctatattttgtggtgaaagtattatggtattatagaaaaagcatcaagggctttggtttccgaaaaacagggattaatatacactctctacctcttagtattaatagctttgtgaccttgggctggtcatattctcatctataaaatgggggtaatggtatttacttcatagagtggctgtgaagcttaaattagttttcaaggcaaaatatctatacctgtatttatacagaagttgtccaagaaggtacacaaacccagaaaaagtatggctgactttcctagatcattatgtggagttttgagggaaaagtatcttaatattacatatttaaaaaaatactttttaaagatgaagtatgaaatgataataaatttggtgtggggccgctgaagccatccctctaaatcctatatccccatatgtaattattctgtagcccctgagaagtattttagtgaaaatatctgagaaactctaggctgacctataaaacgtgaccagaattatttggctcacagtatgtgttaggattagctgtttatctagttacttaattgagtgaatacctgggacataatttagctttagaattttttttagtcagtaatgtgccacgctttgttgtcaacatttagattgttttccctttcatatgaaacattttattaaaattcccaaacatcatttttaagtccaatagcattcaaataccttctgcttaggcaccttcctttgtaaaaattttaattgtgtcttgactctttggaggcttttttagtgatttgtatttgatttgtttccctgggtggcatgggaatcatgatgtcattctttccattgtcctggtcctggattgaataacagaagatccttaacttctggagaacaaattttaaaaatggctatacaaattcattgagttttaactatgctatcatcattttgtgcatgaatgatttgtgttttatattttgattatatatatagatcacctcacacatcatagagccttccttttcaaaaatggcataatgtaagagtcattagggacccattcaaaggaaatgaatatattaggtatgtggacctagagataatttggaaatcaaccttcacttctcctgtatatttaatataccttgggtcatagcttagtataaaaatactcaacatatggttcaaagccttctatttaaaaaagatattggaatgatcattatttcaatttctttctttcgttttttttttcttttctttcttttttttttttttttttttgagaaagagtcgcactctgttgcccaggctgaagtgcagtggggtgatctcagctcactgcaacctctgcctcctgggttcaagcgcttctcttgcctcagcctcccttgtagctgggattacaggcgtgggccaccatgccctgctaatttttgtatttttagtagagttgtttcgccttgttgactaggctgatctaaactcctgacttcaaatgatccacccgtctcggcctcccaaagtgctgggattgcaggtgtgagccactgcactcggccatcattattttaatttctaaccttgtttctttaggaaacactctataaacataaataaatgtaaattatagaaataactactttcttttaatttaaggtaaattatactggcacatatactgaaagtcaatcttcctaaaataccagttagttaaattatttaaaattcttcaagtttcctgttagcagcaggagaaaattttatttctgaaaactgactaggaaataataccctgcatctcattccctggagtatactccattattcctcagtagtatttcttctttttacagtacaaactggctttttaattgtctttcattctctttgagagttgttttggccgctcaacactttctcacacagttctccttgcctagaatgtcctgatttctttttctcttacccctatacccatctgtggtagtccagttcaatcttttctgtctgttgagttcctgtgacattgattgtaagttgtttcttgtctcttgagtcagatagcaaaggggaccatgttttatgacagttatcttccagatgagatataaaagtaactcgacacttatttaatgctgggttaaaaattataaaaagcactcaaaagaatgaagtctttcttgaaattggggttaaattttttaaaaattactggaaataaatatttgatggcttctataacttttccctgatttcattgatttaataatgatctacatacaaataattttattttggtgttggttttatgttaagcacttgttttctttatttcctcatccaacatgtatacattgttggtccagttgtgtcaggagttctatgtcctagaattataaatgcaaatatagcaggcatgatccttgcacttacagagcttaataatctaatggaagaaaccaacattaaataaacaaacacacacataatttattataattatgttaaaagctgcaaggaaaagtggagggcatcataagagcatataacagaagaacctggcttacactggggaggttgctgcagaagtttcgtgtggaagtgacatatgcgcaaacatgtatttatcaagaattgtcgtaattacacagtatggatttttatcccaattttctagatgagggcactgaggtttagaattgttgaggaactaatataagtggcaaggttagagtttgagcctagcattgtgtaactatgggacctctttgtgcacagtacctccctttcagaaagactcaattccaaaggagaggcagagaaatattgggtaggcggagaagagtagaggcaaggctgggcacggtagcttatgcctgtaatcccaccactttgggaggctgaggcaggtggatcacgaggtcaagagattgagaccatcctggccaacatgggtgaaaccccgtctctactagaataaaaaaaaattacctggacgtggtggcgtgtgcctgtagtcccagctactcaggaggccgaggcaggggaattgcttgaacctgggaggcggcaattgcagtgagctgagaccgcaccactgcactccagcccggcaacagagtgggactccatctcaaaaaaatataaataaataaaaaaatgaagagtagagggaaagtgagaggtgacagtgtgctagcagccctcgcttgctctgggcacctcaggccacagcatccattctggccacgcttgaggagcccttcagcccgccactgcactgtgggagcccctctctgggctggccgaggcaggagccatctccccctgcttgcagggaggtgtggagggagaggtgcgagtgagaaccgaggctgcacgcggccaggacgagttccgggtgggcgcaggctcaataggccccgcgcttggagcagctggccagcgccgccggccccaggcagtgagaggcctagtgccatcaactgcccaagggctgaggagtgtgggcgcagggtgtgggactggcaggcagctctgcctgcggccccagcgtgggtcccagtaggcaccagatacactaggcaaagccagctggggtcctgagtcaggttgagacttggagaacttttatgtctagctaaaggtttgtaaatacaccaatcagcactctgtgtctagctcagggattgtaaatgcaccaatcagtaccctgtcaaaatggaccaatcagctctctgtaaaatggaccaatcagcaggatgtgggtgggccagataagggaataaaagcagactgcccaagccaacagcgcaagccactcgggtctttgttctttcactgtttgcaataagtcttcctgctgctcactctttgggtctgtgccacctttatgatctgtaacactcaccatgaaggtctgcagcctcactcctgaggccagcaaaaccatgaacccaccagaagaaagaaactccgggcacatctgaacacctgaaggaacaaactccagaggcaccatctttaggaactgtaacactgaccgcaagggtccacggcttcattcttgaaagtcagcgagaccaagaacccaccaattctggacacaaaaggacatagagagtgagagaagggaaaagagaaaggatagagtataggaggaagagaagcattaccctaattatgatcatcgaaagattgattccccatccagattaagttggcttcaaccctgtattagtttttcgtttccttgcaggtgaaataggatgaagaattatattgtctctggttcttccatctttgagtctgtggtcctttggccattaatccactcagcaaatatttcctgagcatgttccatacgccagcagtcctctatgtgttgatgattctgtggtaatgtaggattcttattttgaggaagtgaaacaacaacaccccttgcccaaaggtagagtaattggatcagtgccttcataaaaaatccaaaagttgtacaagcttcagtagggacacagtgtaacaaaggatgatatttcttatgaaacatctacattattgttgttttgaccataatttcagctgaactggttaggatagtttaatttgacctgtaccagactgtaggctattccctgtacagcataggacccagaacaaactgtgatgtttcttaggtaaaattctaataaaatcaaatatgaggtttaatcaaaagtggaaaataattttgaagtattccatagaagacagaattagttgcattagctttgctcttagggtggatgattcactgtataataacaatgaacacttctccattatttattatatgccagccattcttctaagcactgttttcacatcttgactcatttaacccttactgtcgggtccagagttcctgttttaattatcaccatacacttcccatccaggcatcttctctctgtcctgcttatgtgttagtttaatatcttcgaatctcaggtccagtctaacaccaggtgatgtggctgggttgttttcccttaaaattggcctccctgaatcactatctagatccatgattgtagtgaatgttcccttcctaagctcctgccagagttcggggccagggatgtagtcctcatttattattattcaacaatgactgtctaggattccattaataatgtcaaatagatatcccagtaccactgtccaagaccttaggtgctcaataaattctaattgattaactgacctatcaactacatgcattgttagccacttcagcagatataaaaatcactattccatgaatataaaattcactaattttttttaattttaaagcaggcatttcaatagagtagtttctaatatagagtttattatgatttcatgtgggaatagttctttctctccccaatttctaaagagttgacattacctaaagaggaatatgtattgtattcatcatgattaggagtgtttacatttgcagtcctctgagatgtcaatatagtttaattcataagaaacatttgatttaaatttccttacttcccaatttcttttatttttttatttttttattttttgagatggagtctcgccctgtcgcccaggctggagtgcagtggtgcgatcttggctcactgcaacctccacctcctgggttcaagagattcttctgcctcagcctcccgagtagctgggactacaggcgcctgccaccacgcccagctaattttttgtatttttattagagacaggatttcaccatgttagccaggattatctcgatctcttgacctcatgatccacctgcctcagcctcccaaaatgttgggattagaggcgtgagccaccgtgcccagcctttctttgccaatctcttctgatcataaaataaaatatctcattataaaaaggcccatatattctttacgtgcatgtagttttctaaaagaacagatattagatgctgttaactttactcagaacatgttttagatgtcgctgttacttagcaaaccccaaattatcttaccattatgtggaggccaactgtcaaaagttatctagaaggaaactgtcatatactcacccaccccctgtttactaaaagtattttctccttataatctaccttattttttaccttggggtggagaatatttgtcctcttttccttatcttctgtatcacattagttttcttacttgtcccatgtgcagcagtagtatcttaatggaattctttggattaatgtgtcctttaaaattttcatttatgttctagcaaatctgtatagtgctattagaatgacccacttttataacaaatggggctagttgataagaatagccaggggaaattccaaaatgttactccgtgctcagcattttttttttttaagtttcagcagcagatttaacagaagattctatacacaaattacagtttgttcttcagttgtttgacagaatgttaagcttaactaaatgtccacagttctccctaccactccactttctctacccactttgtggctttgcgtaacagactgtatgcagttgtcaatgattatttattaactgttaattgccatctatttcaggatccctgaaacaattatttaatgtaagctgctttttccagctaagacttttctttaagaaagtgtcataaacggtttgataaggtatttcagaaagttctaactttggatatttgtattagttcatttgcaaaccaggcttttctagttcccacatatgtgttcttttaactttgaggaagtttgggcgaggtttgtttaacaaatgaaataatgttctactgcagtttctaatgtagtttttgaaagagtaataaaagtcatcttgtccacaaatctggcattctttccttttaaaaggcagctatatacaaattatttttctttctgattgccagttaaagtcatatacagtagactcaggaaggaaagactaagtccatttgaataattctatgtgtagtcatatcttgcaaagtcacatgaacaataattttcctttggtcttaaaattaaaatttctgatataaatgttttatacattaaaaaaaagtggagatcaaaactcagttacctgaatatagaaattgagaaactgaaatccacataaaaaaatctgactttctccagattgcacatttggtaggcagtagagtcagggctaggatccaggtcttcagattcctacaccacaaaccaaactgcaatttaaatgaacaaagttttaacttcttacccatttttttgaactgatgttctttattcttcccttaaagtaatatcaaagtttggtcagtacatacttaatgaacgtgtttattttgatgtgtgcaatactaattgaccagcattcattttttctctttatcaataaactagtatatccaactagattattacgatagctgttcctatttttctgaaatcttgagagaaacttaccaattgacaagggagtgagggaagaggaaggaagtaattttgattggaaggaaatgttggccaaaaggtcacttaactaccctttccttttagctccagaacattgcagattgtgcatctcctaataggaaatgcctgtgggcctccagaagcagcccaggcagttgctatttccattgaatgtatatattagccaattttctgaaaaaggaattttcatgttctcaaaacattaaaatgtctgaaaattgtacaactctgaataacttcagcaaacttatgtatgcaacatgacttacataataagttccaagaattattcttctttgatttgacttttcaacacatggcatcatcactaacaattctagagggggaaaaagacccagtaatgcgtgttttcacttgctttctggttccaaatccaactttgtaaccttgaggttcattaaatcggatgcaatttggaaaatacaaaatttaaactttgtaaccttttctagtcatagtaaagtccttgtagtacaaggagtgcatttgatgcttatatctttttctttctgtctttatgtatgctgagccacttatctggaattctaaataaacttctagagtatacttactctctctccaattcacttttttttttttgactacttaactttctagactaagcattatcacttgtgcaagacctttatctggctacttcctttaagtcaaacagggctatatgtgtcttctatggactcccatactaccatctttctatcttgacacttaccttactgtgcggtttgtccttcacactagtctccaagcttttttttttttctcctttaatttttaagttctgggttacatgtgcgggatgtgcagagttgttacatagggaaacgtgtgccatggtggtttgttgcacagatcatcccatcacctaggtattaagcccagtgtccattagctatccttcctgatgccctccttccccccataggcctctctgataagacccagtgtgtgttgtttcaccatgatgtatccatgtgttcttatcattcagctcccacttacaaatgagaacatgtagtatttggttttctgttcctgcattagtttgttgagaataatgacttccaacttcatccatgttcctgcaaagaacatgatctctttcctttttatggctccatagtattccatggtgtatatgtgccacattttctttatccagtctatcactggtgggaatttaggctggttccttgtctttgctattgtaaatagtgttgtagtgaacacacacttgcatgtatctttataatagaatgatttatattccttgggtatatacccagtaattggattgctggaccaaatggtatttctgcctctaggtctttgagggctcatcacacattcacagtgattaaactaatttacactcccaccaatagtgtaaaagcgtacctttttctccacaacattgccagcatctgttgtgttttcactttttaataatagtcattctgacaggtgtgagatggtatttcattgtggttttgacttggatttctctaatgatcagtgatgttgagctttttattcatatgtttgttggctgcatgtatgtcttgttgacttctgacttaatttcgttatttacccaagattcttgaaagctgcttaagcagtaagacgttagcatcaaccatccatccattgtcctaaaattagaactgaccatctttgcacctgcagtattcaatatttccagaacctggtagaccaaaacatatttgaatagatgaataaataaacaaataaggaaattttattagttaatgggcttcattgcatagcttactactctttggtgaaacttttctgctagtgaaatagagaaatcagtgacacttcaaagggctttcaaaaagaaggctctgggtgattattgagggtatactcaggcaagccttgctacagactgtcctccctttttttttaaataaataatcactgagtccaggctttttgcttagtggctgcttctttaaggataatctggcaaaagaataagcatgtctttgccaaagcattcccgttgaagaagtgggaggagcaaaagagaatatttagggagagctgtggctttgggtttgcaattttgaagccagtttttgtaaggaataagtctttatttttcactccaatattagctcagtgggaagaaattttcttgcaatcttgggaaaattcactgaagttcccaaagattctgaaagagtctggaaccaggagttaaaaaacaagaatgcttgctcaactccatacatttattagctgaacttggtcaatgtgcttaacctctctaagcctcagtttcttcatatttaaagtggagataaaatcattcttacttcatagtaagataatatatgtgagagcatctggagatgcaatcatgaaaactaatggttattacttaaaaatgtgactgtaattgagaggttaaaaataaattccaaattgttagtttcctaaaattcagatttttagatggacaagcatattgagtattcaaatgcttttctttgcatatatccctatataaacatatacacctaaagcgtataactatattttgaagtctaagtggctccctcaaggttgctaaaactagtaactggatcttgggtcataaatgttatttttcataagaccactttgcatatttggatagaggcaactttataggaatctgcttttaaatggatttgaatgttgactggaaaccagcagcaataattgtatcctatttgattttgggaaaagctgaaggctgtgggcattctgcaaagatttcaggcagtagtggttacattttagagtctttctacagctctctccaaaagaatatatgccacgttgccaaggtaatttcccttatgctgagcacttcctattttttagtcctatgtttaaagcagtcagataaattagccagggaatattcctgttctattgattaatggttttacatagcctgaaggtctttaccactaactctcatccagatacccatcattacctttaacagacaagaggtgtaaagcagtctttattttttttatcctaaaatcctgttcatatgagcagattttgctgatgacaataccaggaatacttagcaacattgagataaaatttttcttggaggtagacataagaagaaatgggttcttgtgtgtaaaatgaattttctctcttggttttaagatgaccaaatttcaaaacagcaattgggtgaaacagtccttggtaaggtttgatttctaactcagaaaagggggatgcttcttttattctttgtgatgacaagggagaaaatccacacaagtacactacctctgaatctttataagccctttgatttcaaagaaaattgacaaaccaccttcaagagcctttacaactaaatatatactcttgaagtagaaaccacattttatttaccttcttttgtaagtctagatatctggaaaagtatcatgacattaatgaatataataaagatataccagctctgttattaccaatttttagtaagaaataatgctatcaccttctcactttatttcagctggaaatgtctacatctcaattttaatttctatttatatataatactttacttatatatttatataaagatataatatttaatttattttatacttaaaaattatgcctgggaattttggcaaactcattaaacatcagtgtgaagtgtactttattaacgcccttaacacttaccatacttctttctggttgtgagattaaaagccagttgagatggacaactgaggggtgcatacatattttcagaaggacatttttagtaattatatttacagctttgctaccagcaggtaatttttagctaccattcacttacctaagcttatttatttctggttcaaaaataattttccagccttaatacaatgtttaacatactactagtagtttattgaagctgataattttggcaaattgattatataaatatactgttcaaaaaatccattctcattcattctgattatatttgcagcctgtaactcgaactggcaatctagataggaggagtgttcagagacggatcatatactaacttatctaatattcgtagaactctgtggggtattagaggtggttcataatgcccctaggattttgcccagcctgaaagatctaggtctgacaaacttcaatctaacaaatatttatagaatacctattatatagtattactattaataataattattttctctctctgttgaattggtattataaatgtactttgtctttgggaagactctttttgtcctaaattctaagttgtctaatatcagtatagccgctccagctctcttaggtttatatttgcattcatttttaaagaaaaatgaatagattttcagaaacctgtgggacaacattatgcatactaatatatgtatagtggaagtacagagaaataacaaaggaaatgggtagaaaaattatttgaaaatataaaggacccaaatttccaaaacctgatgaaaaacattcatttacacatttgaaaagctcaacaaattttaagcaggataaacacaaagtgacccacagctacaaatgtagtattcaaatgctgaaaagcgaaaggcaaagataaaatcttagaaatagcaagaggaagtcaacttgtcatatagaaggtaactacataagtttaacatctgacttctaattagaaacaatcatggccacaggcaattggaataacatatctaaaatgctaaaagaaaagaactgataacgaagagttttggatccagaaaaacaatcctttaaaattaaaagggaaacaaagacaatcccaaataaacaaaagactgaatttgtttttagcagtcttgccttagaaacatttccattgataatctaaatagatgcaggaaaggcctttgacaaaattcaacaacccttcatgctaaaaactctcaataaattaggtattgatgggacatacctcaaaataataagagatatctatgacaaacccacagccaatatcatactgaatgggcaaaaactggaagcattcccttcgaaaactggcacaagacagggatgccctctctcaccactcctattcaacatagtgttggaagttctggccagggcaatcaggcaggagaaggaaataaagggtattcaattaggaaaagaggaagtcaaatcgtccctgtttgcagatgacacgattgtatatctagaaaaccccgtcgtctcagcccaaaatctccttaagctgataagcaacttcagcaaagtctcaggatacaaaatcaatgtacaaaaatcacaagcattcttatacacaaataacagacaaacagagagccaaatcatgagtgaactcccattcacaattgcttcaaagagaataaaatacctaggaatccaacttacaagggacatgaaggacctcttcaaggagaactacatatcactgctcaatgaaataaaagaggatacaaacaaatagaaggacattccatgctcgtggataggaggaatcaatatcatgaaaatggccatactgcccagggtaatttatagattcaatgccatccccatcaagctaccaatgactttcttcacagaattggaaaaaactgctttaaagttcatatggaaccaaaaaagagcctgcattgccaagtcaatcctaaaccaaaagaacaaagccagaggcatcacgctacctgatttcaaactacactacaaggctacagtaaccaaaacagcatggtactggtaccaaaacagagatatagacgaatggaacagaacagagccctcagaaataatgtcgcatatctacaaccatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcctgtctaaaacaccaaaagcaatggcaacaaaagccagaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaaaactcatcaaaaagtgggcgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggacgtggagaaataggagcacttttacactgttggtgggactgtaaactagttcaacccttgtggaagtcagtgtggcgattcctcagggatctagaactaaaaataccatttgacccagccatcccattactgggtatatacccaaaggattataaaacatgctgctataaagacacgtgcacacgtatgtttattgcggcattattcacaatagcaaagacttggaaccaacccaaatgtccaacaatgatagactggattaagaaaatgtggcacatatacaccatggaatactatgcagccataaaaaaggatgagttcatgtcctgtgtagggacatggatgaagctggaaaccgtcattctcagcaaactatcacaaggacaaaaaaccaagcaccacatgttctcattcataggtgggaattgaacaatgagaacacatggacacaggaaggggaacatcacacaccggggcctgttgtggggtgaggggagtggggagggatagcattaggagatatacctgatgtaaatgaggagttactgggtgcagcacaccaacatggcacatgtatacatatgtaactaacctgcacattgtgcacatgtaccctaaaacttaaagtataatttaaaaaaaagaaacatttctattgatatatttccaagtttacttatgttttttcttgtcaactcaaatctactgttgagctgctctagtgaatttttttaattaataacttttttaagagcagttttaggttcatagcataactaaatggaaagtacaaagggttcccatacacctcctccccacctaacacacacacaggccttgctcacacgggcattgacatccacaactgagtggtaaatttgttacaactgatgaacttacagtgacacatcattatcactcaaagtccatagttaacagtatagttcacttttgttcttgaacattttatgagttagaaagtatttatgagttagaaagtattttttgtgcttctcttttctggaagtgattgtagataattggtgtaatttattcatgaaatgattgttaggattcacctttgaacccatctgggcctggttctttctgtttgggaaggttattaattattgattcaatttcttcaatagatataagcctattcacatggtctgttttatcttctttgagttgtggtacatggtgtctttcaagaaaacagttcatttcaccttggttataaaatttgccagcataaagttattcagtatattctcttattatccttttaatgaccatggaatctgtggtgatgttttgtgtttcttttctaatattagcaattttgtcattttttttcttaattagcctagctagaggcttatcaattttactgatcttttcaaaaaatagccaatattttgttgattttctatactgattttctgttttcaattttcttgatcttctctaacttttacttcttttcttctgcttactttggatttaatttgcccttccttttctagttttctaaagtagaagcttagattattgattttagatgtttcttcatttatatacattcattcgatgctatgaatttccctctaaacactgcttttactgaagcttattaattttaatacattctatttgctattctttttctttttctttttttttcttttttgagacagggtctcactttgttgcccaggcttgagtgcagtagcatgatcagggctcactgtagcctcaacctcctgggcacgtgatcctcctgcgtcagcctttcaagtagctgggaccacaggcacaagccaccatgactgcctaattttttttttttttaggagttggggtctccctatgttgcccaggctggataaaacatcatgtattcaatttcatttagttcaaaatactttccaatttctcttcagatttcttcttttacccatgtgtttaatctccaggtacttcataattttccagctgtctttccattattgatttctagtctaattatattgtggtgttaagaacagacattgtatctattcttttgaacttgttaagatttgttttatggcttagaatttggtctatcctgatgactgtttcatgtaagtttgagaagaatgtgtaatctgctgtcattgaatgaagtagtctatggatgtgcttgatatcagttgtgtgatggttccatggagttcaaatatatccttactgattttgtgcctgctaggcccatccatttttgatagaggggcgttcaagtctccaactataatagtggattcatttatttcttgctattctatgggtttttacccccatgtattttggcactctgttgttcagcccatacatattaagggttgttacatcttctcccagtattgactactttattattatgtaatgcctctatttatctctgataatttatcttgcgttgatatctgctccacctggaattaatatagctactcccactttcttttgattagtgttattatgatatatttttctccattcatttactttttatgtatagttctccttacatttaaggtgtttttcttgtagacaacatacagtcatgtcttgctttttaatctaatgtactttgaaaatcttggctcttgaattgatgtatttataccattgatatttaaagtgattattgatgtatttactacttggattaatatctgccatatctgttaccattttctaattactgttctaattactgttcttgttctttcatcctatttttgtcttccacactttttctgccttttttcgttttaaatggcattttatattatttattttctttattaatatatcaattatacttcttcttttactttttcaatggttgccatagaatttgcactacacatttacaaccaatccaagttcactttcaaataacactccaccacttcacaaatagtacaagtgtcttataacaaaatattccccattctgccatagtttcttgtattattcatttcacttatatataatcatacatgattataagtgacatgcatatatatgattatatataagtgatcatacatatgtgtgtatatataagcacatatataatcatatgcattattcctattattattttgaacaaactgttatctgttagattaagaaaaataaaacttttattttgttttattttcatatattctttctccagagctctttctttctttatgtagatcaatgtttctgacctttatgatttttcttctctccgaagtacttactgcaatatttctctcaagataggtctactgacagaaacatttccttaatttttgtttgtctgaggaagtcttttctttttcattcttgaaggataattttataaatttttactttggtctttttctccccacactttcaatatttcacttcactctcttccagtttgcatggtttctgggggggttcagatataatttttatctttgctcctccgtagatatggctcccacctgcccccactagcttctttcaagactttaaaaaaatccttgattttctgaagtttgaatatggtatgcctagatgccagttattgggagtaggaggattttttgtttgcttgtgtgtttgtttgctttgtcatttattctgcttggtgttctctgaggttcctggatctgtgatttgttgtctgacattaatttgggtgaaattttcagtcattattgcctcaaatattgcttctgtttctttctctgttttgtctccttctggaatttctgttatgcttatgttacacctttgtagatgtctcacatttcttaaatgttctctattggttattttgttctgtgtcttgtctttttttctctgtttttcaatttggaagtttctattattgtatcctcaaactaagggattcttttctcagccacgtaagaatcaaaagtattcttcatttctttactatattacctccagcattccatttttattccttcctagaatgtatctctctacttacattattcgtctgtccttgcctagttgtctagttttttcattaaagcctttagtatactaatcataattcaaacatttctgccgtatttgactctggttctgatgcttgttgagtctcctcatactgtattcttttaatttttagtatgcctggtcattttttatttaaaatgacataatgaactgaataaaaggagctgttttgaatagatctttggtaatgtagtggcaaggtattggggaggaaagcatgctttattcctgtgattaggtttcagtattttggtgagtttgtctatctggattctaaatttcaccagtgcttctctgttgtcccccttatccccaattttaggtgagacaggatggctagagggtctggacttgggtatttccctttccccagttatgttaggccctggtaaaaccccgacaggttaggctctggtaaaataatttctcctgagagaagcccttattaagaagcactgaatgctctaacctacttcagaatgattccttttcctcttccctgccagagcactagtagattttcttctaatattcaatacgaaggcctcgtagagctttaggcagtaaaactcacaaaagcgtggcggccctgtgactgttccctctggagttcatgactgtcagagtttttcacattgagcatctaacaattcatcagttatagttcaggtttttctaccctggcactggttcccaaagaggtatctgcccattggtttttgctctgataattggtgattctttgtgtctacctatctgactgattttggggacagtgatttgccttgtaacttaacttctctgatggatctaacaatagttgttgatttttcagtttgtttagctttttatttgttgttagaacagaatggcaacttctaagctatttatgtagtaggccatcagccccaaactctagcaaatttattatttcagtttttgactccaaaattttcatgagattttgatttataatttctatttctctgttaatattttcaatttgatgtgtcattgttgtcatactttaatttttttaaatggctcttttagttctttgcacatatttatggctgctttgatgtttttgttagctaattccaacatctggaatgcctgagaaatagcttctatttattgcttactttcttatgtatggatcatcatactttccttttttgcgtgtctcctatatttttttgaaaactctacatataagataaaagcaattagagattctgatttgccctcttctctcttaccagctccagattttgagggtttttaaatgttggtttaaaaactaacatttagtcacatgctagatctgtagtctgtttcccctgcagtatatagctactgatgtctctgatgagtctgtcttgttttttttttcttttttgttgttgttgtttttgaagcctggcatcatagcagtgcctttagatcaacgtagccagatggtgagccagtgattggtgagaggttatgctgaaacaccttgagccagtaagccttccatccttcaccaatggatttgtgagtgggccagggaatgtgtttacattcaagcagcctacaacttggcctgagattttattttcgaataggccttccttttcctatctcctgtgcatgtgtgcaaggtctcacattcaggcagggatatgttgattgctaggaccttctgtagtctcttgaggatactcacgacctttcatatgcactcaaacttccagtcttccatggaaatataggagctctcaaagcctgacataactctctaagtacccaaattgttctgttaaatttctggctactgtagacagcatgttgactgcaccagccagtattgcaaccttagactacttccatttttgctttccctgaagtttgccactgaaatcactattgttttcaaaaactatgcatgggattttcccacattctgctccaaatgaagttggccccctctggcagtaaagctgctggttttcatagcattttctgctggtagaactactgtacccacagaattttgtggggtgggaagagatggggcaatgtgcagccccagactggaataacacaggctctcacagttgttaactaacattcagcagtttttttttttaatcaatcatttttaacttgctatatgtctttagtcagttttcaaagtccagaaatggctattgttggcaatttctgcccagttttaaagttgttctttggggacaggatttgctgagctccctattccaccagtctgtaataataatgaacagtataataataacatttatcatgtgccagactactgttccaagtattttactaatttatttaaattaatttacactaatttactagttcatttatccttcacaatcctatgatattcattttgaccccacttacagatcagaaaactgaggcagatatctgacagctattaactggcagagtcaaacttaggaaatgtctctagattatgagcagttgagaactgtactttacttcctacttcatttataatccctaacaaccttattgaagtaagtataagtagtatcgtaatttattgaggaggaactcaggctatttaacttttctaaagtcacaaaaattattaagaggccaatttaggattagcctacatgtctgactgaatccaaagcctgagctgatacttaacacagcctgataatataatcagagcaaaaagaatctacagaagtagtctgtaaacacagagaaacagcattagcagagcctggcctgtgtatatatgtgcatgcatatgtgtgtattagagtgcgtaggagggctagagaaagaaaggcagggtttgtgatgatattagatggaaggagaggagaatcatggaagatgtttttaaaggctaagtaggagttatacagggaaaacttggcaagcaagaccatcctaagcagaggatgattaagaaaacaaagagtataatgaaaacatgatttgaattttcttccatctcttctccctgccctaccaactgctttcaatccttggtgctttttgctgtaagtttgttgtctgattaacatttgtttactatattaaaggagtatctgtagtttaattaatagaatgcaagtgaaaatttttctggtacccttttgagtcttcctattccaagaagatatgaaaagaaagaaaataaaagaaaagaaaagaaaaggaaaggaagggaatggaaaggaaaggaaagaaaagaaaagaaaagagagagagcaagcaagcaagcagcagtgagctatgcttgagcatgaactgttagaaacttatcctatcagcgtcccagttgaccctgtgacagaatacttaaaggtcaacaaagaaaagtgtccagagagagagaaattctgtctctgagacttctagagatagaattggtgcataaaattcagagtccagaacgccttaatccgactagctatcacaacttgagtatgcatgacccctttcaaactcctggatcaagtctgagaaacactaatagatatgtagaaacttctacatttttctttgaaaaatatattgcttatacttttttgtcactttagacttctaagttaattgaatctaacagagaaaaaacagggtaagtcaggtcttctgtatgaatattgaacacaactgccccgtgcatatacgtatgtgaatatatgtatatatacatatatatacaccaagcagtaaagcttatatgttatatatgaaatatgcttatatataattatatgtaattatatatatgcaaatatatatatatatatataagctttactgcttagcatatagtaaatcttcagcaatattaactacaattatttaaaaggttttttccaggtctgctattggcttatttaatttctacctcttcacctttcttaaaagagaccagtgtggcatgtatgtacatgtctgctagggggagggggatggtaagtgaaccatcaggtaaccatcaggaaactgatggttattgcttgcaggaaattttttaaaacatcactatatatacgattgttataagaatccaatgcaataatgtatgtgaaaatagtatgaaaattaataatactgttgttaccataatctaaaaatgttagatataaacaactttaaaccttacaatttctatgttatcacctgggccagacattcggtaggggacaaaacctattaataagcagtccttgtcatggtcctaaagtactttgaaaaaggtgaaataaaataaagcagcagaatgctttcccttagtatctgatctggaaatactggtatgacctttattgtaacaagcagcccgaagcatttttccaaaatcacagaacttcagatgaaggagcagggtgatgtggctctatagctcttttcccaaggttgtgaagatagtgatgtgctttttaaatgggatgaaaagagattatatgagatagcgaagaaggtgggggtagtcactcaataaatatttgttgattgatgaattgatcttgaaaactgctgaaagggtgacctatatttagatgaaaagggatgcagctcattgttagcaagatttgaagtaaaatgattagagagaaattaaggcagttcacgcctttggaaactgacagtggtaagatttttgaataaaagggattttaaagatatacagcaaataaaaagcctttagcataagagtcaatccatttatttctttaataacaatttataatgcggctactaggggcaaacataagttcagttataataggtgccataaaagaaacacaaatttaaaagatagttccccatccgagcaagaggacagtatgtcagggaagagaaatcacaatgtgaggagctggcaagaggaagaccacaagtatagtaagagaggtgctctgctatgtatgaccagaaagaaaaattattgttttaatgtcagatactggattcaaacactagatatttccatttctttctccatccctataggcactcatttgctaattttgttcaacaaatttatattgagcacatactttccatcagtaagtaaggatgaggatgaacaagattctcctggtttcacattgcttatgaaagcataaccttgaaaaaattgtttaacttagaaactagcttctttgatagtaaaatcaacattaaaatgctaagctctcaaaattgttacaattattagatgaacttaagatagtgtctggcatgtactacatatttaacaaaatccagtagtagcaatagtagctgcagtagtagtaatcatttttattgttattagcattttttctggagataacagggttatgatttccagggtatcgataagaaaaatatttttgattcgatggacaagacagtctttagttggtaaaaatgggagattcccacaccaccaatagaatgcagctccataaaggcagaggcctttttttgtttaccactatagccctaggacctaacctaatacatgggaaattttaggcattcaaaatatttttctacattaattagaattttaataaacataaattgcattaaggcatttaaggcagcgtatgtggcattagtaaagataccaaaaggaggaggtgttcagctcaattacttggctagaaaacgtttttgaagatgagaaacagggtatttagctagaaaggtaggttggggacagctggtggatggtatgaaatgttctctggggattaaaaaattattgaagctacttgagcagtaaaattccttgatgaaacattttaggaaaataaacctcaaaggatatgaagaatagattgatgttgaaaatcaataggggaagaagtatttttaggaagttataccaatgttcttaagaaagtgataatttgaacatgaaataggatggcgggaattgataacaaatgtaaaggatgtatatgacaaaaaaaaaatctccttaacagagatatagagtggtagactgcaggaaattatggttacaattaggcaagagcatctgttctgttttagatgtattgagaccagggcagtacttaagtgtttactcagaaaaaaaaaaaaaaaaaaaaaaggccggggggtgaagtcaaaactcaggtagattataaaagcaacaaaggacagagcttggcaaatgttcatatctggcaggagtaaaataaatggtcatcactgccgtggacagagcagtagggaggagactagcaaggatagaccctgtgatggaaggaaagggaagttgcgagtggtgggtggtcactctagtgccaaatactgtatgaaagccagggcaaatgaagactgggaaagatcattgtatttaaatgtgaaaaagcttttgttgattattttgggttcaacttttgtataatagtggaacacaaacaaaagctgcagaggattgaggagagagaggggatgaagtagagaacattgatattttccctcatgctacagtcatattatactcaagtaaaagaaaatattcttgactatctggttagatcatcatattcgtaaagtctcatcttttggcttagcacccagtttttatttccctaaatattttggctatgtgctttgagttcttgatacttttggacacttgcttgcaaatgaccacatgatttgcatagatgggtggtgaggtgagggaggagatttgttgggacaaaaaccttgtgtatcatgatgccttacaaccattgatcaattgtgttcttaacaccatttactgttctcaaagagcatgtacaaactcatgaaatatttaaacccaaagaacaaaacagcctgcatcaggctggagccaagtgaatgcattaaaaccacctgttattctccatcctgcacatggtgcaaaacaagggagcaaagctgagagaaaatggactccttccaaatcaggcaaatccagttttgaacatactaagtaactatatttgttcctttgttacaaaagcctttaatcaagacaattttgtatatagaaaatgattattttatgcatataagaaccctaagctatttttcttaatttcttctgatggaaatactgataaaaattattataattttatagctaaaaagccgctaattacaaaaaaacgtgtgctttctaattaaaattttaaaaacatagtagttattaagtctgtgattatttttctagacccaaagttgcgtgtgttataaatacttcataacaaaggcagataattttttaaaaaaaaagttatttaagggccttgcacagtggctcacacctgtaatcccagcactttgggaggccaaggcggttggatcacctgaggtaggagttcaagaccagcctggccaacatggcaaaacctcatctctactaaaaatacaaaaattagctgcgcatggtggcgggtgcctgtaatcacagctacttgggaggctgaggcaggagaattggttgaactcgggaggtggaggttgcagtgagccgagattgcaccactgcactccagcctgggcaacagagcaagactccacctcaaataaataaataaataaataaataaataaataaataaataagaatggaaaaaattatagtatactgattttttctttatgtggtagaagctatgatttagcattcgctgagctcggaagtttttgtaattaagattagaaattttaacttgaaattagagtttactggtagaacaaattcaggtgaataataggaatagtgatcttaccaaactcagaatcttaactaagaatatcagtgattgtttttatagcttgtgagcgtttatttaaagaaaggaataatgaactatgatgagtttttaataaaactgcatattttaaaccagtcttattataacttcatagtattcataaaataaccagatgtataccttacattaaaacaggttctaaacaaagcttaagcagaaaatcttttgcttactactaagtgtttaaataagtaattttgacacttacacaaatgtgtgtaatgcataacaaagatgaattctaacagcttgtaagtacagaactgttatggaatccaggtcttttagattccacaatctaaacttttaatttctgtgtgataatgcgctgtaacttgaaaaaagggcctgtttttggtcactatctttagtgaagatagtctaggagaagggacattagttaaaggtggtgatggacaatctagttgtattaatgcaagcctcaggcttttgtaatgtgttttgtcctatttagagcttacattctggtggaatgactcactttttcagcactcaactgattttcatatattcagcagagaaaatttgacccagcaatcccaatactggacatctacccaaaggaaaataaatcatcgtatcaaaaagatacctgcactcatatatttattgcagctctattcacaatagcaaagatgtggaattaacctcagtgtccatcagtgggtgattggataaagaaaatttggtatatgtatacaatggaatactattcagccataaaaaagaatgaagtcttttgcagcagtaaggataaaactggaggccattatcttaagtaaaataactcagaaacagagtcaaaataccacatattctcacttataagtaggagctatgtaatgtatggaataataaacattggagactttggaaggatgagaaggtgggaatggaatgagggataagaaattacccaatagatacagtgtaccttaggtgatccttacactaaaagcccagacttcaccactaagcaatatatccatgtaacaaaactgcacctgtaccccttaaattcatacaaattttaaaaatatagcgaaatatgataaaaagatgggagtaaagaacatcagcctcctcaagttttttcttttggtttgaagtagagcaaaactttcttacgttttttcctttttagagagaaacagctacttactctttccctccagaaacctgagatctttgaggagtagaaatggaaaaaatgcttatggtaatgtcctcgagtggagccaagacggaaagtgataccactatttagtttcctccctgttgaggccttttataggttaaagagaagagataagacagagatattcagaggtcagagagatatcacctggcaaaattatgggttgccagttaggatctttagaataaagagtaatagaaaaatcacagtaacaattggtcaggtgcactagatgggaagaaaagccctgttgctaggtcagagctgggagggacctcagaggttatctatctgcatgagaaaattaaagcatcatgacaagcccaaggttacctagcatgttaaatcacagactcaggagtacaatgcaagcatcagactcttaaggtcagtgctgtctccagtagaacattctgaagatgtggttaatattgctgtctctgttttgataggcctacacattctcatgaacacctgccatgaacacactcagctcatcccatctcctctatgaaaagttttctgactcactgccggtggaatcacctattcctattgcctcctttatgtcacctctgcagctgctgcagtctatagacatctaccatagcactcctatcgctttgttacatgtttccattcacttgtctctatctgttagactgagttatttgagggcaggaaccatatttcacccaactttgtatctccagtgcttatcattataccaagtacatgataggtactaagtattaatgtatttaattgatgttttaatttattcagtatttaagttggaaattatttttaaaatttgcaaaaatttcctgagatgggaggataaattcaagccatatttcacaggaaagggcagctgttgttaggggctgcccatacttaggcaaagatacagtttaaacacaactcaatttttggagttcataggtgacttgggtctaaagatttttctggagacctgctttgatcaaggcatggtgtcagaaggtacaagggtaaaaaaaaggttaatatacaacctgtgctctcatgaacatgaggatataggaaatgccttgagaatagccttaagaaagtgagtgccaatagcagagcaacataatgatcaatactgggcaagggaatattttttttaaatgaaaagtgagtatacacaagattgggagaaagtttagttgagattttttttttttttttgagaccaagtctcactctgttgcccaggctgaagtgcagcgatgtgaactcggctcactgtaacctctgcctccctgcttcaagcgattctcatgcctcagcctccagagtagctgggactacaggcgtgagccatgatgcccagctagtttttgtatttttagtagagatggggttttatcatgttggctatactgatcatgaactcctgacttcgagtgatccacctgcctcagcctcccaaagtgctgagattataggggtgagccaccacgcatggccaaaataatattttgagtgaaggccacacttgtttgagaacaaaagctaaggtaattcctatacacaaggcagtgcatcttagattggttcaagaaaaagatgtttgagttaggaaagccttttagtggatatatagaaaaagacaagtttgtttgcttaagttatgtattactggagaaattagcaaacattcagtatttgatcagacaaattttgtgacccttatagatttgtatccagaactaataataatagctatcattattgaagatctgctttgtgccagacagttaacatgtgtaatattatttattcctaccaagaattttatgaagtagaaactgagaagaaaactgtttgggattttagctaaaatttctttaatcacttaagatgtgtgataattcatataaattacctaatgtaatcattgcaataaccatacgaggaagaactatttttagtactattcttcacataaagaaattgaggttttaagagattaaggaacttacccaaactcgcactcatcaaaaatgttggaaagaagattcaaatctgtcttttcttactctggaagccatgtttttgcctaccgagtatcacactgtatgtaaggtcaagtgtaaagagcagtaatgcatcatgacatatttactataagagatactccaaaagaagggaaggatgaatattggcaaggtactaaaaaagaggaatgcaaatgagtgtgtgtgtttgtgtgtgtgtgtgtgtgtgtgtgtatgtgtgtgtgtgtgttgatttgctgtggcatttgatggtggtgtgaccctgtaattcagggcttctgagaggagccaagctcagagatgaggataaataaacaaggaatggcaaaaggcatgggcccagtaggcatggcatccccattagcaaccaaggtcttctttgagtgcatcaggtttaacccatccaaaaacttcatttgttgattcactgatttatctacttactcactcacatagtcatcattgctagccactgtaatatatgctgcatctgtggatgaagcaaagtggcattgccccaccttactctggaagtgacaagagaccacaagaactggaggtcccaatttgcatgatgatcacattcctcccaaagtccaattgtagtgctagatgctaaaacaataataatcagaggtataccttgttaactatatcataattacttataataaggagaaggattagaacatcgtctgtcatattctctactactgacttaatctatgtaaacgacaaagagtaaatagatctgcacataccttgcatgtggcaatagtggcgctgcagctttagtctacctctatattttaaatattagatatcactcttgtatgaggccttaatatatttgtgtttcggtgcctctttaaaggttgtgtgtttctctagaatatggctgtatcttaaaatattttctcagtatctgtcactgttcttgacactttatgcatgcttaataattgctctttgggtagaattgtgtttagtctaaaaaagtgaatgctttgatatccttgtttcagcacttttataatatgtgacacagagatatataaaaatttattcatcttgggccaggcgtggtggctcacgcctgtaatcccagcactttgggaggccaaggtgggtggatctcctgaggtcaggagtttgagaccagccttgtcaacatggtgaaacctagtccttactaaatatacaaaattagcttggcatggtggtgcatgcctgtaatctcagctacttgggaggctgaggcagaagaatcacttaaacctggtatgcagaggttgcagtgagccaagatcgcaccactgtaccccagcctggttgacaagactgaaactccgtctcgaaaaaaaaaaaattattcattttggagtttagtatatccttagccttaatgaagctacaaaggtggcaaagaacaagcaaaacatttcagagaaattattatttaagattccaatgaaacaacattaaaatatggatagttcacatttgttatgtatggagaacctcttttcaggagataaaaatatatctcaaaatcaaattatatcatcatccaggcaggtgattactatatcattgaagtagaaaaaaggccataaaattaactaaaagctgttggagaaaaacaaatatttaatgcattcaacattcattaaattagagctttaaattaaataccaagtttaaatttgagttggctgtgggtcactctctttgcttaactgccatatgattctaggaaggctacatgctcagaacagcacaggacaatgtgtgacatcagtttgattttctggccaccagagaaatctaccagctgtcaccacagaaccataaagttcagaaaaatcaagtatcttaaacatgcacacacatttttcaaacactgaaaagtttaatctatttgactgactctccaagtctatgaaaatgtcaatcctctgatttttctagttctcaaagtagagaggaggctgtgacagttagggccagaactggaataacagaaaccccaactgtgaagctctccgggccccaaactatcagtagcataaaatatgaccaaggtacttaaatattaccgtaagtgttactgtacaagaaaaaaaatgtattcggccgaactcttttgaggaaaaggaattgaaaatcatatgtcgataacctgattgggaatattatatgagacaccaaggcaagttcaaacaacaatggattgtttgcaaaccacccaaaagatgatgggagccatttataacagttttggttttgctgagtgaggatacacaagattatggttaggggtgaattactgtagatacctctcagtgtttcatcactcagtaagcaaccactgtagagagtttatttagaaataaagtcgaaataagtatttaaatccttatttaatactgtactggtatattcgtttgaaaaggcaccaaattttcacaaattaagatcgaggtattgtttttttctttctttctttctttcttttcttttttttttttttttttttgaagcagagtcttactctgtcaccaggctggagcacagtggcactatctaggctcactgcaacctctgcctcccaggttcaggccattcccctgcctcagcctcctgagtagctgggactacaggtgcacgccaccctgcccagataattttttgtattttagtagagacagggtttcaccatgttggccaggatgttatcgatctcctgacctcttgatccgcctgctcctgcctcccaaagtactggaattacaggcatgagccactgcgcccagccctgggggggtattcttagttcttttgttctgtctcattctttccctcaagatatttgccatttcttgtcttaggagtcctttggcagaacatagaccacactctccctgtaatgagagaatagagattagggcctttccaatgtcttttctgaactctctcactggctcctgtgattccgtgctctaaatgctcctcatgtaaaaggttgaaatgatgcctcacctatgctaaaaatccttcatgcttctacgagttcacgaaagcttgttgtagacatgggatgctttgttgttgttgttgttgtttgtttagttttgtttttgagacgggatctcactctttcacccaggctggagtgtagtggtgcgatctcggctcactgtaacctccatctcccctgttcaagcaattcttctgcctcagcctctgaagtagctgggactacaggcacctgtcactatgcccagctaatttttgtatttttagtagagacggggtttcaccatattggccaggctggtctcgaactcctgattttgtgatctgcctgcatcagcctcccaaagtgctgagattacaggtgtgaaccacccagccgggatgctttgttttaaaagcaaagttacattgcaaccttgatggcatcatctctcctgatgaaaagaacctggatactgttgaattagacaaatgatattattttcttgagttgaaaatgaaagacccatgaggtaaatataagcctgcaatagtttatgtagctgactaaggaactttggaataccaattaggatatgcatatataatacttctaaaaatctaagagtcagcatttaggatcctagaaatgttaagcgtaggttttgataggccacaactatgcagtgtatgccactaaaatattcttgtcttttaagcacttcctaaaagaatttctttgagcctttagacatttattattagaggcgtgtttttctctcttggaagttgtttttttctccccagtttgcagcactttaataatgtgaagtgattcagtttggagaagcactgaagcaaagaaaagcctcatggagccatactgagggaatgaaaatgtatctcgttaattcagccttcccctattgtcctcttcctatccatcaaagaaaattattttaaaaatcattcatatggaaacatacaaggagtttgaagtgtgtttgtgtgtgtgtgtgtctgtgtgttttacttttgcatatacaaaacaaaaccctctagaaagctgctaaagctttctgacatcatcaagtccttttctgtgagtcattaagttgctgaagcctagaaaatcaaatttagtttagggctgtttgataatgtagtaaaacagtaaattgtgattcaccaattagctcacgtaattagaaaatcaaaaacatgctgtgagtgggtggtggacacacctaagtaaagtccattgtcattgtcattctatatgttcactgattataactataattacacctttaggtgatgatactacattcaattttttgttacaaaagagaatccacaaatatctatgtttataaattacacaagtaaattaattacttagttcagtcactcattcattcactatcttttccctcattattttcttgccaggctctgtgttaggcaacagggctggctgtctgggccttgcctgcatagaactctcaatccctggtactgggtataaattcttctaagatagaaaagtaaatgtaagttagaatcctataaaaagtatggctttatagttaaaatgtagtccttctggctgattcctaaattccaatgatgttgccaagacacgtatcagaaataagaaacaaccgatttgagaattttcttgcttagaggttttgcctggttgagaagaattctgagatagatgaaaatgagaaaggaatatttgttagattattttaaaccaacttttcatatggcctctgtgcacatttgtggaaatctaaggtgcctggctgtatttaaaatgtatttctctctgtaaattcaaatcaatacaaggattggttggatggttgaaacaattcgtcactaagcatttcaaaatgtgtcttactttgctcatttcttactgctactgaggtacataggtatggttatatggtccagggctttccaataaagataataaaaggatgatggggatgatttacctgagcttgagccactaaagaaaaggtatttctcagatgatgcagtcattttcatgctatttttctattcaaaaatggaacaatgttgttctgccattatcactgatttttaaggtcatattttagtgttcaaacataacattttttaaaaaacaagaaaattattttcctcataattgtatcattgcccctagatgatttgttctttgtaagctcacaatatgtattttgtgttattatacctcactacaaaaaaatcacagaattactaagggaagcaataatctttgagtattttttgtagcatctcagtcatatattttagaatagcatagattatgtttcacttgaatgaaaatgcacaatcagaaatatcaagaaaatgtggttatttatagctagaatgaaaatttcacccccaagcattatttaaaatgcagctgtctcctcctcaacatgtatttaatagttctcttcttattttttccctatttacaggtcaatgggacagaaattgaatatgaatttgaagaaattacactggagagggtaagaaaaaattttgaaaaatccaaagccccaatcttgcatttcacattctattctaatcttaatgagttgtcttgtgaaattatacaattgtgttttataacctggaagtttcccacaggactcacaatgagaatattaatgaaatgctcacagtagaaagcattgagacagcagaccaaataactgaatgtttagtatgtaaatttcattgccaggatttggagaaatgaatggaaaagagaaatgtttgatgagcttgtacagcactttgttcttaatggttttattattagtgttttggctatacattatttagatatgttacaagatgttttcatttgtgtgatatcgatactatcatcataattatagttaccatgtgtttcttacttagtttaaaaaacaagtggtgcattttaaaactactcccataggaaaaaacacagcaaccccatagagctctgcaaatatgctggtagggtcctggcaaagtgctttgacaaattaaggaaactgtgcaacacaaccctaatatatgtagatattttacagaacaataagagaaaggccaaagaccgtgtagaaaaaagtgaccaaaaagcattaacaggacattcattaaaaaagaaaaagccaataaacaaatgaaaacctgttcaacctcattaagaacaaaggaagacaatgagagcaaacaagttttgcctgtccaattgacagaaacttaaaaggaatgtgaatattcaatgccagtgagaggttctgaaaattagtacaaccctacaagagcaatttggaaacatagattaaaagcctttaaaatgaatacactctttgacccagaaattgtacttacagtagcggacaaatacacgatgaatgtgtgtattgatatggtttataatagtgaagattgaaaaacataggtgtttaataataaacaaaaaaggataatgtgtttattatgtattcatgtaatataaattatattaaaatatactgaaataatactttagaaaaatatgtaattgcaaggatagaaggtctacctagattatattattaaattaaaaattaagttttaaaatggtatttaaaatataattcagtagacacaaagctatataatataatatatatacataaatacactcataaagcctggaaagatgtacaccaaatgttacacatgttggtggctaactcctgttaaggattttggggtaatgtttagtttatccttcttgcttatatttatttcataaaccttctatgataaacgcataccacatttagtataagaaataaaaatgtaaatattttcactaagctatcattcaagtataaatgaagattgtagacctgcactttaatttatatctcgtttttagtttactaattattcactttcctgagtcagagcatttctcatcttcaggctgatttttatcaagtgtgagtgcttttaaaccaaaatatacgttgaaacttaagtgtttgacagatgggttctttaaaacttccattatggacttgataaaattttaatggtatgctaactggagaaaagtgaggcttatggaaaatgagctcaaatgagacaaaaaaacacatttctcctgaatcattaagtttctctccaagacaagctatatgatttatggagtgcagtacaacatgaaaacgtggggcctttctaaacacaggactcaatgcaactgaacaggtctcatgcccgtgaagctgagccttctcctttttccttatccaatgtacatcaccatcttgaatagaacactatttagttgccctggtattggaggtcaaaaaataaaagctaacattggtatgagagagaacactcaataggagtcagacaactgtgggttctagtctggattctgatcttacttgtttcctgatcttcagcatgtcagtttaccttgctaacttcctgccttggggttcatgaccatactctgaactttgttactgccattaactgccccctctccaaagcctctatgtcaagcaatatctttgtgaacacttcctcccttctgttcatatcatttattctagtaccttctcattgaaacttctttagccccattggaacctcagatcattgatttcaccatttctacccagctttcacctttctttatgccctctcttccctccccacctagcatgtattacctggtccctcactctaattctccctctcatgcacttttttttctcttctctagctttttgtgctcatccagcaaaaccccagtccaagttagcttacgctggttaagccaacactttcctcttcactccatgccactgcctcagcaactggatatggctagagaaacactcactcatctcactttaaatatttaaccattgattttaagtgaactctcaagactttctagcaattcttatacacttctttagaaaaaatcactttctcatactctgggacaacaatttcataccttatcatatctcctcaaatctcaagcactctcttctctcatcttctctttcagctgttgacctgccttaatatgtttttgagaaaatccaagcaatcaaatgaaaaccacattttcctactaccaggtctactagtatattctcccatggcaatgaaggaaagttcctattccattctaagaccaactttttacttgttacctagactccattaccagttatccattgaatgattttccttctgcagttatctcctctctcttctgcaatatcaagccctatcttgctttttactgaataactttaactcaggcacagtatatctttcatcttagaaaaaataagtaaccgtcccctgaccctatgttttccttccactattacctcattattctattttgctttaccaaaaatctaagaaaattgtctattttcattagctcccccttattacctcattttttaaattttaacctgtttcatgttctcatccccacaatagtcataaatccatttatatcaaagtcattactggttccatcttgctaaattgaagcatcagttctcagacctaactgacttcttagcaggatttgatgcttcctccttcctcaaagatgtcaacattttaacttccaggacaaaacactctcctgttcttttaccacctcaatggctgccctttctcagcctccttgctggctcctcctctaaaggtttcagcactccagatacccagtgtacagacctcttctccatcttttcttcattccctagatggcctcatccagactcatgcccttagataccaactgtcaactgatgactcccaattctgaagccatgacatctccctgaatgagaacttcaaatgtatatgtctaactgtgcagttggcatctctgctgcttgattattaagaaagccccttccctgcagtccctcttctcagggccaaagtaactgctgccctaatattcttcatattgactaattggttctatcatttcccatattatttatgccagaaaaataatctaaaatctaaaagtcttgctcaattattctttatcctcagcattcatgagtaagtcctgcttgtgctaccatgaaaatatattacaaaatcagtcagatcttaccacctgctctgctgaatcctaatccaaaccaatttcatcccatgcctcaacaaccataatagcttccacttttaccctgctgttctcctccaagtaacccgttatcttttttcaaaatgttaatataagccagatcataccacttatattcttaagaccttccaaaggtgataattaacttcattatcattacatacaaggccttctgtaatgtgacacctgctcctctctccaacattatgtgctcaccaccaactcttcataaatttcactctagccacggtgaccttgacgtttctcaaacaagccaagcttttcctaactcaagccctatatgtatgttattctagctgcctggaaaaattgtccgttatatctttacatggtttattctttttattatttaaatatctgctcaaatatcatcaccttagaaaaatcttccctgttcactgtaattaaattagtagcatttccatcattcttttttcccattttattattacttaattgcactcaccagtatctgaaatgtatattatttatttatagtttattttgttaacatctattccttcctgtaaatatatgcagtatataaatataaagtgatttatatacaatttttctagaacaacatctgaaatttagtgtatactcagggagtggttggcatctaaatgaagttggcctggttgtattactggaaggacagtaacatagacgcacatggcctggtttgaatccaggtttgaattctggctctagcactttctggtcaagtgaccttgaactacatacttaacctctctgtacctcagttgccacatctgaaaatgaggctaaactgtttataattaccccataaggccgttgtgatgaatacatgagttaacgtaaaggtttagagcagcatatataattattcttaatattttctttggttaacatggtagttctcacaagaattatttataaatataattgaggaagttattaaagacatagcattccactctcaacaaacaacttaatctaacaagaacttcttttgtttctgcttttcttttctttattagatgtcaaatacccaatgacaaataagttatggtatttgccacgtgcatttacagcttatacttttgctatgtttaacctctgtaacgtttaatttaagtaataatcacatttagtaacactcctatgaggtagatgttgctaactccattttacatattaggatactgaggctcaaagattaaatcacttgccaaaaatcatagctttataagagatagagttaggattcagccctatgtccaacagatattagaatctgagcttattaccactgaattagactgctgtcaaaattaagcttaaatatcatttcctccaaacagattttcttgactttcactcttgggcaatatgcctctttgaaaacaacaacaataggccaggggcggtggctcatgcctgtaatcccagccctttgggaggccaagctgggcggatcacgaggtcaggagatcgagaccatcctggctaacacggtgaaaccccatctctactaaaaatacaaaaatttagctggacgtcgtggcaggcacctgtagtcccagctactcaggaggctgaggcaggagaatggcatgaacctgggaggcagagcttgcagtgagccaagatggtgccactgcactccagcctgggcaacagagtgagactccatctcaaaaaaaaaaccaaaaaaacaaaacacaaatagagaatttatcacactagatgataaataaaatctatttcttccactggcctatgaattctatgatgaaaggaattttctcataatgttctttatgttatcatggtgacattaaaagaaaagaaaaagcccttgggcaatttgtaaacaagttgacgactcctcctctacagtagcattgtttaaagcattaaccacttgccacacagagtgaacttcatgaatatcttttgtacatttaattgtcaagcacttgttaaacataggtacagggcacagaccttgtttcaaagaattttgcagccttgtggaggacacagaagtaaatgcacaaaaactatgacgataagtagattgctctcaatatgtggtccgcatgaagtaatttcctgaggcatcataactgagctggcttatgagaggtgagagggaacaagccatgtaaaagagagtgaaagccagacatagcagctcatgcttgaggtcccagctactcaggaggctgaggcagcaggatcatttgaacccagtagtctgaagctgcagagaactatgattgtgccactgcattccagtctgggcaatagaatgagaccccatctttaaaaaataaaatttttttaaaaagtagtggatgacggcctctcagatagggagtagcaggtgcaaatgttaatgggcccatggaaaagtaacatgctaaataaaaattcacaagtattatacaaatatattcatttatgtataaatacacacatgcttgggtggtacctttgtatttaatatttacatttgcatatatttcaaatatgcaaaatatacagtgatgattgcacatacataaactttggagttcagttaagaaatgtatctattaccaaaattatttaattaaactataagattttaatacagttgactatataaaaactgaaattctatcaaatatctactcaaaccgtgcctgtttttttattcctgtcactattattaaaaatagctaaagagacctagaaaaaatgaggaatttagaaattcaaaagctttatattatttgaagtaacagatccttaattctattagaaattaggaattttcaaaaagatcaacaatgtgagataaaagaatttggtctaaataaatcagatatctaatgattttctagttattttgatatctggagagctggggaggccactattagacaactttaatgggtctcttcttacctggcaattcactaatactgtttttaaaattcccatgttacataccttatatcctaaacttgtttcttctgtaggaatttgcatgatgcaataaatcagtcatttttcttttctctataagtcattttgttttggcagaggtgaaataatgactaacaaaagtcagtaatttacatttcaggaaatggttcagatttttaaattattttattagttgcaaaaagaatccctaacttgtcagacaaaacgttcaaatagtatcacatggccatacattctgcagctgttgggagagcactccaaatgtttttttcttcagtgaggatgggaggaatatgagagtcaaataaggtagctgatagtcattttagcatctttgcaaaactgtaatcatgcgtgctggtcagggttataaaagcatcataaatctattatccatgctcggtcaactaactactcttgatacaaatcatgttggggttatataagctattaatttcatacatggaaaatgtataaattactcagagtacgcaaagacatggacttgacttagctgcatttgctaatgtcataagaatccagggagtcaggaaagcttgagatatcaaagttgtctatggctgagcggctcagattgtgatagtaaaaggaatttgtggaattatactctaggcatctttgaattttcccttctcttttgtattttcctgtcctgcaaaacaccacatatattcttctatcgttcctagtatatttttgaattatttcctcctccatcaacttggcagaatttagccattaattatttgtcttaaatggcataccttcatcctttcccaaatactatgtatgtgcaatattgcagccaaagtgatgtatttaaaacataaaaatgattatgtcatttttatcctaaaatttctccagaggctctttattgtctttaggataaggtttaaactccttggtatattatttaaggcatccatggatgtcctcttcatcttgccagcctcatttctcccttggagccctagttcatatcttgaagtgcagtcattctgaactacttgcagttacagaaatacatttatataatatgtgtgaattttaatcagtggtttattggttttggttaaaggtgttggaataatttgagaagaaaaataagcttataaaaacagtgggggctggtacttgactaccagtggccccatacccaagacatctgcccactaatctgcacctggcattgggtgtgtatttccaggggcagaccctttagatcaccaggctttggaatttgcagccagcactggtagggtcagcctgaagtaacataggggactagacggctgactagatatagctgggagcacctcttgcactgaaggaaaccaaaatatcgagtaaatcatcacacttcgaatagatcttttgaaataaaacgttgaaagtttatagagaggtgacatagaaaccaaagtagaagaggggggaaactgggaaccctgcacagagttgacaagctccagggccagttcctggccctaaataggacctaaagaagggcatacattgctggtgaaacccagtgcagaaatctagtcacaaatgaagagcctcaaccctctaaaagcatccagaaatgaagccaatcaactatactcaatatataccacaattcaactctaaaagaaataaagaatataaaaataggtccactttttgatggggttgtttgtttttttcttgtaaatttgtatgagttctttgtagattctggatattagccctttgtcagatgagtaggttgcaaaaattttctcccattctgtaggttgcctgtgcactctgatggtagtttcttttgctgtgcagaagctctttagtttaattagataccatttgtcaattttggcttttagactggattaagaaaatgtggcacatatacaccatggaatactatgcagccatcaaaaaggatgagttcatgtcctttgtaggggcatgggtgaagctggaaaccatcattctcagtaaactatcgcagggacaaaaaaccaaacactgcatgttctcagtcataggtgggaattgaacaatgagaaaacatggacacaggaaggggaacatcacacaccagggcctgtcgtggggtgggggaaggggggagggatagcattaggagatatacctaatgtaaatgacgagttactggttgcagcacaccaacacagcacatgtatacatatgtaacaaacctgcacattatgcacatgtaccctagaacttaaagtattaaaagtatctatctgtatgtaaatgtgcatttgcatctgtttgaaagaacaaggggaaaatgtggaaagtctacagcaggtgtgagtattggcagctcaaggggatggggttgaagatgaggctaaaggagatgatttgctttcactttatgtatctttatatgatttcaattgttagaataagcatgtattacttttgtatttaaaaatattaatggctgggtgcagtggctcacgcctgtaatcccagcactttgggaggctgaggtgggtggatcacttgaggtcagtattttgagaccagcctggccaacatggtgaaaccccatctgtattaaaaatacaaaaattagctgggcatgttggcgtgtgcctgtagtcccagctacttgggaggcggagacatgagaatcgcttaaacccaggaggcagaggctgcagtgagctgacatcacaccactgcactccagcctgggtgacagagcaagactctgtctcaaaaaaataaaaataaacttcaaaagcctgtccaagtgatagcaatgtaagataaaggaatgcagccgtctcaggtgagaaagaatcagtgcataaactctggcaattcaaaaattcagagtgtctccttacctccaaataattgcaacagcttcccaacaatagttcctaatgagattgtaatggctgaaatgacagacacagaattcaaagcctggatgacaaggaaacacaacaagattcaggagaaatccaaggaagccagtaaaactatccatgagttgaaagatgacagagccattttaagagagaaccaaactaaagttctggaactgaaaaattcactacaggaatttcatagtatagttgcaagcattagcaatgtaatagaccaagctgaggaaagaatctcaagctgaaagactggtcttttgaatcaacacagtcagacaaaaataaagaaaaaatatttttttttaatgagcaaaacctccaagaaatatgggattatgtaaggagaactaaactacaacccatgctggtattcccaagagagaaggagaaagagtaaacaacttggaaaatgtatttgaggatataattcatgaacatgtccccagtttcactagagaggttgacaggcaaattcaagaaatacagaaaaccgctgcaagatactatacaagatgaccaaccccaagaaacaaagtcatcagattctccaagattaacatgaaagaaaaaatcttacaggcacctaggaaaaagggtcaggtcacttacaaaggaaatttcatcaagctaacagcagacttctcagcagaaaccttacaagccagaagagattgagggtctgttttcagtatcctcaaagaaaagacattccaaccaagaatttcatatccagccaaactaagtttcatacacaaaggagaaataaaatcctttccagacaagcgtaagggaatttgttaccaccagatcagccatacaagaggtccttgagggagttctaaacagaaatcaaagaatgatacctgttaccacagcaacacacttaagtgcatagcacagaccctatagggcaactatataatcaagtctacaaaacagctaacaacaggatgacagtatcaaaacttcatatatctatagtaaccttgaatataaatggcctaaatgccccacttaaaatgcacaaagtggcaagctagataaaaaaacaagacccaagtgtcttcaagagacctgtcttacatataatgacaaccacagtctcaaagtaaaagaatggagaaagacctatcatgcaaatagaaaacaaaaaagaggccgggcgcggtggcttacgcctgtaatcccagcactttggggggccgagacaggcagatcacgaggtcaggagatcgagaccatcctggctaacatggagaaaccccatctctactaaaaatacaaaaaattagccgggcatggtggtgggcgcctgtagtcccagctactcgggaggctgaggcaggagaatggcgtgaacccaggaggtggagcttgcagtgagccgagattgcgccactgcactccagcctgggcaacagtgcaagactccgtctgaaaaaaaaaaaaagagaaaacaaaaaagagcagaggacagtattcttatttcagaaaaaacaaacaaacaaacagattttaaaataacaagtcaaaagtgacaaagaagggcattatatgataatgaagagttcaattcaaagaggacttaactatcctaaatatatacataccaaacattggagcacccagtttgtaaaacaggtacttctagatctatgaaaatacttagccacataataatagtgggagacttcaacattctactgacagtattagatagatcatcaatgcagcaaactaagaaaggaatcatgaacttaaactagacacttgaccaattggacctaataaacatctacataatattctatccaacattgatagaaagtacattcttcttgtctgtatatggaacacactccaagatctactacatgctttactggtaaagcaagactcaataaatgcaaagaaataaaaatcataccaaacatactctcaaactacagtgcaataaaaatagaaatcaaaaccaagaagatctctcaaaaccacacaattacataggaattaaacaacttattcctgaatgacttttgggtgaataataacattaaggcagaaataaaaaattctttgaaattaatgaaaacagagctgtgacatactaaaatctctaggattcagtgaaagcagtgttaacagaaaagtttatagcattaaatgcctacatcaagaagttagaaagatctcacattaacaatctaacattacgcctagaggatctagaaaaacaagaacaaactaacctcaaagctagcagaagaaaagaactgaaatcagagcagaagtgaataaaatcaagatgcaaaaatatatacaaaagatcagcaaaaccagtagttgtttctttaaaaagataaacaagatttatagaccactagccagaataagagaaataaagagaagactcaaataagcacaatcaggaatgacaaagataacatcacaactgatcccacagaaatacaaaagatcctcagagactgttgtgatcacctctatacacacaagctagaaaatctagagaaaatggagaaatttctggaaacatacaacctcctaagattgaaccaagaagaatttgaaaccctaggtagcccaataataagttctgaaactgaatcagaaaaaaaaaaaagccaatcttactgaaaccagtttcactgaaactgttccaaaaaaatctagggttagggacccctccctaacccattctacaaagccaacgtcatcctgatacccaaatttggcagatacacagcaaaaaagacaacttcaagccaatatccctgatgtgaacatagatacaaaaattctcaacaaaatactagcaaactgaatccagcagcacatccaaaaggtaattcactacaaggaagtaggctttatttctgggatgtgaggttggctccatatatgcaaatcaataaatgtaattaattgcataaacagaactaaaaacaaaattcatatgatgatctcaatagatttagaaaaagctttggataaaattcaacatccttcatcataaaaaatctcaaccaactagacatcaaagaaacatacctcaaaataataagagccatctatgaaattcctgtagtcaacatatgacatggacaaagctggaagcattcccattgagaactggaataagacaaggatgcccactctcaccactcttacaacatggtacttgaagtcctagccaaaagaatcaagcaagagaaaggaataaaaggcatccaaataggacaagaagtcaaactgtctctctttactgagagaatagaaaactatgtatactgtatattctatgagagtataaaatactatgtttctctatctagcaaaaccctaaatactccaccaaaaagctcctagaactgatgaagcacttcagtaaagtttcagtatataaaatcagcatacaaaagtcagtagcacttatatacaacaataatgttcaagctgagagccaaataacaatgcaatcctatttacagcaggatacagtagtagccacaaaaagatttaaaaacctaggaatccatctaaccaaaaaggagaaagatctctaccaggagaactgaaacactgctgaaagaaatcagagatgacacaaacaaatggaaaaccattccatcctcatggattggaagaatcaataccgttgaaatggccatactgaccagagtggtttacaaattcaataccattattatcacattaccaacattgtttttcacagaataagaaaatactaatctaaaatccatatgtggctgggtgcagtggctcacacctgtaaccccagcagtttgggaggctaaggtgggtggatcacgaggttaggagtttgagaccagcctgaccaatatagtgaaaccccatctctactaaacatacaaaaattagccaggcattgtggcgtgtgcctgtaatcccagctactcaggagggtgaagcagaagaatcacttgaacccgggaggtggaggctgcagtgagccgagatcatgtcattgcatcacgagatgcaatgtcattgcattgggtgacagagtgagactccatcttaaataaataaatgaatgaataaataaataaataaataaaattcttatgtaaccaaaaaagaggctgagtagcctaaggaatcctaagcaaaagaacacaactggaggcatcacattacctgatttcaactacattacaaggctacagaaaccaaatagcatggtactggcacaaaaacagacacatagaccaatgaaacagcatagagaacccagaagtaaagccacacacctaaagccatctgatcattgacaaagtctacaaaaataagcagtagggaaagggttccctattcaattaatggtgctgggataactggctattcatatgtagaagaatgaaactggacccttaccttttatcatatacaaaatttaactcaagatggattaagacttaaatataagacctcaaactataaaaatcctaaaagaaagcccaagaaatacccttctcaacattggcattggcaaagaatttatggcaaaatcctcaaaaggaatcgcaacaaaaacaaaaattgacaaacgggacctaattaaagtaaggagcttctgcacaccagagaaactatcaagggaataaacaaccaacttacagaatgggagaaaaatctgcaaactatacatctacaaaggtctaatattcagaatctacaaggaatttaaacaaataaacaggccaaaagacaaataactccactaaaatgtgggcaaagtatatgaacagatacttctcaagagaagtcatacaagtagccgaaaaacatatgaaagatttctcatcatcactaatcatcagagaaatgcaaatcaaaaccacagtgagataccacctcataccagttagaatggcttttgataataggtcaaaaaataatagatgttggtagggacgtggagaaaagggaatgcttttacattgtggatgggaatgtaaattacttcagccaccgtgaagagcagtttggagatttctcaaagagctaagagttgaactaccttttcacccagcaatcccattactaggtatctacccaaagaataataaatcatcctaccaaaaagacacatgctcctatatatttatcacagcactattcacaatagcaaagacatggaatcaacccaggtgcccattagtggtggattgggtaaagaaaatatacatacatttacatggaatactacacagccataaaaaaaccatatcctttgtggcaacatggatgcaggtggaggccatcatcctgagcaaactaacgcagaaacagaaagccaaatactgtgtgttctcacttataagtgagaattaaacattggatacacatggacataaacatgggaacaatagataactggggaacatcagaggggagagggaaggagggaaggttgcaaggcctgaaacacatcctacttaggaccatgctcacttcctgggttacaggtttgattgtactccaaacctcagcgtcacacaatatgcctttataacaaacctgcacatgtcccctggaatctacagtaatagctggaaaaaattataatttgtaaaattccaaggaaaaatcagaaatatcaaatttagaagattttttttattataaaacaaaaagtaaataaaaataaaaatggtggaaagaagcacagtctttgaactcagaccttgttagagtctagaatcagccacttcctgaatgaccgttcattacttaacccgttaaagcctcagttttctctgtaatgaatggggtactactatctacttcatagcattgtggtaaaaaaaataaaaataaaaataacatatgaatgcctaaaagagttcctagaactagatactagattatcagtattattagctattataatgtttatacacaaacatttatctacccccacctttttaaagatgacattgtttgtataactttaggctatgattatttgactatatcaaaaggcaaatatatgcttctactttgtgtgcgtgtgtatatgtgtgcacatatgtgactatatttgtggttaatagtatgctttttaagtgatctctgaaatgtgtgtatgcccaattattaatatatatttaagtatgttaagtatataagtggaatctgtccttgatttacaaccataattttttctagaataacatagcactctgcaactcttttcttttctttattaactcatgagaacttagttccaggctagataagaaattacagtgttttattttcaatagtttgagactatgatattttgctctgatacctttttaaaatattttattttaatgactccccatttctaatctctgcatataaaatgctaaacagctagtgttttgtcgtgcattaaaagcacctcttctttttaaaaagcatcctcctccttttagggaactgcccttctcctctttccaaccccgtgattctgggaaagaatgcagtcatagtacccctggtcacacagttgatttgtctagagctgctcattggaataaccaggttagctagtaagaaataatactgataattagaccagatgaatctcaactaaacccaatggatccgaacctctggggctggagcatggaaaatctttagttttagaactatcttggtggtcacatgtgcagtttagaagctggcacctgagcgaaatcaagccaagcagattgtttctcaggattttctacagtggagtatgggagcagagagggggcagcattcccactgtgtagtaaagtgtgacatacaatacagaaaagtggccactatgtggtctttttgccatatgaagtaatgtcatctgaaataatgagccttcctgcagagaaagctagagactggagatgagagagagggaaagaaggagaaagagaaaactggcaacttccaattcccatgttataactgtcccaaggacccaatcagaaaccaccaccctctttcctatgtctacatgagccttcccttaaattcctcttatatctaggtaccccaaatcaggaatgtataacttgccaacaagtggggctttatacaaatgtatcttgaagttgtactttagctatcactattctgaagttgtcaggtaggtcatgtcctagggtcatattgccacagcctgttctcaaaataaatgttgcattgcatagattcttcatgcaatgcaacatttctaaattatttttctaattatttttctaatttctttttctaaattctttctaaattcttttctaatttttacttttaatttctgttggtacatagtaggtgtatatatttatggggtacatgagatgttttgatacaggcatgcagtgtgtaatatcacatatcatgtaaaatgtagtatccatccctcaagcatttatcctttgtgttacaaacaatccaattatacttttttgttattttaaaatgtacaattaaattattatttagaccttttctaaattctaatcatgtctttcaccatggagtaagatgataaagcaaagctctccagtagaacaacattggcaggttgccataaaccttaataccccaaagcttatacatatagtctcctttaactcattactgtgtcctaacttccaagaatgaaagagcaatttttcttaaagtggcaagtaaaaagaatgactagggacaggtctgcaaatttaggtctccactgcctagaaacctttctgatttggaaaccagctggcttttgtgtgtgcaaagtgcttttgcagtgttaactatctgagtcagatgtcagggaaaaaaatgtgtgtgttagaaatatagtttacagacattcggaggggcattaatctaacttttctttagatgtaagcatcaaagtgtcaggaatgagaagtgcctagtaaacatacctcaaagggctgagttagatgaatcggcacaaaatgcatttagctgaaattcagctgctgactccagccttctccatttttctctgtaagtgctcagctgagttatctcctttctctcgcctcacaaaccctctgccacctgattattaacaagtgctgtcttccagttcattagtccaagtcttactgccctcacatcatctaaactgaccaatatattttcttctgcgaatcacttgttacaatattaccccatctttgacatggccctgatttttaccagcacatctaatgctaggacagtcatgtaccacataacaacattttgatcaatgacaaactgcctatacaacagtggtcccataagattataataccctatttgtattgtaacttttctatgtttggatacacaaatattcactattgtgttgcaattgtctataatattcagtattaacatattgattgtactggtttgtatcctaagagcaatggtctataccatgtagcctaggctataccatctatgtttgcttaagtacattctgtggtgttcacataatgatgaaattgcctaacaatctatttctcagaacatatccctgtcattaagcaacacatgactgtataagggtacttttaaaactaacagcttttagacaaaatctgcaatggaaagacttgcatagaaatgacaaagctgtatccccaagttgaatgttctaatcaaagtagatttatttccataatttgtaaaaacaaggtgtgggtggctaaggagatttggcaagaaaatatctaactcaggggtacgagtttaggatctgatggagttaccagattctgagaatattggaaataacaaagatccagggaatacacaaagaggtctaacatctgaataatacctgggtcactagattacaggtcttgagaaatggtaaagctggaaattttgctatttgcaactgaacaaatcataacagctttggctctatatttctgtagcttaactctcaggctggcaaaaaatataacttcagtcattcctagtgctttcccaactacttcagtcatctgcagaattgtccagcagttctatgtccttacacagtgacaagacaacccacacattgtttggtttatcctcacaaataactgctgtgatagtcattacccctctctgagttgtttctttcaatagtggacctttgttggttatctcctcatgttattcttcctaccccttcctaattgtccctagattttggttcagataatccctgtgctttgctagaagctgacatgactctgaattgcaagggtgggtttttactgatttaggccaattgataccctggcctccattagtggtggatatgcaacctaatccagtaaaatcagagcaaattccatgattcttacttagaactttgaggcagaagcccacccttctctatgagcacgaagtaaggaaccctgtatctggaagagtagcttgaagctgttttgtgactgtaggggtttccatctttagaatgaaaccagcattttagatggcagaatagataaatgaaggtaagaaaacaggcttggtgacatctacagaccgtaaatcaaaccatctttgaaactttccttctgaatttttattacagaaagctatgaatacagtttattagccagtttgcattggtgcttttgtcatatgaaagtaaacaacaaaaccctattacatagcaggtcatgaaatttttaggaaactgcatagggccccaacttcttagacatgctttaaaatgtccatctctgacagatattttctcccctttcttagtcaacataatcattcctcaccctacccacccccaattttggaaacctcactcttgttctcttcttcatcaagactttgtgcttttgtagagaattcctgttctccattgtaccttatccccaaaccctttaattttctaacgtgtttattaggttttgaaaacaaaagcagggaaatctttacaggctgcttctgagttcaaccctgcttctccctgcttcctcctacaatgaatacctgcttcagtgggaagaaaggaaaaggaaaaacgcacagagaagtaataaaaacactagtagctcgaaatagagcctagttacacagagatgtacattaggaaaaactgaaattatttcaagcatttgagcaattgttagaattcagagtttacaagcttatattttatccatttaccttgatgttgatgagcctgatgcattttaaactctcaaattatctattgtttgaaggaaaagaatgtatgtattatgaaaataggcattaaaacctgtttggtgaattacgtggttttaaagtttaagatgtttggtctatatagacttagcttaaattaaaaatgcacatgtagtcatttagaaaaatgtcaccttggatttaactcaatattaccaatcagatttattgattctaaaattattcttcactctattaccatttttaactgatcaacttcttcttatcattcaaaacccagctaatatgttatctcccctgaaaagccttgtcaaatatccccagagttagcttgtcccttctcttcattacttcaaggctttcttctcatcatgtgttcacatgtgcctaccttttatatactgactaaaaaatgagcatcatattttattcgccttatattcccagcacctggcacaaggtagatgctcaacgttgaaactgaaattctacaaagacactgtatcagtcaggataggttaccgaaaaatctcaatgacctaccagattgcaagtttatatcttactcctattttagtcttccaaggacagagactcactgtattagagtctccagagaaaaagaatcagtaggacatatatatatatatgaggggatttagtatgagaattggcttatgtaattatggaagacaagaagtcacacaatctgccatctgcaatccagagaactaagaaagtcagtggtacaattaattcagtctgatgccaaacatctgagaagaggggaaaacaaggggcaggatccatataaaatctagagaccaaaggtctgaaaacctggagctctgatgttccaaggtaggaagagataatggatgtcccacctccagaagagagcaaatttgtccttcctctgcctttttgttctatctgggacctcaacagattggatgactctcacccgcattggtgagggagaacttctttactcagcctactgattcaaatgctaatctattccagagctgccgtcacagacacaccagaggcaatgttattatcagctatttgggtatcccttaagccagtcaaggtgacacataaaattaatcatcacactgaccaagacttcatcgtgatgtgttcacctttgtaatcacaacctggattttaaatttatctctggcaatgacacacaatgctttattcacattttactggcctgaaagccagtcaccttttctttttttttttttttttttgagatggattctcactctgtctccaggctagagtgcagtggagcgatctcggctcactgcaacctccgcctcctgggttcaaatgattctcctgtgttcaaacgattctcctgcctcagcctcccaagtagctgggaccacaggcatgtgccaccatgtgcagctaatttttgtatttttagtagagatgtggtttcaccgtgttggccaggatggtctcgatctcttgacctcatgatccacctgcctcggcctcccaaagtgctgggattacaggggtgagccatcatgcccggccagcaaatctcctttctacctggagctagaaagatggaaagtcagatatatttggggtacagcaaaaataaccaacaaaaaagttaaatatacaaattccaggttgaaaacaatggaatcagtactgttcttttcttagaatcactgaattatgattagaaaactaaagtttccagagattattatttcacattctattgattaaaaaaaacctgtagatattttaatatacaaacctatgaactaaaatatggctcaataaaaccaatgtaactaagcagatttatcactactcaatgatgagcctctagtagttaaataatttttttgaggagacacctgcagccactaatagaatgttaactaacttggctcctgttcactttgattttagctgaaccaaaggaaaatctggagtccaaaagtttaaggccctaaagggctaaatttttccttagtttattttttttcatttggcattttatcactagaataatcaatttagctttccagcaaaagacaaaggataaaaactagtttttcctcctgagagtgtgtgtttgtttatgcatatatgtaacagatatacaaatatgtatatacaagtataaacatatatgtacaaatatatgtatgcatatgtctatacattttcatttacatactttttaataagtatgttgtttcatatatatttatatacattctatattctatattatatatatgcatatatttctttcatgtaattgtatgcagttatgcatgtcactagatagtaaatggatggataggtaggtaggtagatagatagataggaaaataaataagaaaaaagaatattctttggaggttgggaccaatgctcagtgcatctgtttctagtgctggtagcagtggcagtgtaacagtaagtataactctctattgtttattgaagtttggaccttatattctaatcactctacaatggctcttttatatcttaacaataagcatgttacataagttttgagcctctgttttatagataagcaaactgtggttcaaagaagttaacacatttgtcccgggtcacataacaagtatatggcagagctggttaatctgtcttaaatcactaagatgtgaccagcaaacatggaaaatatggaagactttttggagtaatatattcattctctcactagtcatgatatagtcagattgccttcaagacttaagcccacctatcaaaaggaaaactaagccagataacaaaggtaaatattgaaagcctgaaagcagctgagagagaaagatgaaaacagtaggtagatagagatacatttatttttgtttgtgattattccttaatgtttgggaaataagccatacttctccctgctcatctgcctaacttattcaaagctccgtaacattgccctaactccagggaaaaacaataacaaaagtgacatcacatcctgcatgtttagcatttttggaactcgtgaataggaatacagttaaatcagtgttccaattgtgttgtagacatttttctcataaaaacgtatctatattttctgaaacttaaaatcaatgagatgcttagttgtatgcatgcagcattattgttttacttgtttgacataatgtatatattatgatacatctcatatttcatattacgtcactattttcaaattatttcttagatattcattttattctccaaagtgccctgtgaaataggaaaaggaaacatgatgctcctcattttgcaaataagaaaacaaacgctcaggaggtgtttacatgggttcccaagggtcactcaatacatagcaaagggcagtctgaaattcacatctttaacttacagcttgattcctttcccattatctcttgtgactgtggtttttttgttttattttaatatcatacaatttcagttaatcatcctactcaggtgaaactaactgaaaatgtcaaaatatggtcattgatttctcatccaaactaagctgaaatcaaaagaaatagttctcttataaaaaattggattttaaatcaccccaaagtatttaaatttacttttctaaaagcaacaattataaatattaagtactatgaaagacatttctacataccaagtttttatcttgtacttccagtgagaactctttagccctctaaatttggaacaattactgtttgaaagcgttttcttaaactggtttgaattttcttctactaaattctgtgtatttttacaaatacagcaaagtgtttcgagtgtggcctttgtagtcatttagcctgaaatcaaactgtagctttaacacttacctgctttgtgaatgtgagccccactgtggctcagtattctcatctgtacagcagggatgataataatacctacctccaaggattcctgtgacgactaagtaagtccaaaaatagaaaatagactgcttagaatagtgcctagccctaataagtattatataataatttgttaatagtaattattattattactactagtccaattgctattcatgttataggccttgagaaaccagcgtcaatctcttccctttcgtcttctcttctgaagattcatctacctccacatttctttaactatttcctatatggtttcctccctctggcaatgctcctgattattattctccctcctaaaatgttatcatattttataaatatgcattgaatgcctactgtggtgcctggaattcatgggttgtttattcaacaagtgtaaattgatcacctctgtggcgggtgtgtaagatgctgtgaataggaaatgaatgagacagtctctgccctcagagagattaaaggtagaaggggagacagacatgtgaatgggatgatcagggcaagctatcataaaatgtcaactagacttgactcttcttgttctatgtaactattccatgatacaaacctgataaaaggaaaaaataatctttcttattcactttgctgtggtaaaatgaaaacccagccttttccattggccagttgttaaagtgaattttttttttttttttttttttgagatggagtcttactctgccatgcagtttgggatgcagtggcatgatctcggctcattgcaacttccccctcttgggttcaagcaattctcctgcctcagcctccccagtaactgggattacaggcatgtgccaccacgctaggctaatttttgtatttttagtagagatggagtttcaccatgttggccaggctcatctcgaactcctgacataaagtgatctgcccgccccagactcccgaagttctgggattatgggcgtgaaccaccgtgcctggcctaaagtgaatgtttcctagttgtagtatgtttctctattcctgaattcaatgataaaatatccaggtgacaaaatattttgtgagaactatttattactgcttcaaaattaaacttgtgtcagtgttagttaatccccttctcttcaagcatattactttagggacgggctgtcttcagcctgtttggtttgatcgacattacaacacacgtttgacctatcatgtttggtggaacctcgaggatgctcctaggtgaactgatcaaatcctttggcaacactttcagatgcagttgaaatgcagcatactgctctgcctggacaacctatgcatcactcagacttggctgttctgaataagaagggaattttttccccaaatgttctggaaatctgatctttgttgttaaatccatccattgtattaccttacctaatcctccttgcagcaactctgaagtaattattgtcatatctattttgcatactgtggtgttgagtgattaagtaactagtataagattgcatacatagccaggatgtgggagagctgagatttgaactgagacttgttcaaatccaaaatttcacaaagaaccacttgctctatggtttcagtgtttctatttctactgattatcagggctgactgtattgtttcacatagtattataattttcactttggaaagcttggcatttgaacagctaacaaggggattcttgcctctggtttctaaggggatgtttctcactttgaacatagaatctgcatttgtgatcagtagggaagaaagagtaatggcattaaatgaaggcagcactgactgtgaaatcagctatcttttaaatctcaaggttattgaattaatgaattagtcttagaaggctgtgtatcattcttagaatcctgagaaaggaaattgaatattaacccagttcacatctagaatgcacaatttatagccacatgcagactgaaccatatggtggaagcattctttcatactttcagattagtttatgttgagtgccccatatagagcaggtcttttcagagacttgtcttgtgtgatcaaaataataaaacatctgttgataataaccttgagaacaaattggtgcttcctaaatttgtttgagctatgaaatatctcctgtaataacgaacacaagatgtgcagacagcatttgaaacatgcacgcacacacatacacacacacacacataaaatttggtcatgtcacctgaaaattatgccctccagcattgccgaaacctcattcacagaaaactcagcttctttgtgaatacatggggctatttttttctctttaatgatagagtatggttgtgagttttaaaaagtccagaaaaggagattaaataaccatgcttagacagtttcatatgaggcatgtcaaagctgcatagtttcaaaacctcaagagaaagttgagccttctaaagatttagaagccaccactgaattgccaggccccaagccaccacagaattttctggctgtctggtaagttgccacaacctacacagttgtagccaaagacatactgcataccagaaaatctgtgattctcatcaaaagctccccctttcctgccctgggaccacaatctggttagaatgagcctgtggaatagtttgtagtgttttttttctgctgtgcctcctcccttcagttctgcatttggcatgaggttcccttgaataggccagaatccctggtagaaattccaaaagaaaaatgcagtgagacatttttacctcctactttgtatgagtagagtaagtgcaatagatctttcagctcccagcaaatgaatctcctgttttattgagcatgaatgagagtacactatgttttaacaaagtactattatctacttcccatgccacgtagagctctccagagactttgccttgaccataagcacaattaacttttagccaactgcaaagtttctgacccactgtttacggtcatattttgtttaaaaatctcagttctagccagtcacgtcctgttcatctttttgtctcatgtacttactattaacatgttacatattgtccttctcgagtctatgaaaccatatccttcacttcgttagattattcactagatagaatagattctcatatctcattttcttatagcacagatgtgatgatgatgtaataacagctcctaaatagtgagatgtactactgaagcctccattatgttatttaaattccacaaaaaacaagcatttaccttttgttatcttcattttcaaaataggaaaacaaaagattttagtaaagtaactcaaatttataatcacatttttattaaatggtagggtcagaattcatccctactattttgataacttctatgaaagtcatttttcttgctgtgaacctatgtggtagatgttatttaaaccattatacagatgaagaaactaaggcttagtaagttaagtaagttactcaatatttagggtttgtatgaaaaagccagggatagagaaaaatcatgcaactgtggatatctagaacattctttctccttttatattctcaccttgggatcgccatctgattagccagaaaacaaccctcactgtttgcgtctagtcagccactaggtcctataaattccacctctcaaattactcttaaattccacctgtattttcccagacacaactacccacttcaagccaccattatgtctcatcagaattagagcagccacctaactagtctttatgtcccaggcttaagtccccacaatgtattactcacactgcgcccagtgtgatctttgttcaaataaaccataatactcattatgctcccactgacttttagataaattccgaccttcttggaataaggcaaccaagccttacatgttcgacctctcactgaagcttccagctcatttcttaccactcccttcttgcatgtgtactccaaccacacggcatgacgtggaatttttcaaactcatgggctcctgcatttctcactcttcttttctgcaaatgcccttctccatgccctactctctttgcctgactactgcctgctcaaacttcatatgtgaacttgatattatgtccttctaggatccttccctgacataatccttaactcttggacttctttcccctctgttgttatttaaaagtcttcgtcaagatttactgacccctgtccagtacttgttgatttcctttggtaactgctcaaaataataacagccccatttttcttgtcctttaaaaaacgtatatttgattaaatagaaaagaaaatagcatcctagttatcttccctgccacaattttgtagccatttatgggtgaaaattttccatctagattctacctagtcagggaattaaatgttgagtctctgctggttgagcaacatttattcactcagtctgtcagtcaataagtatttactgatcacctatcatgtgttctgttctgttctgttctaggcttagtacatatagcagtaaacaaaaattcttactctcagaaagcttatattttagtggggtaaacattaagtaaactaacctaatagataagtaatatattagatagtaataaatgaaatggaatagagcagatttattttgactttagtcacccaaacagaagaaagccactttatgtttcctcctaagatggcaattgccattcaaaatgatcattgcccttcaccccttggctagtctgggtgggtgctgtaatgactaccctatattggctggacttcaggcaccatcagaaaagggagagggtggaattagcaggtgtttccgttgtagaagtatcaggacactccacaaatatatcagttgtacaaacataaaaacagtctccatttcaaattagttgaggtacacacatagacacagacacacacacacacacacacacacagataacaaaagaggtctcttgagacaagactacatgtgatgtaattctatttttatctgggaaggagagaccttcaaatctttggtggtgggaactgtacctagttccctgctgactgggtgacttggaattaaccaggttagaagacactgtgtgtgtgcctagttgggtgttcagaagataagaagctaagctttaaatatgaatgtgcttttgagcattgtcaagccctgaaataacatgctgactatacccatccactgagttccagtagatacctaggctttaataaatagcacttcttaacccaaattgaaattacctgtattcttttgtgtgagcctaagaaaatagtccaaggaagtaaactgtattgttgctgtgacatgataattgcaaaatgaatctgtttattccttcctcctcaggaagactgtttctacctaagtttctgattggatcagaagctctccctagatgttactgtagcacccaaggtcatttcacgctatgtcatgatagcctgtttcctaggcagtcaccccattccttccctgtgctcaactagagctccttgagggtagtatcttttgtagctgaattcccagcatctaaccgagtacaggcacatagtaagaaatacctgaaggaagaaaggaaaatgggtatctaccaaagtaagaaatccatatcatgaatcagaaaatattagagctagataaggttgacagctaattcaacactatcatttttacggattttggcaaatgaagaaatggaatgtcacagagttacaaggacttacccaggctcaacacagctacctcattagtttaaaagccagatatcctatattgttccttgtctggttatgaaatatatgaaatatttgaacaaaatatgtcttcttttacctgggcataggggtgtacatctatagtcccagctattaaacaggctgaggtgagagggttgcttgagcccaggagttcaagactagcctgggcaacatagcaaaacactgtctctatttagaagaagaagaagtagaagaagaagaagaaggaaaaaattattctctctcaagagatccaaaacaaaaatgattaattttatagtgaagtagttttaaatggaaatgaactgcttccagtttagctaccaactttttacacaattttttgtatgtggtttggaaccaactctaacctaaaacagaatgctttaaataaaataatcctataaatatttagcaggtacaaacctcctatagcccacactggccattttgagatgatacttctaccagtttctttgtttgtcactatcctaagaagtcatgtgacctcagttacacctctaaaactaaaaacatcaataataagaatagaatatatttcctcctctggttgccctgggattcactggaattttgttttgttgaagatattagactttggatttgctttttacattttaaatatattctgattcttgtggcctcatattattgctatctcagaagaaaaacatttgagggaaaagtattccttcaaagttcctgtctggttgcctatgctacagcatgccaacctcgacttaactgtttaaactttcatttattttttacaactattcaatacatttacaatgacttttggtcaaaggcaatgatgttcagacctacttctgtaaatatagcttttctttaaagatattctggttgtttgcttacttctaataatctgattacttttctccatttcctgtttaagacacatggatattttcatgccgtaaaaatccaagatttaaaataatgctaattctgttgaagtgctgtttcatccacttcatttttagtgatccttcaggtcttagtttaaccattactccctcaaagaaactgtgttagaccttccaattcaaattagctatcccctgttattgttctctcacttagtactggctattttattcctatttgcttatttcttgttttaatatctgcttctgtcattagatactaaactctgaaatcaggtaatcatccttgttttgtttaccagtgaatatactgtttactagcacagtgttttgcacatagtaggttctcaataaattaagggctatattaaaagaaaaattgttagtattcagtgacagagttttttcagtttttcttatgtatcgttatctttgtgctcatttctttaagtgatgtgtgtgttcaggaatcattgccaactgagaaggtgaggagactataatagggagtcaaattattttatcatgcttcttgtatgtttctaagcatctgcacattaccaccccaacgcatggtggaattctccaactacaagcttaaagcttatagatatcaggtatcttgccaacaccctgatgaatctgctttgccccagtggtaatccaatgtgaaactgaacatttttttaatcacttagaataggctgggcatatactaaattctttgataattacctccagctgtttaaccgtttggactaaagctaaagccagaacaaaaaacaggtcatgccctgcttttgatatatgtaagcatctagaatgtagaaagggttggaaagcttcatgtgagacatcaaaattaaaataaagaggtaatcctgatacacaaatcagaataaatatctttctcttgtgcttttgtttatttgtgtgtgtacgtgttcaaacgttttgtagtttatgacaaaaaaaaaacaataagtagaagaagggtcatattcacatacatatatggccagaaacataatgtcatacatgataatgcatccagttttatatgtcaatttaaaagataaataagtaattttgaaaaatcacaaaagaaaaccattctgtacaggaaaatcaatagtgactggtgactttaagtttagaaaaaacatcactgtttgggttttttgttggtccttttgtttcctgatttcttgctcttcaacccaaatattttcccctacctttgcatataaggcccattgtgattacaactgagtcacctttccatctgcatctcccatgacccccacctcatacctgctgcaatacactcagatgtggttcatcattatgatcctagtgccctaatacttgactgagagtaaacactagacaaatatgaatgaatgaatgaatgaaattctatagggtgaaagaaacaccaaaacttcctgctcatggtaggaacacgaaaaaatagataccatttatttatgtatgtgtgtgtatacatgtatatgtatgtatatataaacattcatacaagtacgcaacatacaaatccactcaaagggctcagacctactttagaagatgctatggcatatttaccattagaacattggaactttatcttaggcgtcaataatctaagctgactcatttgccacttcactgacctgtcttccctgtttctctggacagctgtttctccattcttcaacatgctcatgtttcctaagctgcctccttctgcctgtatgtgaacttcatctttttcttcttttaaaaccagctttaccacttatgttttctctaatccctttctagatgttgtcaaagaagacaccacacaccctggctatcactattgggaatgtgtgttggtgtgctacacatatactggtctatttatgaagtacatgtatgtgttggtttttctgatttaaatatcttaattgcatcatcttaaccctatgttttgtaatatgtttgcctttttaataatgacctcttcttactttttttttttctctgtatgagtttgtttctcagaacaggtagttccactttcaatgagatacttctctaaaagcaaactgaagaagagaagcaactggggccatttgcttctaagtttacaagtgtaaatttcatgcatctttaccctgtagtttggttttgtctgttttggagagcagtggtttatttctgctgttacgaccatttaggtcacaagttggacacaaatagagtactaaagaagcagtaatacatgattattttaccttagtagctgcttaagaacgatcatatacagatttttatatgtgtgtgtgtgtgtgtgtgtctatgtgtgcgtatacttatatatactttatatatatatacacacacacatatatgtgtgtgtgtgtgtgtgtatatatatatatacttttccacttgtacatgtttgatgtttgataatttcttacagttgcagagctgacagatcaccctgtgtagccactgtgctctgtatttctttgtatccttgacaatgcctaaaataaatctttgcctactgtaggtgttggtgaaggtgtgatttcttctcttgtttccaaggggataagcaaatgtttaacttgtgtttctatgtagaataaaaatgttgcaatgatttttttaagaacgtcataggttgacttactttgaaacattttattaatttttggaaacttgtgtgtagaacatagtttcagactcatactcccccttcttgagattgtaattatggtaggcctatctgggcctgttgtttgtgtgtcctggcataaattcactatgtgctatctcaagaatacctttttaattgataaagttagggaatagctttatgagcaagaacttttgagaaatttctaaatacttggtatagtactaaatattgtgtttgtactttctttagtacttgaaaatattaactatttaatataggatttatatattactatatggtaattgtcttatgaaaattctaagttcgagattgtagaaagaccaggtttctagaaatttagtcctttattgagatataattcatagttcactcactttcataagtgcttttgggggcaaggaggagtgcagggaaagtgtactcatatttaagaccccataatcggcaaaatgtagatcttattccctgtaaaccttaggttaaggttactattatctcttcagtttgtctctaatacaatgtaaaaatactataaatattttcagggtaaatgaatttagtggtgcataatttacgttctcaaaaaaagcaactatatacttcttttcttaccatacactcttctgcctgacgtggctgttttgaggcaagatgacaggccatctcacatcatgtaccctgtctttggaatatatcatttgaaaatgaaattatgtacaacattcaggtttgagtagtactgagacatgtagcctgggcattgaaatttgggggacatttggacagtttatatagataatgagactgtataattgaccttgagatcaccctggaaaattcaagtaacaggctaaggtctctcacagatgccttcctgaatacccaaacttcttcctgctgccatcctcttaaagctcccccagaaggactgcagggacttcaccctttggacatatgccatctagtctgtaaatgtgtcatggttcagtagatgacttcttagtccttcctagatttcaaagttttcttttgggcctgaaggacgttctgttgtattacatctaactataatactatctcttcagtcatcctgaaaaaaactgtaaaagaaagcctgtttaggtccctgaaacaacttttcctctgacccatttagtgtactgtttcacttcattttcatctgccagcagattgaatgactttctctgggctcagcatcattaggctgaaataaaaagactgcttttaagaaaacgagttgacaacttagaagtttctagcagaacatgccaaaaaaggtgatctattttataaattgtatgttgaactctgaagttggaggaagtacttttaaaaccatacacgttttttcaacttaaatggctactgcttgtgttttttttcccccttgtgattttttggtttacccagctgcacagcctcgcttgattatatcaatgaagtgtatattgccccctaaatgcctgattgatccaattagctgaagactaaaactttttataccatgatgtaactaaggggggttgggggaatcttgaatatattaaagtcaatcccaatgcagaccgaaaaaatttaaaagaaacctgatagagaaaaagcaaattagaacagttagatttacccagtcatacatatattattcacatttctagaaggaagaattgtttttgggacaagtaggctcctaagtggtaaagagctgttttggtaaatctgtaggtaatactaaatatgtagagagtgaataaaatataggattgtatgagagatcaataatataaaaataccttatcacttttaaatcactaaaatgcagcaaattaacaaaatactccaacaaagtatacattgacagtatttagcacagtaaatcagtatgttttcatataagcagatattggatacaactagctagacaaatttctaagtgtattggttacaaaaggcctttaatctgagtcccagctactggtctaacatctcacaccttcttcctacttatccaactctctacccctattaaatggcttatagtccattcattccacacttatttattaaacatctattgttggctgctacgattttatgccctgggatataacaatgaataagtaaaatgttcctgcctcctttgagcaaacattgaaaagggggaacatctataatataaataagcaaataaagcttttagaatatgttagaagatgttaagcgttggtattgtttgaattatgtccctcccaaaagatgttgaagtcttaatctccagtacttgtaaacatgatcttatttgaaaagagggtctttgtagatgatgaagttaagatgaggtcattagggtgggccctaatccaataaggactgtttcttacagaaaagggaaatttagacacagagacagatacgcacataagaagaacaccatgtgaaggcaaagacagaaggctgagcatagtagctcacacctgtaatcccagggcttttgaaggtggaggcaggaagatagtttgagcccaggagttggaggcagcctgggccgcatagtgagaccttgtctgtacagaaaaaaggaaaagataaataccaagatcagagtgatgcatctgccaagccaaggaataccaaagattaccgacaaatcaccagaagttaggagatagacatggaacagatcatttctcatagccctcacaaggaatcaaccttgccactaccttgatttcagacttctagcctccagtactgtgagacagtaaaattattatttagagcactaaaagattacatagagctttagcagaagaaggattagaaaggttaattcggagctaaatgtaaaggaaaaccttttgatcactggggagtattggaatgtatgtcagaactgggtatgctgagagttcaatcctagtcctaaacaacaaatttcaccatttgggtttcctctgaaagccatcagtgtagtggtttggcgcactctctgaagtcatgcagacttaccttctaacgtgtatcacaatgtataacttataatcacaatatagatagccctttgataaacatccttgtcctagattatacaaaaattgtttactttggataaattcctaaaactataatggctagcttgacgaatatggcattggcactggctagatattttcaagctgctctctagattggtttgtaccacttgctgctcccacagagtatgcaaataccttgttccctcactgacattcacttattcattaatatatgtttatggaagtcccatcatgtgcccaacattgtacaaggaattgtaaatacaaaagttaactagacagacattctattaccccaaaaatgtgtagtttagtgggtaagagactaaaataactgagcagatcagtttataaaataattgtaaattaagtactacaaaggaaaaaacatagtctaatttttatctttgccagtttgataggcaaaattgttttttattgtttaaatttgcattttattactaatgaggttgaatatagtttcatacgtttacaaattggattgaaatattttttcttttctgaaatcgatatatatacacctctgttttttagttggcatgtttacattttttcttattgagttttaaaatctttatatacaacccatcaatattttgtcttttatattttgtatcagatgatttccaatgcatacaagtagttaactctgttagtatttcctttagagttttctttctttggtattatgctttaaaaggccagcctctccttgagataagttagacatgtctctgcatttttttctactgtattttccatctacagtcttcataaattttctttttgtttcttgacctctgccatcaatatttatttaagtttattcagttcttcgctaacataaaagagtccttttttccatccctccaggtaactatactaattctcctgacccttcgtggctgcatttctcttgctgcctccatttcttcatcatcgtctcactccacaaaccaccctgcaatggttactgtgccccatgagttacactccagttcttactaaggtttccaatgacctccatgttgtttaatcaaacgggatttgacatattcagagatggcaaagtaaaaatgcaatttttaaaaactttcaatagctgattttatcctctttattaaaaaaagaaagggaggaaaaaacttgattttagaatcaaaggtatcttgatttcttccaatttaaagcagtctttttcagataaattcattatattactccataatcacactggtttactatttaacaatcacactagaaaaacaattaatttcactgttcaaatttcttatcagggctatttttaaatgtcaacaaatcttcacattgccttgaccaaacaacttggaaggataagaaatcttatgtgtcctctatggtgataggaacctgtagcttgtgttgtcctctgagtccttgctgcctgcatggctatttctttgtctttcctgaccactgggtttcttattgacagctgtgcctgaagcctacagtggtagaacttgtgatctaggctttcagccttgtgagatcctagtacccccctacagctgacttgcccccatctcaaaatttgctgaccctaaagatcctcagcatcataactacatcttctaaattatagtggcttaggttgtttatctagaagcctctgtttggagggtcactttattcagcataataatctcacagaaggcccactgattctcacctgcttgcctttgaagcaccatcggaagtacatggcaacttctgttatggtccatgctacataaaagctatgggtaaccaaaaacttgtgtgtgtgaggttggatttgtagtattataagtgctgtctcagctttaatcccccttggtttgcatacaaccacctctaactgtactatactggaatttagcacgtgagccttgtctggcagtaatatatgtatttgactaataaaaagtgaaaacaggccaggcacggtggctcacacctgtaatcccagcactttgggaggccgagacgggcatatcacctgaggtcgtgagttcaagatcagcctgactaacatagagaaactccgtctctactgaaaatacaaaattagccgggcatggtggcacatgcctgtaatctcagctactcaggtggctgaggcaggagaatcgcttgaaccctggaggcaaatgttgcggtaagccaagatcacgccattgcactccagcctgggcaacaagagcgaaacaccctctcaaaaaaaaaaaaaaaaaaaagtgaaaacaagttatttctcaacaaatatgatttcttatcacatttacgcaaaaaaatgttggcactatttaagtgccatgtctaaagacaataaatctagtttgtttggcagattcaatatttcaaaataagatatccatgagagatcaaataatcaaagaggtccctgattatggaagtctaggacctctttgacatgtaccgtgtgggactgctattgtcaagtttatggtaaagaaagagagaaaatgggaaggagagagatccttcactaaacatttgttaagcgtctatcatgacagaaacctttattccacaataaagatccagagatgaatacaaattattttccaccctgctagagagattagtgaggtaaatattcaacaaatattgtgtttctttatgtagcaactgatatgatagaagcgtgagaatgaggttctttagaatcacagtggaatttctggatcttacaacctgtgaggtaaggggagtctgctcttttccattgtcaggtagaaataacaactcatggagaggtttgttttatcagaggacacggagatcacattttatgtcacctctccagagctttcttggatgatgtagcttttctggttaaacctataacataggaaaaaaacatgtgctggtagtggtcagtacatttcaaaggtgaatacctgaacacgccacctgaataggctttgtggccccaacaataccatctatcacctgaggttcatagtaaagtatccttcactgaagttttttgtttttgttttcttgaaaggagagctcttttgaatgacagtttgctagattcaatattgcaaaatagctctcaaccgactttatttttacatgcatgaatcacaaaatagaatgttgacaatttcttgcttagttctttgtgagtagaatacattctaaaaataattttgtgaaacacatttttatactaatgaaagcacatgcctcaacttcagaaaatttctcctatatttctgatgtggtaagtagacctgcttatggagcatttacagtggttgccaggaaaaatatattaagatataaaaaatcatctctatgtacttagttgccttttgggccgctatttcatgcaaaagaaatggttaagggattggttaaataatatatctttgaggcttaactttttggagcacttcttctgaagtaggaggccagcatcacactggagactctgaataacaatttactacagagttggattgaatgtaagcaggattcatacagtacccggagcagaggagcttagatacaaaactcagtgaaaggactacatttaaagtgtcttcatctgccaatgaggccttataccttgattctagggttcagctgtagaggatccagggttaatggaggattaaaagtaatattgtcttatgactccaagcacagcatagacttggctttgacttggcttttgcattataaagagaatatgtgaccttataccaagatctgataacccaaggcagtatgaaattatcaatatgaaagaggagtagtttattgcatgcctattgcaaagtgcattacagatgctttatacattttaaccaattttaagcctcacaacaactctatgaagtattattatgcccttttgcaaatgttgaaacagactcagaaaatagtatcttaccaatgaaacatataataagtagcagaggatgctactattgaggactgacttttaaactcactttttttcataaagaaagtacctagcatagtccatgacccatagtcatgtctctctgcaaatattaggggttttttttccaatattttccttctttcttctttgctctccttccactcttctcttttttgtaacaaattgccttttataaaagagcatagactttagaactttagaatcataatccttcccctcttcttaggtagaataaattgttttctcctcttcactaatgtgtggggtgcgtgtgtgtgtctatgtgtgtgtgttatatgtttggtctgtctcttccatgaataccacgagattataaaaaaccttcaagggcaatttaatttgctacctcaaattgaatgtaattttctgcctcattttaagcaatacattcaagcactgctttagtgaaaagaacattagtttattcagcttataaacactttttaagcctctaatatgtgctgaaaatgagtcaacatctcccgaaacacagcccgacaacttttttttttgtttgtttgccctaggagcatggaagttcaaaagtaagtgtctggtgtgcagtagattgagagttgtgaactcataggctgcttgacctcatgcaaaatttaggagcaaaaatcttggtgaagacaggcatcactggtcatcagttgactaatcagtctccaacttaatgggacattgacatgtcctctccccaggtgttctctgaaagcactgagagcttaatgagaaaatctgggttcaggaattattattttattttattttgagatgaagtctagctctgtcacccaggctggagtgcagtgacgcgatcttggctcattgtaacctctgcctcctggattcaagaaattttcctgccccagcctcctgagtagctgggattacaggtgtgcaccatcacacccaactaaatttgtattttcagtagagatggggtttcactatgttggccaggctggtctcaaactcccaacctcaggtgatctgcctgccttagcctcccaaagtgctggaattacaggcatgagccaccgcacccagcccagaattatttttcaccactgattgttttaatttgagaaagccaagtgaccactgagtttctatagcttaacttggaaaatggggctgataagtcctactctatctctatctctcagcattattcaaatataaaatttgaaaaattatacatattatctttaaaagttagcaaggaaaggctgggcgcggtggctcaagcctgtaatcccagcactttgggaggctgaggcgggcagatcacaaggtcaggagatagagaccatcctggctaatacggtgaaaccccgtctctactaaaaatacaaaaaattagccaggcgtggtggtgggcacctgtagtcccagctactcaggaggctgaggcaggagaatggcgtgaacccgggaggcggaacttgcagtgagccgagatcgtgccactgcactccagcctgggccacagagcgagactccgtctcaaaaaaaaaaaaaaaaaaaaaaaaaaaaaaaaaaaaaattagcaaggaatataagtgagagtaaacatatatgagttgtcacatttattgttgttatctgtgacagtgacttttaaaaaggaggagaaaatattttccataatactggctactgtataatgtggacccattgcttaagtgacctatatattcatttttgatgcattcattagttctgtaataaacatagagtacctgctatataccagataaccagggatacgtattatgaacaagatgggaacataataattctggaaggaaaatattactaaccccattttatagaagagacaactgagactcaaagcggttaaataacttatataacattatagctgtgaatcctttccatctataaaacttctttggttaatgagaacccagtaaagtgaggactgtgcctgttttgttcaccgtatatatccagcatgtcacctattgccaggtaaagagaaggtgttcaataaatatttttaaatacataaatgagtgaataaatgaatgaataaattaatgaattgaatgaatgagcaagagtaaagacaaaagaaattagagtagtgttgtagcttacaatccactgattttatgtgcatgtttatatacatattctccaactgaccactaaaaccacataattagtgactgaatgtaaggatatagttattcgaaagaatacatacataatataagtttacacactgtgcttttaaactcagctcaaaaattaaacattgtcacctgtgtagcatgactatgttagcctctttcttacatgcctgtagttctattttgttggttgccataatacaaatttgctgagtggtgcaaactactaagttactctaagccacccagtctagattatttgattaatttttaatgaaggaaacctattttatctttataacccaaatgatttcaggctcagtgtctgtcatccagtctctttacccactctgtggcagaactgtcatgtgagtctgtctagaccactatttaatttatctgggctttttccccgctttatttttgatgcagtgatactgctacaacctttctcagagtcattgtgaagaacaactttaaaagaatgaatgctaaattactaccggtgtatcccctttaatataattcaaccactgtcttttaaaaatttttgccctggggctaaaagaaataaatggggtagacaagatagcagctttcttgagtgattcaatgcctacccttttttccatttgggtctacttagtttatctattttcaggttgcatactggtatgtaaataccttttaacatggtgaaataccgagacaagggacaaggttttatagttgataaatgggggatggaatgtcaaatgagccttacagacattaggcacacttgagaattatctacttttttgaggagtgaaaaagaatatccacctcactgaaagactggccaattcttccctttgcctttggatgaaatgaagttgaaattagttcaggcatcaagccaattctcttcctagtcccctccttccagccatacctccaaataatcagttaatgcaaagtatgctgcctacatcttccacacaaagaaaataaatgttccagtacaaagtcagtaggaggcatttcatatcagaggaatttttctttcatttcattgcatttgtatttgtttagaaacacactcatgcttttcaagaaagggtttcttagcttctaagttgggccttattataggtaactaataagatgttttaagccaaatataaaaagattcgtatactctttctaaatatctatttaagaagtgaaattcttagaggtttgttctgttctgtgaagcttgatacatgtgcttgtttgagcgaggtaaaaagtaggtaaaaatggggcacatcaaaaaataaagatgcttttttctgtataacttctttaagatttcctgctttaattctcaccatgactattaagcaaacacaacccttatttactgtacaagttcagtctttttaaatgtgattcgtatgtgtgtgtatgaatatattacctgtatgaatatatgatatatatttatatatataacatatatgaaattcatatatatatgaatccagttgtaatgaactaaaacgctcatctgcatatggtctcatccacccctactttgccgtggtggttaaaatcttttggactcatcctaggatgagagcaatatgtcctcaggcagatttactaccatccaatattaagtgctgtgaaatagcggtatttgggtaataaggttttatctctaaaatgctgtgttgtgctttgctaccagagatttgtgccctgaccttctgaagaagctgtcgttttcaactcagctttaattttttttttttctgaggttgtcacttttgccatatggtagatgtttcttctgggagagaaggagctgcatgcacaaaaactttgagggaaacattattgtataatttgcttgaggtcgaagccaatactctggaggttggtctatcatttattgtaatgtggcagatattagagggcttataaacacgttttgcttttgaagtgtattcacaaaggattgaaagtggcagaatgtggcaagtcatatttatgcctcagtgagaattattaacctgcctaaagtacaagatagaacaacattttttgtgagttctgcttacccttggacttcagtgtaggaagatactttagggaatcaaagaagtgactggaaaatatctttttggtggcagaatcataaaaatgaattttatttctaccgcaaattagaagaaagtaagtaccccatcttcctgcttctgctgctgaaaggatgagtaaagaacaaaagaaattgtttatactcgggttaagtaccttctaaaagaaatatatacctctgtgctgcactttaattcagtttatttactttaccttcaggtgtagaaatacattagaattgatgttgagaattgaaaagttttatattgtgttcttaaatcttttgtcaaatatgaactcgttagagaaaaatgatttaggctatacttcactctagtagatgggagaagactctaagagaaatatgaattagatttcaaagtttattttctcttaaagtctgatcggattttgcctgtgattagggaattaaggagaaaccatggaggcaaattagtttctcaggcttccatcgggcaaactgttactctagtacacatttgatgcagcaggaggctgaacaaattttttcttcttcaaatggtgaactgcttgatcttttgtagttgatagaagcatgagtaaacataaataaacatggatttaaatatactaattagaggaattactaagataaagccagctgggtggtggtggctcatgcttgtaatcccagcactttgggaggccgacgcaggtggatcacctgcggtcaggagttcaagaccagcctggccaacatggtgaaaccccgtctctactaaaaatacaaaaaattagctgagggtggtggcacgtgcctgtagtctcagctactccggaagctgaggcaggagaatcgcttgaacctgggagacagaggccacagtgagccgagatcgcaccgttgcactccagcctgggcaacaagagcgagactctgtctcaaaaataaataaataaataaataaagcctataaaatgcttacgataataatatcaataaaaataaagtttgcattaatttatttattcaacaaatacttattgcatatttattatatgccagccatggttagaggtgcccataaattacattaacatagtttttttctcaatgaatacaattcttataatataactgatacatgtggcagcagaagtaagttcaatgtactctgggtgtaactgaacccaactggttatctgaacccaactggtgagtcacacaagcctcacagagcagatgatgcttaaaccacgtttagatacatgaggaaagaaggcttagaaatggaaatggaatgagtgtctttaggaatctataagtaggagttgggaggaggaatgaagggagatgagaaaagcccagacttaagctgaaagacccaagtagaaaaccaagtctcccacttagttccttttcattcattttaaattagttgatttattcatctaactataatgagggagcacatatgatatgtgcagaattttcggaatgactaggatagatcagagacaaccagagggttaggctaaaaactaaagcaggctagaaaataaggcaaatacacatatactccgaacataaagccaaagataaattgctttaggaaaggtataacccaatgtgctctaggaccttagaagtgggagcagttgctttcatttgtaaggattagggtgcgtgagatcaagtgagacttcttggagcaaatgacaattaattcaagccctaaaggaagaatagaataagaggtgagggaaagtctgagagcaaagttgcaaggcttatcaggaccatatatttacaaagtaaagtgaatactggggtttgattaggtgacgcttaagtggaaaaccacagtgagaaataggcgttggaaagcaaagtgcaacataataacaaagtgccataaatgttatgcctaataaatttagactttattccctaagcagtagggagccaatgcacgtttcacttgtccctctaacattcatttgacacttaaaatatactgacatttaatgtcattttatgtttatatatcctgcttcttcacaaaatggtaaattctgtggtgttaggactttagctttacttgtcatacacatgtgatatggtttggctgtgtccacacccaaatctcatcttgaactgtagataccataatccccacatgtcatgggagggacctagtgggaggtaattgaatcatgggggcaggtttctcccatgtcgttctcctgatagtgaataagtctcacaagaactgatggttttataaaagggcagttcccctgcacaggctctcgtgcctgccaccatgtaagaccttcaccttccaccatgatcgtgagacctccccagccatagggaactgtgagtccattaaatctctttccttcataaattacccagtctcagatatgtctttattagccacttgagaatggactaacaaaacatggaaagtatttcgattgagcaggacagggatatcctttttattgagtaccttttatgtgctaaacagtatcgaatgcttttacatttgaaaacatcattcttcacaagagtttaacaatcactgttttaaaatgaggaatttaagagaagttaagaagctagcccaaggtcacacacttaataaataaagtccaggatcatcttacctcccaaaaggccccacttgccagtgctcttgcactgcggattaagtttccaacacacgaatttggtggacatattgagctcatagcaggaatgaaattccagtctgtgaactctaaaacttatacacttttcactctattaccgcttcttactgattgagacactcatttcttaaacacatatttattgaatgtttattatgtgtctggtgctgttctagaaacgagaatacagttagtggtgaaaatgacagaaaggttcctgcctcctggagcttatactctagtgaggtactcatacaatatatatgcagttaacaaaataagggtagatggtgataaaggacatgaagaaaataatagggtgataagataggaagtgaccaaaggtggtaatgagaagagtagtttgttgctatcagggcaggctcctttgaggtggtaacgcttgagctgggatctgaagaataaggacgtaaaaatgctagaggtagatataagagcaaatacaaagtctccaagatagaaataaacttgaaatgttggaggaccataaaaggggacatgataattgcagtctagtaagggagaagaaggatacaagaagtcaaagaggagacaggtgtccgtgacttaaattttttttgtcccctgcaaaactaaaggatttagatattaaccaaaatgctcagggttgcaaagaaagcaaatatactcctaaggggaatggagtgcacacaatccagcctttgcctacctccacctcccgtctcccaacatatacctgtgatggaacattgaactcacttgcttccagaaaatatttctttttcctgggtagaggttttatgggcagcactctgaagttagaattgtttgaataccaatgaatagattttgagcccagtgagaatggtgggctgaggggagtttggattattgggtcaaataagttctaatcttaacctagcgttgacatttacacatgacatcttttagtaaggaaatagactctacaaataaagttgtgtaaaacagaaagttaggtctttgaaatccttaccactgccaatgggccttgcatttaacaaatagaatataaaactacagactaagcatagctttaagaagcctgtaactaatagctacttggtacaagaatgtgaagtcagcccaggtgaggtggctcactcctgtaattccagtattttaggaagctgaggtggctgaatggcttgagctcaggagttcgagacaaggctgggcaacatggcaaaaccctgtctctataaaaaatgaaaaaaaaaaaaaaatagccaggcttcatggtttgtgcctgtattcccagctacttgggaagctgacgtgaaagaagttgtagtgagcagagatcgtgccactgcactccagcctgtctcaaagaaacaaaaagaaaaaaagaaaaagaatgtgaagtcatactaggcgtgaggcagtaggaaacctgggtgcatgcttttaaaatctccgtgcagccgcagaaaaacacatcatattgaaaaatcttttctctttaggagttgattccttatagcatgttctgaggtggtgaatagtattattaatttgataagcattcaactatgatagatccatctccatcctcccctcctcaagcactctgctgcctcagctccttgagttcgctttcaaattaagaaaaatggatgatagtcaagggtgatttcaagaaattataatgctggctaatactacctagagcccttggtgtaaataagcttactaatatttactgagcccttccaatgtatcaagttaaatgctttgtcagaattatgtaacaaaatatttacaaaaacagttctaaaacattttggtctcaggatcctttttacacttaaaattcatgaagagctcctatagtttatgtgtattctgtctacagtatttaccgtattcgaaattaaaactgaaattttttataagtaataatttatttataaataataataaacccattaaatattaatgtaacttaaaaaaattaaaactagttttattttttttaagccaaaaagagtagtaagtagaagggcattgttttacattttcgaaatctttttaatgtctggcttaatttaatatagttggattctcatatctttataggacattttttttactcttctgtgaatggagaaaggcagaatgttttcataggcttttcagataactgtggatattctttgataccacattaaaacttgacaaatggtcattctttaaagtttagctgcaaggtggaatctgagactctatcattgaacttttattaccattacattaaaattcgttcatctatcttgcactttaaatgaaccttttactcatgtatttttgtataatatgtattggttgattgaaaattactgatttattgattcactgagctatgcagattctccaaatgttgacatacttccctatataatatcaaaaaatagtatttgtcattattatcacccatcctatcagaaaaaaaagtttaagtcagaaagcttgtcagctcattggtggtgaatacaaagtttccaaattctaatgtgtgcttgaaaattcaaattttgctattgaccacaaatattggcaattattttccttaaaacaacaatctcactttattagttttcaggaatgtttttgtgaaatacccgaaactgaataaccagtttgtatgtcagtcattcttttaagtaaaactgatgttcagtaaatatgtggttagtttagcttgcaactgaaataattgcacagtatttttatttttctatagaaaaccatgtgcactatacaatggaagtgttttatgcatatatctcactgcatcacatagaatattataaagttatggactcaaaggtcaatatttaagaaaattaataatttttaatgcctcatcaaagatattcttaagtaaaattaattttttgtgtgagtgtatgggagtgaagaactctatgcttactagcatacttcggcaccactaccttgatttgtactaagacaccaacagttatctccattgcttttgtaccatcagcacacaggtgaacacagtgaaaaagacaaataacatattattatttgatcttgaagatattttgagtactactagtttataaccaatccaaaaggtattattgttccgtttgttctggtgaagaagttatagttcagaaaacttaagagaattgttcagggtcacaagtcaagagatagtaaagctagaatctgaacacagcagaaatgattacagagcttattttctttatccgttccaagggagtagcacctaatagatgacagcaagtgtccattcccatccctcttgcctagtcaaggttggtaaaggaaagggtgttaaagtcttgttaagtcagaagtacagttggttaatcgcatgttaccattttaaagggaagttattttaaagaaatacaaatttatggctgtagcaaatgagaacctacagtattgccaagaaatactagaagaaataataagtgcacaccgccagaaaaaaatctctagttatctgcctaaaaaaaaaaattctcatggttcagtaaagagtaaaaacagagtaaagagtaaaaagatattgttttattcaacatttagaagtttttaaagatttggaatagaaaaaaaacagcaggaacatctaaactgatttgagagaaagtgagaaaattatacttctggaatgaaaagtggtagtcataaaagtggtaaaaaaaaaaaaaaaaaaaaaaaaaggaaaagtaaaaagaaaaaaaaaaaggccggatgcggtggctcatgcctgtaatcccagtacttggggaggccgaggcgggtggatcacggggtaaggagatcgagaccatcctggctaacacggcgaaaccccgtttctactaaaaatacaaaaattagctgggtgtggcggcaggcgcctgaggggaggctgagacaggagaatggcatgaacccgggaggcggagcttgcagtgagccaagatcgcgccactgtactccagtctgggcaacagagtgagactctgtctcaaaaagggaaaaagggaaaaaaaagtggttaaaaaaaaagtcattctcagatgcttagaatttatgatatcctggtcaatagaaaatgaggaaatagaggcagtggaaatagaaataaaaggatgaaaacaagagttactcaagtgatagaatcaataaaacttggtaaatgatggatgagaggacccagggagagaggagccaatggaaaatgggaaatattgtgccgtactcatgctgttccccatgtatatggcacatctccccaactagactgtaagctccttgagaacaagaactgtacgtcttttatttggtttgcagaatttgacacaatgttgaacagatagcaggttctcaaagaaacaaatgcagaattaattaggtgattcaaagtttagccctcctacattaaaatttcaggtaaaccccttcacctgacccttccttattagctcaatcatgcaaatattttggattattcttcagtttagtttaactcatcaaacatttactgagcatttgctgtcaatgggcattagattgagagagagaaatacaattgcaaatacagtggggcccctgccttccagatgctgaggatctagagaaagagagacacagtgtgaatagtgtctctctcacgttatgaatgaagttttacggaagcccagaaggaagggccttcgcatctgcctgaagcagttggagaaaacatgagagagcagttgaggtggagtttgatatttgaatagaaattcaacagcaaagaaaagaagaattgcagaataggaaatagttcagttcaattcagtttatacaaggatttattcagttctgttcatgtacaggtactatgcaatcctggcatggaaaatgaataactaagtttcgatattttgcattgattctcacaatagaatagggaaaataaacatataaacaagtacaaaacaatgtgctgtgtgcagtaatgaattgtgaatcacttagagaattatatagaggaggaaaatgaaggggaaagtgaggagttactctgagtcaagcacttttctttatgtgttcctcgggatatataaatctacacagaagaaagtacaagctagttcactgaatggtgagcagtttacaaaatggcgaccctcagactatatctctggcttgcagatgtgtttgctcttcacattgttggcctgtggggcagtcatgaggatgtgcttcacagactgccaactacagggagcataattcacctggaacccagctgctaagctctaaaatctgaaatctattcttgagtttgccccaatggctcctctgagccagtgacctagtgctgcatggctactcaggtggggccttttctctgatggactcagagaaaagcaatgaaggatacttccaacctatcttccttctttctgttctcctctttgggatcggacttgcatggtgatctaatagctcttctagccttttctggatgcttccccattttccttcacaagcatttcccctaacaaaattcttagatttaatcctgtcttgacatctgcttctcagaggacttggactagtacagcctaatatatatttacagatataaattcaataattttctaacatttaaaaattgatattttacttaaggaaatttgattcctggcttctctggggtgtggggagggtaagacaatcatccagtaagaggaccccatttcagagaggcaataacccataaaagctgaatggcaggttatcgctttagatgagatacgttctcaacccgcacttctgttttgtttccaatacgaagatcagttgtcattaactcacattcttgctctgttgttttacctctcctgggattacttcaccctcctatatgtgttttctgccttcataggcattggagtttgagatttgttgtttttgagcacatccttgcatgagaaggaaggagagaagtgagtcaggtgtggaagccagaaaaccaatgaggagaactaaagatgttctaaactagagagtgatggcagaagtcgagaggagctggatggatttgaggggtatttcaggggtagaatcaacaagatttgagttttaataaaatgtagggaccgatggggaggcaggagtcaaggatgactatcagatttcttgctatggtaataagaattgttgagcattcttgtttcttccttattttcaatacacaaaccagtctaaatagacatctctgctttaatccttttcagaacacaagcagagatgtcattaggagtagaagatttgatgggactacaaaagaggaactcactccattattaccagcttacactggaaaaatgatcaacaaattaagaaactatgttgggagctaatgagaagtacatatttgctgccagtagcattttggatacatactgttacaggacagaagactgatgttacttagaaattttgtagttggagtatcactgacaacatcttaaatcagatcttaagaattaacagcttaaatattatatttgatcccatattgctctccttgctttctgactcaatccacccagcctattctaaattcagcattctaaacacacaatgcccttgaattaatcatggtaaagcatcacatttgtcatatcgctccttactcagataacctagtttctccaggaaagcccataatcctaggtctgtcactcagaaaactttctcatatacccttacagttgtggggaccaaagtagataactttgcttagaactttttcctgatattcctgcaataacccaccctattttctggccagcatcttgacttccttaagtaggcaattgtaaggtctaacacagtatctgatatatagcaagcactaaatgagtgttacctattattttttttttgacgatgtaagtattttttttctttctctccattaacaccaacatatttctcaaactgaaaaaggcccaagcctaagtcttgatttacatctcccaaactgctttcctcatcctcaccacagtcttcttatctcatacacagcatccctgtccagctatgtgtcacgtcatctttgattcttctcttttccacctttcacgttccagccatcagtaagtccagtcatttctaccttcaaattatgcctcaaatattgccatccccattgctatcagcctagttcagatgccatcaatttctgacctggactacagcaacttgcctctctgttctccccttcagcactctccaataagtttgtacacaataaaaagtataatcttaaactagatcagataatgtaattcccctgttttaagccttttatgacccaaaaacttactgtccccagtgtctgaccccctgctaccttctcttgcctcagctcttccttccctttcttaccactgcatagctattctggtctcaatttagtttcttgaacaagtcaagctctctcttttccttaggccttagcacatcttgttcctctgccaagaatacttaactgccacactacctcacatcatactcctcttctcatcttttcactgttctctccttctaccctaggtctttcttcagtttcaatgaaaaatgttagccattttttctgtctttaccatctttttgttttttaaatctccttctgtcttactgggaaacttcagtgtcagctacaaagtaccctgacttgatcatcacctcaatacactcttataacttgacctttactatactcacatgactaacactgagtgctgctttatctccaaaatattgaaccctgaaatctgccaatatccacagcctgttgctccctcttccttcccctgctccccataaatctatgttttcaccttatcgtatctccatcttttcaccctcttctgttcttccagtctgagtatcttcccttacgtctcatattttcctatcttttctaacatgttactcatcacttacaaagtaaaccatatctttttccccaagcctcacccctaaagcaaccaaatcatccctttcactgttcaagattactaagctctgtgggagaaaatcccataacacgttgatggcatcccaccatggtgctgcttagcaggctccagctgatccctaagtgtctctctcttgcctcaaagctgcagttccaatcacttacagctttacttaagttttcaacttcattctagacctttccctctgatgtcctgacttctaaatatatggagtaaagacatctaatcagttaagacttccttcagcctccttctcctctaccttaaaatgacctttaatttcttccaccttaaaataatactataacttaccgtaggaactcagttactcttatctcagagggcgaagtattcctccccctacccatggctgagttatgctgtgtcaaaagcgaacttattttttctaatgttacacatgttgtacaagtataatgtgtgtgtatgtgcatgtgtatacatgcatatgcgctcattgcaagatatatttataaggaaaattaaagatggagtgctcaaaatgacaaaagaaaaagatctacaaagcactattaataaattaatcagcataattacaaacttttataatgcatgcatattgtaaagtgaggtcaaagtttaaatcctaaattgtctcctactttatctacaactattttgtaaagatcttttcatgtcagcacataaacttatacaatactgttgtattgtggctatactacatgaaattaagtagtacctatggtgggactcaaagagtctgaactctgggccccattctcactcctccttcaagattatgtttttttgtgtgctctcttctctcctgtaccttcaatctccctttcccaggggcttctttcctttagactaaagagatgcttgagtcccctccctgccatcctccaaaatctttcctctgctttttctccttctctttcgatactgccacatatctcccctaaggctaaaactctctcacacacacacacacacacacacacacacacacaccctaaggctaaaactctctctctctttctctctctcacacacacactcacacacacacacttctctcacacacacaccccctaaagctaaaactctctctctctctctctcacacatacacacacacactcactcaaacacacacacacacacacacacacacacagataataatctactttcactgtgtttacttttctttgcttctcaggagttctttggtctacaataatctggcattctctcttggcctatttattaaactgcttcctctctaccatcccccatcttgttaaagcatttttatgtaaacatttaccaatccccaaatgaagtattctcctgatggcttttctacccagcagcttccagaaaaatacaatttaatagaacaaactatggggcatcctaaatgcaattcctgtagattgtataattgtgaaaagggcatttcttattcctggactaagcactttgttccaggacacatacattattagatagcatttaaaaactaaataaaaaatttgaggaaaaaaatctctatttagcaatggtagttagaaatgtctgcattattttctcaccttcacatcctagtaatagacctggggctgttcatctttagatatcgtaacatgagacagaaagtggatgtgagaaagactttaaataattttaacaagtaatgtgtatgaaaagacacctttttattccctgtgccactccagatttacttttcaaagtaaaatgacttccaggacaatttggaagattatttgccaaccaacagacctttctatcaagggacatttcttcttctggcatgtagcctaaatggttctttattttaacttcttattacctgttttaatcttttttgatatctttattctacctacttatattgttcgctgtcctattatcttcatggccaatgttcaagtggtagcctagtaattttcgatcagggtgcatatgagaaatttacagattaggggctgaggtatgttatatttgaaaacaacatatagttttgtagtataaactatattaaattaaaataaacaaatggctttgctggaacaaatatacagaaggtaaacttgaatatcgatgatggttggcaagtagcaaaaggaacagataggtgttcctgggttaagggaagcatataggaatcttggggttagtgagaggaatataccatttcaatatttatcaaatagaacatgggtattaaaatgttaaaagaacattatttgagtctttttttatctagctgttttttatctaaggtttcaatactataacctaatctttaccccaaatttagtacttctagctaagttttgttttaacaaagaaaagtaacatatattatcagtgtaggttaaaatgcattaatccatacttgttggatcaataaataaggcatgaattaaagaatacattgtttgacatctgttctcccttactgtcctcaaactcgtaaggaccctttaaacagtgctatgcatcaaaccaaaggaattgaactaacattgcttgatcatcacccatgtgctgtgcttagcacttgctggtgcctgtgtcatttgaattcatctcattatctccatttgacagatgatgaaactagactcaaagtctagtttcaaaatgtatccaataccatgcagatgtcaatggcagagccagtgtgcaaacccaggttaaaacgacccagatctatgtttttccactaaaccgtatcactttattagaaatgttttgaaatattttcatgatactgatagaagtttaaatcttttccaaaaatccaatgaagcggttccttataactaaaatttgtattacttccctaccattgcattagtttttgaattcagaagagacaatgtgatataatggaaagaaaatagtaattgaagtctgagaattacttttaaatctgaattcactatttacttgcttcacgtctttaagtaagttacttcactcctctcagcctcagtttttgtttgtttgcttgttgtttgtttttcattctaatatataaaaagagaataatacaatctaccacataggaaattgtaagaaacatagattagtgtttagcatagaataagcatgcaataaatgttagttcccttaataatgcttttagtattttactaggggctttataattttttaaaatctccttcttatgtagtttaaattatttaagcaattttactattattaattaaagttagtaattttcttgttaaaattaagtcattttaaatgtcttcagtggcaatcatactgtaattaaaatgtcacttttttctcatatttatataatcaacattttccgtttttattaacagcactaaaattttatttttaatttataacttttagattctgggggttcatgtgcacatttattaaaaagttatatcatgtggtgctgaggtttggaatacaattgaacctatcacctaacaagtgagcatagtaccagataggtagttttttaacctttttccctttccttccttcttccctcttatatttcccagtatctattgtccccatctttatgttcatgtgtacccgatgtttagctcccatttataagtgagaatatgcagtgtttggttttctgtttctgcattacttagtttaatggcctccagctgcatccatattgctgcaaaggatatgattttattctttttttatggctgtgtagtattccatggtatatatgtaccacattttctttcagtccaccattgatggtcacctgggttaattccatgtctttattattgaaaagcactacaattttaatgactccaaactatccccacattcagataaatgtaccacaatattttaaccatttctccatgatatggatgtcagttttcagttgtgtttttttaacactagaaaaataatgcaacaaaccttgaacacaaatcttttcatgtttctctgattatttctttaggataaaatcctagaatcgaatgatcaggtcaaacagtattttaaagtagaaaaattctaaaaatcaaaaaaaaatcattgtcggtacaacattatatataaatgaatgtgattataatattactacttattttcctcttttttattatatataaccccattttgagagaaattttcatttgggaaataaacttttaataaaagtggggctttcccagagacattatatttatatttgtgaaatgtctttccttttggtggattctctctctgagaggagatggtgtgcagtacatgaaacaagaagtgtcatttggctagaaaatgggtttgtgctcgtggggaagagtcagcaaatatgaacaattaagagaaagaatggtccatgtcagtgacattcatctgtcatggaatcttcccaactgcaaggacacagcagcccacccagaatcctttacagggtctgcccttaccagcatggcaccttgaagtttccattgactgcatcagggatcaacactcggttaattagtcacaattttcaggatctaagagtgtcaaccaggggtctgcctgttcacatggagagattgctgctcagagaagagaggagctgagatctgtccctgcagctggcaggctctgggacaattgtcaggggattgaagtgattcagccatagagagcagcaggcagcaatttcaatgacacttttgcatctgtccctctctctgctaaatgctgctggctggtagcaaagacttaaaagggaaggctggaagagaacaataaagggaggtgaaagctctttaaatcatttccttagctgaattcagatgaatctcttgtaaagaaccatgatgactggccagacccagctggtagactagttttaattgaaacacaaaagctttcagggatgctttgggaccagaaacacagggcaagttacattctgtctctacctacctagtttccactgtaaatttcctaaatatattcattcttttcctcagagtgggtctggggacaggggaatgtatattagaaaatgccagagccacagttttctccatattgtagtcaattcaaaagaaaaacagtggttaaatgtttctaggttgttatcaaagctattatttcaaagacatattgattcacagactaagttccaagaatttgacagtgatctacttcccccactaaatgtccctaaaacatccccttttctctgttggcaagagcagacttcctatatctagccagagtcccaaaagaatcctttaaaatcatccagtttaacctttcaataaatgcctgggtccttcacgcccagtgactagccaaatacctcctgagtgaaggatcctctatcccttacagagtagtgcatctccaatctgaacagttgtgtcttattagtcagcctttagctgcaccacagtttgaatgcctgagctttctacttttttattcttgtaatgacacagagcaaaatggcttctacttccatattgtattccttaacacattgtggatttctattgtggcctttttgagtcttcctgttagggcacaaacattctcagtaggcttgtttttctgttacttcattcatcaagtatttattgtcaatactatgtgctagacaaggctccaaaaaaacaaagatgaatactacacagttcctgccttctacaagcccagtttaaaggaaagacagactcagaaacagacaactacaaaataacacaatgcataatgtaagtaagcataaaaacctgcaaaaacacagaaatgtgatctatctagagaagggttgggtgataatttagtattaatttgagcagacaccgtctgagccacatcttcaaaaatgcgaagaattgaaatagtcaagaaggcgatgtgaagtttctggtagagaaaacagcataaataaacaccaatagatgaattatagtgaggtctgtgcagtaaagagcctgcagttcacttcattgttcctggggggtaaagtgtgaagctggaaataaagttgacaaggttaagagttagatcacgaatatctttctcacaggacaaagttttgagtaccctctccaaacatgttgacagtatcaggagaaagcatttgggtatctcccaatctctgcttgcctccttccctactctcattaatcaagacattattatccctgagatgctaactacagtgagaccaatatactctagttgatgtacttagagcttgacccaaattacattgaaaatactcatcctcccattttttcttcccaaacctctggatcttagagaactgcctcattaagtcccctaaacactatctccatggctacatacttgacaatgcagttgaggttatacagtacgtgaaatatactgatcactagatgccagagtattattgcttttttttgctatgctttgaatatccatgaaggcagaaaccatctggccttaacctctgcagtcttagtttagagtcagttgcatacgaaatgctcaaccaatactaacacagtcatttggtgtcagtaagtatttaaaatccaaaatggtttctcgtacactctgctcttgtcaatttcatgattaaggtacatctatccaattcttcttgctttctttgttccaactttattgtctgttccttgggtgtggcataccctttctcacctaagggcttttacacaagttcttccctctatgtcaaaatgttcttctctatgtcaccaggtcactgtgtttggttctcctacccactcctacactctgcatttccccttcatgtgccttataaactgacatacttactcctgtagctccagggcttagtctagtgccaggtacagaggtggtgtttaataaatattaaataaattcatgattatatgagtgctaataagtaataactctgttcagtgaacactggactttttcaaagagcaaacagaattagagaaaacatcagaagtataaacacatgagattttagttgccatagctgaattattcatttcaccctttcaacatatgtaataaatatacaattgtaaaaacaaccctctggaaatcagttttataaatttagtcaataagaattgctaaacattaccttgacatttgcagtggtataggtgtcaagttatagctgatcttatcttgacattgaacctttctgactaatcaagcaccctaattactttttctgaaataactactgaattcatagtcctcatctctttttacccaagagtggaaattaatcaaatgatcataaatttagtaagctatattttttgtaagaatatgtagagaaatttaatatccagtgacaagggactggttaaataagtaatatgtgaccttgatgaaacatgactagccatttaagacgaatatttataaagactgcctagctatacagaaagggcataaaatataatgtgatttggaaaaaattacaacacaaccatgaaaacatatgtagctgtggagatgggagatggggagtaaaggagactatagaaataagaaataaacaatatggtttgtggatttggggggacttttaattatgccttacatacaaattttagaaagatatatatatcctttagagagagagatatatatatcctttatatatatatctctttagatatatatatcctttatatatatatatatcgctttagatatatatatctctttagatatatatatatctctttagatatatatatctctttagatatatatatatcgctttagatatatatatctctttagatatatatatatcgctttagatatatatatctctttagatatatatatatcgctttagatatatatatctctttagatatatatatatcgctttagatatatatatctctttagatatatatatatcgctttagatatatatatctctttagatatatatatatcgctttagatatatatatctctttagatatatatatatcgctttagatatatatatctctttagatatatatatatcgctttagatatatatatctctttagatatatatatatcgctttagatatatatatctctttagatatatatatatcgctttagatatatatatctctttagatatatatatccttatatatatatctttagaaagcgatgtatgtatatatatgtatatatgtatatatatatacacacccacaggatatcagttactataatctacaggagtaagtgtaaaggctttattagaatagaagctactcagatttccatgctgctgcactattgcatgccttttctattgctattgcaaattaaagcctgtttattgttcaaaagtatctctcatgtattatgattctagaagggggccttgtcttctgaagtggaagttttctttacttagaaacacattatttgacagataagtgatattagaacaacaataccagaaataagaaaatgaaacacccaagttcactcttctattaaatcaaattctttcatgtaacttttttcttcctctttcatataaatgtataatttttacagttgacactctaatgattctttatattttttcatattacacaatttgtaagtttttatttcctgcttcataaatgtgattttaattgctgcataaaggaagcaatttttaaaagaaaaatataatgctcttgcattcttacagtgcaggaataaacctcagtgtttttcctgaccttcctttgtctgctaactgtgcactttatgatttagcatacaagactgttgtcacctgatttccatttgagtagtaacatgataatgcagagtgcaagaggaactaggttttaggtgacagacacatcatttaatatctgctttttgtttctataggggaattctggcctgggattcagtattgctggggggacagataatccccacattggagatgaccctggcatatttattacgaagattataccaggaggtgctgcagcagaggatggcagactcaggtaaagatctgaaacattagaatgattttgaaagtaaatctgctgcatcaatgagacacatttgtacctttgaagaataataattctacaaaagttctgtacttgaaagagatttttaaggcaagcttcctgaaatgactttgcagatcttttgctactgattgaatttcagtagtgtttgatttgtgttcgttggtaggtaccacattgaacattgggccaggcactgtgaggaggggatgaagataaatcttttgtttggatgaggccttcagtctagttggaaagaacataaatatgaactaacgggcaaataatataattatcaaaaggatacactataagtagcattagcaagtaaagcaacgttgtagatattgtatgtattctcatattcggcaaccatttatagggctttctctaggcgtttagagagggaaaaagagtctaaaaaaaccattccctgggaaggtttcctctgagtccactaaccctacaaatctaagtgggaacacagagaaaagaacaagttgtccctcagaaaaaaagggaaagcagcttcatctggatgaagagcacaggatggcctggctcagtggctcacgcctataatcccagcactttgagaggccaaggcagatggatcacttgaggtcaggagtttgagaccagcctggccagcatagccaaaccccatctctattaaaaatacaaaaagtagctgggcatggtggtgggtacctgtaatcccagctactctggaggctgaggcaggagaatggcttgaacttgatcccagtgaactgagatcatgccactgcactcccgcctgggtgacagagtgagtccatgtctcaaaaagcaaaaaagaaaaaaaaaaaaaaaaaggcacatggtgagtttaggttggtggagggagtgcagccaggtacttctcagtgatagagagtagtagctgcttgagctgggctactttctttaaggaacttaattgtgggaaataagagttaccctcatggggtaaataacataaaatgctatgggatcaaaaccttagctaaaaggcactataggttggaaaaattaggagagatttttcaggaagaataacatgccctaatgtcacttttagcacccctgctaggttgtaaatcccctcaggccaagcagttacatatgtataactggctcaataaactcttgctgaagaaatgaatttttgagtaagtaaataaataaagtggagaagagggagaagtgaaaattattgtgggaggtaagataggaaggatatgtgaaatacaaaatatttatgacacttgttaatgactgtaaggaagagtttattcaagagggttcactgcaatggagattttgcagtggaggagagttattggtcttaactctgaatacagaaagcataagtgaagatgtatagccaaagagctgtggagtggggggtggcagttagtgcatggaaaattactgagagaaaacgtcaagggtaaggggaattctggctgaagggacttggcaggattcttgttgaaggcaggccaagctgataaattatcaagggtatgggataaggaatttgatcggataccaagggagagaaatttttcataaactgactcagcaggattcttggtaaaactgggctaacgaggccaaataaaaagcctaaggtcaaagcctaattgagaataggacccagagaagcctgattcaaatttaatcaaggacggagtcttattaaataaagcaagtgaagtcctgtaggtaagaatgactttagcgtgcatggagccacattgaggactgtgacttaaggagcgaaatgtaagcttcatagcacttcctcagtctgttttttcattaagcatataagctactttgctgtttttcttatgaatcaaccaaagatacttttattccttatccagtttttctgatgtagtgattacttttgacagctgcatgtttacagcttgatgaagagaatcacatttttttttttttcaggtaaatgtgcatcttttttcaacaaaaaagatactcccacatgaaataagctttttgacaacagaatttttaagctgaattaactaaattaatttctgaatgaggacatatccccactagagtgaaaggtttgaaaaagatgctgtgtaattctatgagtcatcgtggggattctgtttgctaacactggaccctaaagaagctctatttttaaagtttagaaatagatttgttagaggataatttagaaattatctctaaattatcattatggcgggccataatcataatttttcaccactctgtttagctacaagatggggagaacctccaccctttaaccaaattctggctctaagcttgaaatagattttatgttatatgtttatatatgtttgctctacaattaagaatgaaaagtgatatctctgagaatgccagcattctttgcctgcaaacatggtggcagccccatgcctacagaggtaaagcaaagttctgctgtgctagaaacttcattcattcgtagttgaaaagataatattgataatgaaagctaacatttcttgacattttatcatgtgcaggacattgtgctaagatacagagatgtcagatgtagacacacacacacacacacacaatcttctacttcagtagccatataagtaggtactattattgtggccataataataaggattcagaaaattaaggcttaatgattttaagatcacccagctagctttgaccacattaaaaatccagttctgaatgtcgcttaggtattctctaaaatctcatgtgttggtagaatccctacatcatgtggtctctgcctaaaaacccccaaaggtaaagctttcacaatgttaagaggtaattctgaacataacagagtttgctgtttttctattgagccacaatttccctttttttggcctctacccattggtctttattttggcttcctggagccagggccatggcctatgactgtgtatatgaatattgcctactaaggttgtacaataaacaacctgcaaaactttgtacagtgcttctaactagagcagcaaaattcaccttctccccaatccacattacagcctttgcctatgtgaagacagctaataattttcagtatttggcaggtggtctagtccaagacatacattttatagagtgggattctgcagctcagaggagtgacttatcctgaggcataaatcatttggggatcctatttaactaaaatccaaatgtcctgactcaaataattaagattattaggtagtgctaagagacagtaacaccatcgcctcaactaagtcagactaagtcttttctcagtgtgacaggaacactgaggttggaccaacaagccatgaggagtatgttttatctcaccattagtccttaaggacatgggagaaggacattgtaattagctctggaaagatgtgggttctaacttctgtatgtaacacagttgaccttggacacaagttaaactcacttaatagctattttctcatttgtaaagtggtgacaataatacctacttcactgagatgttctgaggtgagataaccgaactccttagctatggcaggcacataattggtgctcaataaattttaccaccgttttcccctttctccttaccttccctctctgtctctaagcagtttttcctctcctcttgcctctgttccttttcttctctatcccctttcctattataccttctacatttccttctgcagtctcctttcaccctgtgtgttcttccctaagtttcctgtccctatttttcacatacttttttttctcttggtcataacatggaattaaagaccatttttaaaaaataggtatggtgcaaaaaacggttctgtacttctattctcaagtttataatgtaagccactgaatctgctatgtttcctttgcttaaaaaaaacccctataaattaaacacagttttcttttatgtaaacaaatccttggtgtttcctttgagttagagacacttaaatttctttaaaatgtacctttacattataaattgctatggccttaatatttgtatcctcccaaaattcatctgttgaaagctaatccccaatgtaatgatatcaggaggtggggcctttgagagatgattaggttttgaaggtggagtactcctgcatgtctctgtaaaagaagccctggcttatattagtgccctcataaaagcttccttgccccttcctttatgtgaggacatatctaaaggcattatctatgaaccaggaagagggccatcactagacatcaaatctgccagtgccttggtttataggccatttagtttatgatattttattttataatagcccaacagactaagacataaattatatttttgacagttaaataacactaacatttacagagaaactaaggtccacagaaataaggtgatgggtttgctccaaggagagtagtaaatctgaactctaaattagtggttatgtaataatcagatcaataataataatcctaataataaagaccaacacagtgcttacaatgtgccaagtcattttctggcacattagctcatttaaagtgttaaatgactcaataaaattcacactattatttattatccatttttcagataagaaaattgaggaactggtaggttaagcaacttccctaagtttgtactgctagtaaatattggagccagaatttgaatgtaagcagtttgactccagtgtccatgtttttatcttctaagctataatgcagaaaaacaacaacgacgcttaaaagacccactgttaccagcatggcacatgtatacatatgtaactaacctgcacaatgtgcacatgtaccctaaaacttaaagtataataaaaataaaaaataaaaaataaaaaaaaaaagacccactgtggtaagcatcattctaaatgccactcacgaataggcgcgatggctcatgcctgtaatcccagcactttgggaggctgaggcaggtggataacttgagatcaagagttcaaaaccagcctggccaacatggtaaaaccccatctctactaaaaatacaaaaattagcggggtgttgtggtgggcgcctgtaatcccagctactcaggaggctgaggcaggagaatggcttgaaccagggaggcagaggttgcagtaagctgagatcgtaccactgcactccagcctgggcaacagagcgagaccccatctcaaaataaataaaaataaaaataaaaatgccactccccaagattctataccataatccatagaacctgtgactatgatgagatgtcactcctatgatttttatatggtataatttaccttaaaatagggagaatatacatgtgaacctggtctaattacatgagcccttaaaagtggagacttttctcaggctggtggcagaagttaaagatgtgtgatgtacttgacacgttgttgctggattgaaaatgaaggaggccatgtgagaaagaatgagaatggtctctaggagcagacagaggcccccaggctgacagccaacaatgaagcagggacctcagtcccacaaactcaaggaactgaattctgacacaaccacatgagctcggaagaagaccctgaaccttgagatgagaatgcagctcagctgacatcttgatacagccttgtgagaacttaagcagagattctggcctcgctgtgctagacttatgacatacaccaatagtgagctaataaatagaaatagtttcaagttggtaagtgtgtaagtgtgtggtaattttctttctttctttctttctttttttttttttttttgacggagactcactctgtcgcccaggctggagtgcagtggcgcaatctcggctcactgccacctccgccttctgggttcaagcgattcttctgcctcagcctcttgagtagctgggactgcaggtgcccgccaccacacccagctaatttttgtatttttagtagaatcagggtttcaccatgttggccaggcttgtctcgaactcctgaccttgtgatccgcccacctcagcctcccaaagtgctgggattacaggtgtgagccaccgtacccagccggtttgtggtaattttctaggaaacaattctaggaaccctggaatcattatgaaaaaccttcctgtgtgtgcgaaatcatagccaatataaagtgacagtgcagactaaaggcacagataaagtgagaagtgacttcctccctaagtagaccagacttcaaatcaagctccagtcttagttgttctttctcctgaaagaacaacttctcataaaagagatataggagaaagaacacaatatttggagtcaaagaccaaggtttcaggtactacttcctagctatgtgactttgggcccctttttaagctctatgttcttcagtttcctcactggtacattggagataggaacatatatctcaagaagatatagtaagattacatgaaatagtgtttgtaaaggagttatgtaaaaggcaaggcctgcaatacaactctgttatctatagagccagctatttagcagaatgctgaacctcagccacaagtctgtggcagccagggatggacagtgtggtaggcaaaattctaagatgccccctaataacctacatccctttccttcgaatgtggacaggacctgtgaatatgatcagattcaattccatgattatgctactttatatggcaaaagggacttcacagatgtaattaagtcccctaatcatttgactttgatttaatcaaaatggagattatcctgattcagactgacccatgtaatgagacttttaaaaacagagagattctcttactggcatggatgaagcaaacttccatgttgttaaagaacctatggggggctgtgtagtaaggacctgaaggcatcctttacgtactaagtaagtccccaggctacagctagcaagatagaagacatcagacatacagtcacaaggaattgatttctgcagattgctacatgagcttataagagaaccccaagttcccaaaatgaatacagtccagctgacacatcagtgcatgcagcctcgtgataccaaagtagaggactcctctgagtcacgtctagattcctgacctgctgaaattctgagataataagtatatgttgtcttaaactgattaatttgtggtaaattgtcatgtaacaacaagaaactaatatagacatataaattctggaccctaaaattcccttaaactgggctgcagagtagcttgctgttgcaggtctccggtaatactgtcacacccaaaacttcagaaacactgatcaggcctcatgattggacttgggactttctaatacctaaaggcaagaggccaaagcacaatcaatcaaaagcaagaggtggacccacgccagtaaaagggaggaatctagtccctcgggtggagggacagcagagatggagactgagacctgttttccctctactggctggagatgtgaatctgagctggagtgagggagacagccagaaactgcagggaaaatgtgagatgagggctaagtcaagaggcaaggcaagaagagcacatggcggtttagatgaatttctctgaacagtgaccattttctgatagaacttctttttaaatagaacttttcgggtatgtgtgtttatggccgtgatatttgtcctttgtgtaataaatataaaataaagaagagtagacaaagactaagcaaaacacagcactttcatttttgcactacacaaagctaatcactagtaacatttttgtacatgtctttctgatattttttgccttttaaacttagtttagatcatactctatatgatatttaatttttgtttaacttcgcttaaccttagttcagagacctttccctgtatcagtaaaaaagcctttgcaaataatttaattgctataaagtagcatatttagccattcacattgtttggaatttattttcagtttatgagcattttaaatatatggacatcttttggaaaacattattaaccttgtacctcattatttccttagtatatatttctactatagaatttctgaacctgatagaatgaacattttaaaaccttttgatgcatgttaccaaatttctttccagaaatattctaccaaattttacttttaccaacaatgttggagaggtcctactttgcaatatgttgtcagtgttgcatgtggtttcacatatgtaattttggcatacacgtatgtccaaggcaaacaatggtatatttccctgctttgctttgcatttacttgattaagagtaagatgaaacttttaaaaaatgttactcgtcatttgtgttttgtcttctagagtagtcattaaaatttgatagcattatctatcttttttttttttttttttttttgagatgaaatctcactcttgtcacccaggctggagtgcaatggtgcgatcttggctcactgcaacctccgcctcctgggttcaagcgattctcctgcctcagcctcgtgagtagctgggattacaggcgcctgctaccacgcccagctaatttttgcatttttagtagagacggggtttcaccatgttggccaggctggtcttgaactcctgacctcaggcaatctacctgcctcggcctcccaaagtgctaggattacaggcgtgagccaccgcgcctggccagcgttacctatctttaagcagtatttgaaaagaacattaggttttctttcagagcaaaatagatatacatccatgatatgaagaatgatttttatttcttcacttgtatttgaattataaaaatgccctctgtgtagtttgaagtcctagaattgccagggaccaatattgatatgtcatcatggggaagagctatcacatgacagcctccacttggcaatgcagcaatgacattttacacaagagtgcgtttattaaaggcatccacagcacaaaagcaccatgtagaaacaggcagaaaagatggctgcttgccaatttcctgacaagtgacacaatttaatctcttagccttcagcataatcatttctactcccagacaagatataaaaaaaaagaagttttcttttctttaaatccattgcttcatttattacttctgtgtctgtttacaggtaaggttgtctttgtcctcataaaaaccaagacaacatacatgtttatttcaaacaagaataatgattatactgaggtttgactgtactgacaaagttgagaggtcaaggacgaatgtttcaagaatgcagttcttgtgtataaacaacaacgttgtcctttggctgtcctttgtcaattcatttttttgctttttcattaatgtatatccactaactcagtgatgattttaaaataagaacacgatgagaaagacagaaggggaggggaggaaaaggaaacacagagaggggaggaaaagaaggaagaaaaatgattggtaatcatcacgagatgaaggcttagaaatggaaaagataaagctcagcttggtttttttgtttgttttttgttttctgtgcaaatgagaagcaccaaacagaggaaagggagtaacttccaggcatcacagtctgacacttattcccaagacccacttaccaattgtttaagaaaatgaaagatttctaggaagtggaaatagcataagagattgctaaattcttagagtacctctccatactgaactgtcatgagtttgggtgattgcaaataaaaaaaccccacaagtcacaacatccaacctgtcaatttccactgtaccccaactgattgttgcactaaatgactatgatcatggtaaatgttttattcaaaggcagagacttctagtgcttccaaatccaagtaaacatttatttcatcattgttttgggggtcaaagcaggatacaagcccagctgttgctctgaacaggaagaccttcatgagaagggagactttattacctagtataaatgataccagcgctctctttagaaagatgtatgatgcaaatctcaatggactcattcttaaggattattttttccatctctcccaacaaaagtgaaaagtattgaagggtaacaaccctctcttttgattttctctgtccataatatcagccctaattgtatttatagagtacttggacaagaagaaaatcacctagcaagtggttctgtggtgactggcaatcgacaagtccccaacaatttagtattatgttacacaagaaaatttctatacaagaagaataatttcagctgcacatctggtagaacatcaggcacccacaagtagtctttcgcagctggagttttcctatttctgtcaactgccatatattccaataaaggaaatccacctatgagttgaccgaaatattaataactttgtggcaaacatgactcgttggatttttgtttttttttttttctctagcaaattctatcaagacttctggatatatacctgcataagaatgtaattggctcccatctcacactgtagacaaatattaattaaatgggatcatagacctacatgtaagaactagaactataaaagtcttagaagaaaatgtaggagtaaatctttatgatcttggtttaggaagtggtttctttatatgacacaaaaagcatgagcaacaaagaaaaaatagataacttggagttcgtcaattaaaaactttgtgctttcaaaggacactatcaagaagttaaaagataacccacataatgagagaaaatacttgcaaataatatacctgataaacgacttgtatccggaatgtgtaataaaactcctacaactcaacaataagaagataacccaatttaaaaatgatcaatcatttcgtattattttctattgctgctgtaacacattactacaaacttagtgacttaaaataatgcgaatttattatcctatagttctggacgtcagaagtccaaaatcagactcactgagataaacttggaatgttgacaggggaaccccagagactatatgggataatttgtttcttttccttttcccaacttcaaaaggccatctgaatcacttggctcataacccttttctccatccaacctttacttccatcatcctatctcttcattgactatgactctactaactcttctttataaggactcctgtgattatattggacaccccaggataatccaagaaagtcacctcatctcaagatccttaactgaattacatctgaaaggtcttttgtgccatataaagtaacatattcacaggttccaggcattgggacataaatttcttgaggtgaggggcattattcagcctaccacaaatttgaatatatatttattcaaataagatatgcaaatggccaatgagcacataaaaagatgtccagcatcattattcattggtgaacagcaaatcaaaagtacagggagataccactttatacccacaagaatggctataataaaaaagatggacagtataagtgttggcaaggatgtagagaatcagaaccctcagcatgcctggtgggattgtaaaatggtgcagctactttagaaaacagtctggcagtccatctaacagctaaaaatagaattgccacacgaccagtcattctactcctagcatatacccaagagaactgaaaacatatgtctacacaaaaacttgtacactaaggttcatagcaccattatgcataacagccaaaaactggaaacaacccaaatgtccattgatgggtgaatggataaattgtgttatattcaaaaatgggatactattagctgaaaaaggaataaagtactgacagatggcacaacattaatgaaacttgaaaacatgctaagtgaaagaagccagacaaaaaaggccacatattatacaattttatttacacgaaatttctagaatagggaaatccatgcaaatagaaggtagattagtggttgccaggggctagtaatagatataagatttcttttgggggtgatgaaaatgttctaggctgggcaccatgacttatgtctgcagtcccagcaccttgggaggctaaggcgggcagattgcttgagcacaggagttggaggccagcctctacaacatggtgaaacctcatctctgcaaaaaatacaaaaattagccaggtgtggtggtgcatgcctgtagcctcagctacttgggaggctaaggtgggaggatcgcttgagcccaggaggttaaggctgcagtgagccatgattgcactactacactccagtcagggtggcagagcaacaccttgtctcaaaaaaaaaaaaaaaagaaagaaagaaaaagaaaaaacagaaagaaagaaaatgtttaaaattacatagggcaattggacaactctgtgactgtactaaaaaaacactgaattatgcactttaaaagggcaaattttaaagtatgtgaattatatctcaataaagatattactttaaaagtgccctgtcattctttttgggcataaatatccccatttacaaatctaagaaatttttttcctagtttcagaaagctcacaacttcttcatattgttgttcatttaaagatacaatttatttaaagtttttgaattcattcaccaagttcttgaatctgttaaagaagatctttgatttgttcttaaatctaaccaagtagagagtaccatttgtttggggctccatgtctgtatggtgtaagtaatctttaaacaagcaaatatcacaaggtgctcacattttctaaacaggtatttgaccctgtattccagctgctaaaacatcaacattgtataaaaattatctgataaatagcatttctgttttcaaaagtcaaaaccaaattattgatatgctttacaatttaggggattaattcaggttgtgttttataaggtccaattttccaaatataatcaagaaaagaaagaatgatatattgattcctcacagaggaacaacaggattgctgagacatagatgtgatgattcatatcccttaagattggctttatgggattctaaatattctgatttaagcatcgccactgctttgtgtatagggtgcaatttctggaattatttgtaggtttatatctaaacttccagcccagactaaaagttaacaagatgtactgctctagtgaaggcaggagacataggaatctctgccactaactagctatgagtcctatacaggatcttggggaattttccattttaaaatcatattctaattatctgacatttgttgacagcctgagaagttcagaatgctattatcatggccaggaaatcaatgctttgtttcagttaaactcagagctctgagaagatccactgctcattagattcatataccaaagagctgattgcagctttaagtggtgataaggcatttgtttttatttatttctaatagtctctccagacacatgttgtcattctaacattctgaaaccaaattttatattgattttagcaaatagctctttgggctctagacaaaagaaaatggtttgagggaggtagaaaaatatatttaaattatttgctgaaattgaattcaatggtaatcttaaatattttcaagaattggtttttctgagcagtttataaattgtgtcattatttagaaaggtctaataatgtggtaagctttgcacaagcatcaagccacttcaaattagcttaacaattaaatgaccaaatcataaagatgttagagctactgtcacagaaaatcaaagctgggcagtagttaaattggtagaaacagattttattcagggactgttgcagtagaggaaaagagacctcactataaaaataagctcaatttcagatacaatatgaacaaatggggatttacagccaaggagcagggtggagatcagtggacagaaaattactaggaggaaacatcaagagtaagggggcattcttgatcaattgaacttactgaaagtgggccagagtgatcagatatcaatggtgagggattctctttaaactatatcccagaaaatgtacaatcattatgtatcaatagaataaattaacaaaaaaggtaagttaacagaattcctactaaaactgagaagtacaggcctgagaaggacagacactgaaacccaaggtcaaagcccagttgagaagagagcttagaggagcctgactaaagtttggtcaaggagagaatctttgtcactacttaatattcattgagcttataaaatggtaagcaccaggcccacccagacattttcagaaactgtggcaacagtagaacaaaatcttgcatatcttctgagagcggtttctcccataccacccattctgagccaggcaacctttattcacaaaatacccttccctctcccccaccactatccctacttccattccaaaggaacacattacattttggtttctcagaggaagctaacgctggaaaaccaagttagaatataaactttttagaattctcaaatttctacaccaggaaattccagcacagcgacagcagtccccagcccccagtttatgcatttcgttttctagccccagctccttcttacctcatgagagccctgagtgcatgcctacaatactacaacttgtacacctaaactccacctactttttcttcaaatagttgccctttggtcacttttgagcctagggttattcataaagctggcactgtcaacccttagaggtatgaactgtggagaaaggttcacatatctactggagtgaactgcggccctctggtcaaggaattcctgattatgtctgttggggtgaatgagagtaaagcctctctgggatcttgtagactttccatgaagtgatcacttaaatgctaactatatttatttagttttaaggcacagtaaaaataaaataaataggtattctctttctgttactatataacagaaataaataaaataaatagatattcatttttggttactgtaacaggatactacagactgggtaatttataaagaaaagaagtttcttaggctcatggttctggaggctggcaagtccaagagcatggtaccagcatctgacaaaggccatcccttggtgaaagggcagggcagaagcaggatcaagtacacaatacagagagagatactataggccagacttgctttataaccaccttctctctaaataactaaccactgtcatgataatattaatccatttatgaggactctgcccgaatgacccaatcacctgttattaggcctgacctcccaacactgttgcattgggaattaaatttccaacacatgaacttttgggggacacattcaaacaataagactgtgactggtagagttcttggcttttagtttctcatattaggttttgtggtggtagttgtggctttcatcccagattaatagagcaatctttcctttgtcttaatgataccacatttatttacattagatgactgttattttctttcttttttattttccaagatggagtcttgctctgttgcccaggctggagtgcagtggcatgatctcagctcactggaatctccacctcctgggttcaagcgattctcctgcctcagcctcccgagtagctgggattacaggtgcctgccaccatgcccagctaatttttgtattttcaatagagatggggttttaccatgttagccaggctggtcttgaactcctgacctcaggtgatctacccgccttggcctccaaaagtgctgggattacaggtgtgagccaccatacccagcaactgacttagttattttcttgatagctaaatctgaagagaagaaacatggcaatctctaagtctccttaatataccaccattctatatgtcttctatcccatgttattcatttactattctattttctataacatctagcatgtctctcacccacagcagacacttagaactaatgatagctaccattcattaaatttttttccagaagcctatggaggtgtaaagaggttcagttatttacaggtgtctgagacaaaattcatactcagtctgtttgactccaaaatccatattcttctcactacagcacatggctgcaattgcaattatctgcagataaataactgaacatatatttaagaatctatgaacacaaagccctgccaacatctcatgtcatagtattaaaaattaaaagcacaaatacatcaaagtgacacccatattcttttagctcttcaggaaatgactgatcagtgtggattggtgttttagtcacttcacaaacccatctaaaaagatagtgaaaaagattaagtaatcttgtttttgaagataatgtatttctctgattataaagtaatggatgtacctcatagaaaatttgaaaaatacggacatttcaaagtaaattagaatcattcacaaccttatcactaaaagcctctatttattatactccttcatattcagtgcatattttcaaacagttgaacttttatcctgcctttttcatttaataccataacacaggcattgtactttaaaaatattttgtaaattttggcttgtagagtttctgccagaatttacaaagtattttaaaataaaatgactgtgttatggtattaaatgaaaaaggcaggatgaaagttcaagacatttatgcagccaacagacacatgaaaaaatgctcatcatcactggtcatcagagaaatgcaaatcaaaaccacagtgagataccatctcacaccagttagaaaggagatcattaaaaagtcaggaaacaacaggtgctggagagcatatggagaaataggaaagcttttacatacactgttggtggcagtgtaaactagttcaaccattgtggaagacaatgtggtgattcctcagggaactagaactagaaataccatttgacccagcgatcccattactgggtatatacccaaaggattataaatcatgctactataaagacacatgcacacgtatgtttattgcggcactattcacaatagcaaagacttggaagcaacccaaatgtccatcagtgatagactggattaagaaaatgtggcaaatacacaccatggaatactatgcagctacataaaaggatgagttcatgtcctttgtagggacatggatgaaaccatctttctgagcaaactatcacaaggacacaaaaccaaacaccatatgttctcactcataggagggaatttaacaatgagaacacttggacacagtgtggggatttgttgttacttacatatttctgggtttgaaattaactggctccagtattccttgttacttttttttttcttttttctttgtaaattatagacctgaagtattttttaacatttgtctgattgaattaataataatagtgtttattaattaaaaccagcttctggagaggttgtaacactcaatatcagtattattctaacattttgagctaagacaatgtataaatcatccttcgcacagtgacctagaattggcctgtgaagactcatgttacctgaatttggcccaaatcatttttgattatgcaaatgtgcctgttatttacaacacagacatcagagccacaagatataatccacaatatactgctaataattaaagtgttggtataattttctgtcttctcctatcgtttgttaactcctttaaatattatagtctgatttagttgtaaattaacagaggaatgtagaccatttgaaaaaaaagaagcaaaaatgcctttttttttttttttgagacagagttttgctcttgtcgtgcaggttggagtgcaatggtgcgatctcggctcactgcaacctctgcctcgtgggttcaagtgagtctcctgcctcagcctcctgagaagctgggattacaggtgtccgccaccacgcccagctaatttttgtgtttttagtagagatggggtttcaccttgttggccaggctggtctggaactccagacctcaggtgatccacccacctcagcttcccaaaggtctgggattttatgtgtaagccactgtgcccagcccaaagcaatgctttctttcagaaaacaatgaattgaaaaatgaattattagctgtttcccctgtttatctgcatgttgaataaaattattaaaacacaatctatttgatagtcattagtccaggtatacataataatatacatcatcataataataatgtaacatgtattttagacctttgttcaaaagcatcccataatgattgattgtgccttatgtgagagtatgctttatgtgccataaactcatcacctctgcattctcacttctctagcattcagagtgcagcatcaaacttgcaaacctgacttagaaaagaatatgagctatgtcactgttttgtatgtggggagtgagggaaggtagtttcagggttttcattgtggtgagatagatcttgagtaagctgattcactgtcattgggaaattaagtgatataataagcataagggataaaacaagtgtttattaaactgacacagaatattttattttactcccaaactgttgttatttattggccctataaatatttcttgagtattctgttgtgcttcagacatctggagctgggaatagagaagggaacaagaaaatcaggatctttgccaccatggacctctcaacccaacacggtaatcaacctaagttgagagttaaaaggagttctatgaatgtaaaggacgtagtgctgtgaaaggctgtaatggcatgacctaatctagcctaagatactcaggggaagccttgtagagagttaatatttaagctgagacataaagggtaactgttacccaagtgaatggagctggaggagtcttcaggcagagaatgcatgcccaaaggcctgaggaggaatagggaaggtgactggaggtggtgggagagtgcagactggcacaaggtgaaggtggagaggtggccatgagaaatcagggagagagagccttgggtgctatagtaagtaatttattctttatccttttgaaagaacatgagacctggaatgtttcaatgtgggaaatgacaaaactaaattgttatctataaaaatcactctgccatggaagtctggcttagctgataagagtgcctgcagttatagcagtctaagaagctgttgtagggctggacacggtggctcatgcctgtaatcccaacactttgggaggctgaggtgggtggatcacctgaggtcagaagttcaagaccagcctagccaaaatggagaaacccccatctactaaaaatacaaaaattagctgggcatggcagcaggtgcctataatcccagctacttgggaggctgaagcatgagaattgctggaacccaggaggcagaggttgcagtgagccaagattgtgccactgcactccagcctgggtgacagagcaagactccatctcaaaaagaaaaacaaaaaaaaaaacaaaccaaaaatagaagctattatagtaattcagctaatgaaagattgtaacttgaactaaggtgttggcaaaaagattgagagaaatagacatattttgaaatatactggggataaactttataaatcttaatgattaattggaatgggatgcaaagggaagtggtattccttcaaataaatcatctgtgtcctctttgtcctgggccccatatcaggtgctgagtatataatacccttgttttcaaagagttcaccatctaatagaattattaaagaatgactttgaggatgacaattggaaaggaatggtggagaggtaaagttggaaaatatgttgaatagttccattttggacaatgttaatttaagatgcctacaacaaaagcaaatggagatatcaaataggcagttgaacgtggatatggaactctgagagatctgactgggaatgtcattgggaacctttaaaaccaagtgaattaagagattgccttgaaaaagtatggaataaaaagaaaagagaagctaggacttagtcctgagatatttcagacttttaatgtaggttagagcagagctttctaaattgagtaaggtgtacctctaggagtacataggtggatttatgtcacttaatatccagatcttcaattgacctgcccaagaagaagcctgcagctttatgatggttcttctttttcacttttccatttaattggtattttcacatttaaaaaaataaagtatatgtcttaaccgtcctaaattctgctatgattcattgtcctagatataaagaaacaatctgaaatactgttgcctggcatgagaaagtcggtgactctaatgattaggtaactaatcattttgttaaatcatgtggtttccaattctttgcttttaataaaattgaaaagcaacagtcaactgatagattattaaagtaattttaattataggtcacaggattcagagcatataacttggaaggaattcagttttcttcccattcccatctacctgtttatatgaacaagatttctgatcacttacatatacagaaatgaaaaaaggaattctgaatcttgtcttactcttaactttaattcatattaatctatggaaacatggactgattttgaaaaacactactcaatctactaagaaaagaatccccaatacaatttcatctttattgttttaggtttatatgttgaatttcataatatattttagtgattttgataaattgcataacactaataatcataaaacccagtctagaaaattatttttattgtttggaatcttatggtcacagaaaatttgagggaaaaatcatcagatttatatttgtacatgtgtttttgttttatataagtatgctagggtgatcaatagaaaatgttctaacatagtgatatattgaagtaaaacttcccatggtaaaagtagaatggaaacataagttcaaggagaaagaaaagtgtgattttttaactgctcaagaagatattgtttattaatattttaaattgtgagcgtggacttcaaatcagtatgtacttatatcccatgggatacatttgaaatagtgatgtaattgtgaaaaaaataaaattttacaattcacagtaggtcagaaatgatatcctttgctactatttaaatttataacaattgtcagcctaaaacatgcaaaaatagcacatagttgtttttgttttccttgtttttgttttttaagtatgaagattaataggttgaggaagaattaaaatagagatgtacaaaaggaatggccagcatggtcagaagaaaagcaggagaggcacagaatgcagaagagtgtttcaaggaaggaatgagccactgggcttcccactgttgtgagatggaccaaaatgagaactaacgagatctcattagatttggcaaaatcaagattactggtgaatttagtaggaccatttctctttttcttggtaggggctttgtgaggaaactcagactagaatgagataaagagagtttgggaaggaagaagtagaaaatagagagagtgtgtataaacagatcttctgataagcttgactggtaaagaggaaggagataggacagtagccaaggggagatgccaggtcaagacaacattttaaaaactaagagatactagaacatgtttgaatattcagagatgacttaagtagaggctgggtttgaagatgcagaatatagagagattaaatgatctggtgagatctttaaaaagacatgaattgatggacttttggtatcagagggaacacttgctccactgtaataggaatagaaaggagacggtgggtttgcatgcagtaaagtatagaaatctggcataataatttgagagacttcacatcacatggctttgtttttctcttggaattattagcaaacatattttctggaagtgatgcaggaaaggagaacattggagtttatctttttagaaagagggacagcaagctgagcagggcgaagtgtggtgttacatttggagatcatagtgacttccatcatttgaggattttctccactaacttctggaaggggcagtgaagaaggtggagggttgggttcagtcagggttggggttttgccagacaactgcaacagaaggactagtgacaatagcatagataggagttataagtgggaagtgaacaagaccagaagccattagactaatttttgtttctgttatctgctgtgtgaatttgagtaagttgcttaacttatcaaatcctcaggtttttttcacttgaaaatgtagcaataatcgcgtggcgtaggtcttgattttaacaatgaaacagaagatattgttgaagtgttttgtaaatagtgagcgctagatagacagaagttattaccagagcctcctgcagctgttgtcacaggtgtcctaggaagatgtgtgatttcatgtttggctttctgtctgatctcctttctcttctggagaagcttctctcttctgcttccctcatgcctatggcctcctttaatatgttccttcatgtaagtgtccctcatagactcacctagtctaccatgcttcaaactgaagtcatacagtctacataaagttataaatcaaatatgaatgactgacaccagtgggtttctttgtgtttcaaaaggaaaaattgatgaattcaaatgaaaccaggtttctggaaagcaagaatatatttgtgagcaaaggggcccttcttgttgcccttaatcctttatgccaccatcctcaggctctgagttttgcctccacaaatgagaacaagtgtaatagattaagcataccatttgcaaataccagttcaaccattaagtcagggagttccggctctggttttatgaaatcataaaatgtcaccaataatctcaaaatgtgtcatgagtttttcatcacaaattaatttgaatttatttcatgaaatatgatttaccctaggaagagatgaggagtataagtactgtgaaattacataaacagtaatagctgattattgtagctcaggaaaggtcagaaaacagcatcactaatcatctaccctagaaaattagcacctccaggcaatctagcattatctgttgcatagagaattgctcacaacctttggcagtactaaataattccaataattataggtataaatttaagaagttcttcaagctagagctatcagaattcaaatttgggcagcaaaattgcatatattttattactgaccaacccaatcttaactaggaagaactattattcattcactcattccttcattgaataattcattttttattcaactctttgcttagtgcctgttaggagctcagcactgtcctaggcattaatgataaaatggtcaaccagacagacaaggctcctactctaagaaaggtgggcagaagataaacaaatatacaaatatattttctgtctgttggacagaaaataaacaactacacaaaatatcatatggtaataaatgctatgcagaaaatgaagcagagtgatatagtgatgaatgcctggtggcaactttagattaaataatcaagttaggcctttctgaggaggtgatatttaaggtaagatcttaatgacaaataggagctagccaaaaacatgagggaaaagactttcaaagctggggaaacaataagtacaagtaccctaaggcaggagtgagctaggtatgtagggcacaatggtagacgatgctaggagacagagctaggggacagtggtagaagatgagagcacaagaataaataggagctcaaactttgtaaggcaggtaagggctttgggttttaatttaaattacataggaagagctcgtaggtcttaagtaagggatgattgatattatctgatttaaatttaaaaattagaaactgtgggccgggcgcggtggctcaagcctgtaatcccaacactttgggaggccgaggtgggcagatcacgaggtcaggagatcgagaccatcctggctaacatggtgaaaccccgtctgtactaaaaatacaaaaaattagccgggcgtggtggccggcgcctatagtcccagctacttgggaggctgaggcaggagaatggcgtgaacccgggaggcggaggttgcagtgagccgagatcacgccactgcactccagcctgggcgacagagcaagactccacctcaaaaaaaaaaaaaaaaattagaaactctggtttccgtctagagaatatattaaagaaaacaggagtggaacccgtgagccaacatgtttgggtagaagtggttggtagtggcttgggcaagggtgatagtcgtagagatggagaaaagttgatggactgggatagatattgtagctagaagctactgatcttgttaatggattggatgtagagggtgaaggaaattaaaaatcttgttaatggattggatgtagagggtgaaggaaataaaagataacaaaaaaactgaatgtatgatggtgtcttttgtgaggagttgagctggccactggtgatggaaaattagaggcaagatttcttctgtcatagggcttatattctagtgcagggaaatataataaataagaaaacaaataaatttaagtaatacaagtatctcatttgttgttgaactatacaaatgctgaaaattacttccctgtaacaggtaatgagatttgatattctctataacaacatgagatttgatatttacaagaattttaaaagatgccaaatgttttctcttaaatattttatacatctcataaactgctgcaattacatacaatgaaattatatgtattttccctgcgtacgtatatgttggttggcttttaagatgctccacacttcctggaggttgggtggggggcttatgacacacctgttatagtcatggtaaatgaagaacagttcaaaataagaagcaacattacagtttgccacatggtatacttgagttcagacttacggtttaattttcctgtttctatggaaattaagctctgagaattaaaataatcatgagaataataaacaagaactttaatttaaagcctaaccgctaaagtttaaaagatgtgcttaagtagaactagctttgtatgtaagtgacataagcttctgaccctgtgatgtgaatttgtaaatccccacctcttcatcccctaggtcaagggccagtatctttctcgttggcaactgtgtcctcagtgcctatacaatacctggtactctgtggcaggtcttcaatatatgttggttgaatgtatgtatgtgcggattacatatatctctcaacttatatttgaggtcttattattggtgatcaattgtgtttgtttaggccttgccctatcactggagttctttttttttttcttaatgctaatatgcctatgaatgatagcttgtttgttagggtgattaaatttgaattcattctttttataccaggaggaaagagatgagatgagaagacagcattcttatgggacaaagtcactggaaaggatgaggaaaaggtgtggatactggcagcaaagatgtcattgactaacttccccacttataaaattcattcactctatttgccaaatatatattctgtgccaactctgttctaccctgtgaggcactaaaaatacaaaaatgaatgacaaatgattttatccctcaagtcataaaccacaaatcaaaacttatgatttataagtgaagacagacatttaaacaaaacattttcttcctttcctcactacccacatacaatccatcagcacatctattagattctaatcagccctccatgtctgtccccttctctttatcctgactgccactggcttagtgcaggctattatatcttttatcagggttatatagcagcctctaacaacaattcttgctttcttctaccttaactccacctaccaaatctaatcaagtccacatctccacattgtacctggagaattattctaaaacattattctagctataagcagtacaatggctttccagtgcctttaagttcaagtccaaattatttaacatgtcgtaccaagaccttcaagacttgatctgtgctccttacctcatcagccactaaactgtgcctgaaacacttcttcctatctttattcacttggctaacttctatttggccttcaggtctcagctgcctcagttgctccaagttttccttggcccccaaaaaccaaataaggttctcctgttatgtactcctgcattaccctgtatttctcttgccatagcacttatattgaattttaatagcatttttcctatctctcttgctaaactgtgaagctacttcaggatatgcatttgtctttaaaggtacttaacagacaacccgggtctggaggtggctaattcaggcagaggaagaggcctgaccaatgaacttgcataatgtttgaagaaactacttatatagcaagagacagggctggggaagtgaatagcaatcagattgtggaaagacttgggtgttatgtgaaggtactttggctttatccaaaaaggcaggtggattcaatttatgttccacagaaccctgtgatcagtgctaccagtagctcataagaagtttttatgtgaattagaaaactcataagaagcctttatgtgcattagacactcccttcagcagagacagctcagtgccaaggcacttggcttagagaaagggttttgcctggatttctttctgcactcactagcttctgctcagtcatatatagcaccctgactggattcctcagagccctctgaagggtcacgaatgaggcagcaggctcggctctgattctcttttcctctatgctgcagaaatcacagaaattctccctctatttgttatatataaataattataaatatccattgtgtgacttctaagtaagatttcattttaataaagggcttctttgcttggattttttaaatgtagacaatggagagcaattgaggaccattaaatatgggataaaacattcaggcttatatttcaataacaccattctggcaataagttggaagatggaatagaggggaaaaagctggaggcaagaagactagttacaacttttttccccagaatctaggtgattgacaataagggctagaattaggtagaataaatgagagtaaaagaaaaggatatactcaggaggctgaggcaggaggataattgagcccaggagttcaaggctgcgctgagctatgatcctgccactgaacttcaacctgggccacagagcaagacccccatctttaaaaataaaaaggttcaggccaggcatggtagctcgcgcctgtaatcccagcactttgggaggctgaggtgggtggatcacttgagctcaggagtttgtgaccagcctgggcaacatggcaaaaccccatctctacaagaaatacaaaaaataaaaataaaaaaaaagccagtgtgatggtgtgcactcgtagttccaaccacatgggaggctgaggtaggaggcagcttgagcctggaaggcagaggtttcagtgcgtcgtgattgtgccactgcactacagctggggcaacagaatgagacccttctcaaaaacaataaataaatacaaagtaattaattaactaaaaatgaaaaattttaaaataaaaatatgttaaaatgtgatagattggatgtgtggctaaaaaagaaggaacactcctccctttctggtgatgaaattatttgtcttgatggagaattaaaagtgaagtaaagggttgtctatggggaagagataagattaatttcagactctgctccatttgagatgtactgtcaacttccaagtaaagataggtgccaggctgggttgaccttgaatttaggtttatagaacaccagagctagaagagaattttaagatcactgtactcaaacacacagagaaaaaaaattgacttgaactggaaagtggcagaaacccaggattagaattcatatctagcttataacccagtgttcttcccaccatgccatgctccttgttgttctcaacttttcactgaaatgttcatcaatttaatgccaaattgaacttgactgagaaaatgtacaattatgaattccatatatgttgatctacatctatttctgggattggagtagatttgagtagaggaaaataggaaatcaaatccagcattgttaaatgtatttcttaatgtgtagtactcactattttaggttctatgcaggtaacaaataaatctatagcttcttgatgagaatctgccatgtatttgcaattgggacattatggacaataaagccttgagtgatttggaaacatttcatgggctatggagtgtgaacttgcctttgaatgatgctagctttggttgaacgtttgagagacagaaagcaacatgaaacaaaatatagtgtcctggctggagcaggcagtaagaggtataaaaagggggttggtttagaagtcatacaatgatgctaattttttcttatgtgacaactgtgtacctgacactggtaatacaaagattaaccacagttttaattttatatatgttacaaatctcttgaatttagaggggaaatgaaatgataaaagggttgccttaggaagttgaacctggttttgtgtgtttgaatgaaatggagaggggctaattagcctggcatcaggaaaactagctaggaagctactgtagtaatccaggtggtaggtaccagcacctcatctcttgaaagttgacaagcagtcctgtcagtggacacagtattgaactgagcgggctaagtaatctccagtcccatgaccctctcactttggaatttctattcaatgtctcttttccatgttgtacccattaagtagcctagcttgaaatttgttactggcctctgcttttccaggaaagtgccaaaagaccaatcactgatgctgaaatagcaatttctgtccccattgtggaaagctgtgatgcttcccagatgacagctgcagagagtcctgcaagcattttatagaagggaaatgaagtggcaaatagaggggaaaaacagtacattcactgtaggagatggcttctatggatcataaacccgagttactctcattcagagttagagacgagagcagaagccctattttttaaatgtggaatgaagaggctatcagttggtcttagctgaaggaagggagtcagtaaaagagtttcaggtagaaaatgagtgctggaaaatggtttgcatgtccacagccttacacattatggcagctgtggtctcctggtccaggttcccttagaggctttgttccaaataatgaaaagctgcaaatagaggggttgggtttggagtcagagctcaggacttttatcacatactcagttgggtctacataagattgagtatttctgtttattttggaatgaatcatacatgagccaagtagaatgacccttcaaaacctagagcagtggtttttggagtatggtctcagtccagcattaccaggatcacctaggaacgtgttagaaatgtgactcttctctcctgctctagacctactgaatcagcacctctggagggggaagctcagtggtaatgtatagtttaacaagccctccccaaagtgtgagaaagattgatctagattttgttacttggcttggctctactggtttacagtatggtcctggacccgactgacagtgggtccttaagtaagtcgcaaaatcatttttaacaaaccagagaagtgtagatggtatagggcatgaactttgagatttcctagacatcatttacctgtcattacaaacctatttcaactttagtttctactgtggaatgaaggcgacaatatctacttttcagtgtttctatttacattaaagactatataacatagtatataatacaaacttttcccactaggtgccaggcattaatgctattcgaataaaacaaataaactcagtataatgagtgcttttataaatactgtatttttataaatttgaattcctagttaaattttaatttcaatggaacatacttatactaaaatgtatgtgtttatctaaataataattactaatgtttatctgaaattgaaattcaactgattgtcctgtatttttatttgctaagtctgggaactccattaatatttttcactaagtacctaatggaggaacactggagcaaataactgggccaaagatggcatcctagaagatgagataagcttgaattaagttttaaaagggaaaaaggaatgagctaagggagataacacatgtaaagtattggtcacaaagtctgcctgtattaatcagaaatatttgttggcaagtaaaagacccaccagcttacttactcaaaagggagaattaattagaaggacatttgaagtatcttctcaaactggacaattaagcgctgggaagaatagccatggactgagacactgtcaggtgttagaggaattcctccttctgtccgaagcccatacttcttcctatagatctactttattccccatctttttggagatagtcttttgaaattttatagtcaacatggaagaaaatggcctctaatattaagctctcaagtttctatttcttctggtcacatagaacctctgagtctcatggtttcaattccacattcccaaaagcaggactggccagacttgacaagtgaaccaggttaagccatataagcttgtcactcctcctacaaccatgtggatgtttgctggaaaaaaaagcctcatagatattactacattggcccatatcagatgcctctaaaacattcctcttcctttcttggaaaaatgctaaattatgctgatttttattcttttattttttatttttaataaactaataatgcctaatgaggtcagtgaaatatacagatcattagggtgagaagtttcaacaagggagaaccttaactggtgatggactttaaagatccccagtaacacttccatgtacttcataaaaggaagagtgagataacaggcagacataattaagtatatgtattatggcaggccattatgatttgaagtcatttgagtcagcctgtgtttgtgtgtgtgtgtgtgtgtgtgtgtgtggtggggggtgtattattttctcctctctgtgagcataaactacttgtcttaataaggttttggcttctattatttgttcataacctacctttaatgacttcaggaatagaagaaaaacaagacccttttcataacttctgttttcattataattgacataaaatgtgtggaattattccttttgaacagattctgagatttttgttttgttttgttttgtttggagatggtgtctcgctctgttacccaggatggagtgcagtggcgcggtcttggctcacagcaacccccgcctccagtgttcaagcgattctcctgcctcagcctcccaagtagctgggattacagaggcccgccaccatgcctggctaattttttgtatttttggtagagatggggtttcaccatgttggtctggctggtctcgaactcctgacctcatgatactcccacctcggcctcccaaagcaccgggattacagggactgaaagttttttaagtgattgattgttatctttaagtgcatgcagtctaattccttagctagtggttttttaaaatttcatcatgcatttttacacttcatacagcacattaaacattgatcagctttcttcatgatgtggccctttggtctgtaattaattcatttatttgaagaaagagaatactactgatagaaacagtaaagcgcaaggtaattaggggacattcttcaataaccaacagctgctgcaaagttgtttcagaccctgtgacctaacatctacctttttttactttttttctttttttagatggagttttgcccttgttgcccaggctggagtgcagtggcacgatctcggctcactgcaacctctgcctcccaggttcaagcgattctcctgcctcagcctccttagtagctgggattacaggcgcctgccaccatgcgtggctaattttttgtatttttagcacagacaggatttcatcatgttggccaggctggtctcgaactcctgacctcaggtgatccacccgtctcagcctcccgaagtgctgggattataggcataagccatcgctcccggccccaaacacctacttttgaataaaaacttgaggaggtctgagtgcagttaggtgtggttgagttaagtgtgctggtcagaatctttaaccaaggcttccataaaaggtaaagtttgtatatcaaaacaactataagttttactgtgggcaagggaagggaaatatgaaaaggaaattacattgtacttcatcaaacaagacttatttaagctctaatatttaggtgaatatgcatttattatttttttctttttttaaacctttagtttcgggggtacatgtgcatgtttgttatataggtgaattgcatgtcgtaggggtttggtgtatagcttattctgaaacctggtaataagcataatacctgatagctagtttttcagtgctcaccctcatcccaacttccactctcaagtaggacccagtaaatgttgttcccctctttgtgtccatacgtactccaagtttagctcccacttacataaatgagatcatggagtatttggttttctgttcctgtgttagattgcttaggataatggcctgcagctccatctgtgttgctgtaaaggacatgatctcattacttttatggctgcatagtattccattgtatatatgtaccacatttttaaaaatccagtctgctgttgatgggcatttagattgagtctatatctttgctattgtgaatggtgctgtgttgaacatatgtgtgcatatatcttaatggtagaataatttatattgctttggatataatacccaataaggggatttctaggttgaatggtaattttgttttaagttcttgagaaatccccaaactccttcccacaatggctgaactaatttacactcccaccaacaattataagcattcccttttcttcacaaccttgccagcatctgttattttttgcctttttaataatagtcattcagattggtgtgagatgttaccccattgtggttttgatttgcatttctctaatgattagtaatgttgagcattttttcatatgcttgctggccatgtctatgtcttcttttgaaaagtgtctgttcatgtcctttatgcactttttaatggtgttatttggtttttccttgtaaatttaagttccttatagattctagatattagacctttgttgaatgagtagcttgcaaatattttcttccattctgtaggttgtctgtttactctgttggtagtttcttttgctgtgcagaagctctttagtttgattaggtcccatttgtcaatttttggttttgttgtaattgcttttggcatctttatcatgaaatctttgccaggtcctatgtccaaaataatatttcctaggttatcttccagggtttttatatgtttaggttttatatttaagtctttaattcatctcgagattatttttacagattgtttaaggaaggggtcgaattgcaatcttctgcatatgactgtccagttatctcagcaccatttattgaatagggagtcctttccccattgcttgtttttgtcaatgttgttgaaaatcagatggctgtaggtgtgcagcattatttctagattccctattctgttccagtggtctgtgtgtctgtttttgtaccagtaccttgctgtaaaagctctatttttatatttttcttcctgaaaatcccattcttttcttctcttcctccctttcttatacaaaattttaaaaacactttcagcatcttgactgtagctctttctttttctccctttagtatttttccctcactatagtctctttatatattctcttatgcaaatgcttcttgtctctttttcgtaatgatagctaacatttttgatgcttactgtttttcagggactacgctatgtatttcacatgcattctctcaataacagtaacaatcagtcaataacaatctcattatccctattttcagatgaagaaactgaggctttgagatgtcaagtgacttgtctgtagtcacagagctcccaagttttagagctgtggtgagatcccagatctatctggctgtgaccaagcctcccaagccatgttcttaggttctgtgctgtgatatatgtccagtataaaacatttgaaagaaacataaaagtagaaatgtgctttttaaagcgctcataatctccatacccacaaaggacccaaattaaaacttcgctatctttctcttcagtgtgttttatgcataatgcatgggaatttttaaatttttaacacttactatgacttgatgatcattttaaatgagttaacatacttaaaaatgcgtaaaatcacaaatcttacttcaatggcggaaaaatttttttgttatatatatatattcttattatactttaagttctagggtacatgtgcacaacatgcaggtttgttacacatgtattcatgtgctatgttggtgtgctgtatgcattaactcatcatttacattaggtatatctcctaatgctatccctcccccagccccccaccccacaacaggccccggtgtatgatgttccccttcctgtgtccatgtgttctcattgttcaattcccacctatgagtgagatcatgcagtgtttggtttttggtccttgtgatagtttgctgagattgatggtttccagcttcatccatgtccctacaaaggacatgagctcatcattttttatggctgcacagtattccatggtgtatatgtgccatattttcttaatccagtctatcattgatggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatagccacactgcagaaaatatttagtaccttgagagagtagatattacctgttactttaaattatattgtcaaagtagaacaaataactcactaaatattgttttacttttcagtgatgctataccattttagaaaatacttgatttagtgcaaaatttagatgtgactctttgaatacgggctaccgatagactatcctttttgtttctaaaatatttttggcaaggaatgcaccaaaatttctaaaggaaattctagaaagaatattaaaattaatctgcggatattacagacaattctggtttacaaggtgaaattgctgcagatgaatactgtagacttacgtgtataacatcaagtactaagagtgaaactgtcaacttaattagattggtagagtgagattggagagtaagtctgtatatgtaaacaacattttgttttttagagatggagtatcgcttttgatgcccaggctggtcttgaactcacggcttcataaaacaatgtccctcagaaatatgataaagcctgcatttgttactgtgacaaagtattccttgactttgaagctaattatatacttacatgcttcaaaatgaatacagttggtggctttactcacaaagtttatctactggtaaagagagcaaattaattttaaatagctatgaccctctagccaaaatctatttcaagtttctgggaggaagggaagttgactgccctagtttggcctgacatactttcctctctattttgagaatttgaatgtaaactaccccacctcccctacaaacaccaccattaaaaaaaaaaattaaaacaatcaactctgagtgtctgagtatctttgtatcagtagaagctctagaaaaagtaaaaacaggttgaaattatgtccctgttttcaccaacactttgaccttgtcagtaaaattccactgtctttaaaatgggatccatactttataaattgtttaagtaagaacaaataagtgaaatgactggctgatattgcacatagtatgtcctttaaaagtttaaatttccattctgttcacatttgaacaaatacttgagcacatctttgatccactcaatagcaagaactttcagatctatggtaggttacaatgtacacatctccacacatcagctatgggtactctcctgcacagtactatacagtacagttactgctctcactgactctggacatagtctctctccttttatgggatactgaagttcaaaaagataaagtggcctcaccgtggtcccacagatgatgaagaactgagactcaaatccaggcctcctgactgctagtcctaaagctgcctacttgatccacatattcaggaatgaacatctgatttaggctatgattttctcacaccagcaattgacaattaaggatcccactgtatacaaaaggaaaaaaatagagtttgaatagatatatatagcctccagaattttttttaaatgtcagccactcccttctatgaaaagcagtgttttaagatataattagtattctgagcatagagtgatggtaaacattatgttttgtattatcatgagatggcaaaattacccactctcaaaggaccagctgctgcagggcagctggcacccatgatgcctacattctcaaaactattttaattggtagtttcccttttttttttttttttttgtcaatcagagaggaaatgtatgtgtaagtctattaaagccatagcatctgttatgatgaaatgacattgccgaatcttaggaagtgaaatattccatctcaagattttgagactgctctgtgttcttactgaggcaagagttcctataactaaacaggtatagaaaagttatgcacaaaaacagatacaaaattcttcccatacttttcatataatattatcattgtagtcatcattttgaattgatatacacaacatacatgaaactattcatcacattagatgtatgtggtcctaagagagaaaagctcaaattttgaaataggaagacctgaaatcaaatccaatctctgctcaaattgctgacagctttaagcagaggacttaatcacttggaagtcttctcatttctataatgtagataataagttttattccacaaagttatagggagtatccaatagttgagaatattataaatcaacaaatattgcactgttatcaataacaaacatttattaggtgttcattacataagagagtatgtactaagtgcttatatgtgctttatctcatttaatcttccccaaaaggcttcctgatagatattactattatatccaatttacagatgagaatataataaggcttagagaggctaaggaaattaactatggttacaaacttaggaaatggagggcccaatcattgaacttagtcttattctttcacacattcaacaaatatttgctaaggaaagatcccctgaacaaaacgggacactgtttggaaggaggaagtggggaatgcaagttgagtaagcaaaccaaccatgttcactgtacgctggccactgtgtagtgaatggattgaaaggtaacaagagagaatccaagaaggctaggtcggcgtttgtggaggtggttcacctgagagatgatgttgatttcaaccagggtggtagcaatgaagatgaagaaacctagatggactgaggctatacttgcaggtagaactgactgcgtggtggtgggggaaaagaagcatcaagcaaaggaggcccctcatttttgactctgagcaacatggtgatctgagattggggacactagaatggatatacagagtgagggaaagaaatttttgtaatctcaagccccgtgctcttaaccattattaatgttatcactaattattatcatgaaaataaaatatatttggagtcgatggccacataactttaaactacctggaaaggtttatggaaatgtcaaattattcctttccatgtgaaaatgaaaaaaaaaaaaaaagaggaaagtttgatgtagaatttgttgtggttcttagttttcaaagtaagcacctaggaacaggattatctgaggttctccttgaactttgtaaatctgaacttcagtatttataatattgtaagatgaatcgaggtggagaggagggtggggaaacactggaagataatttgccagaaagctgacagacttatttaatttattattattattattttctttttttgagatggagtctcgctctgtctcccaggctggagtatagtggcgtgatctcggctcactgcaacctccaccctcgggattcaagcaattctcttttctcagcctcccaagtagctgaactacaggcacacaccaccatgcccagctaatttttgtatttttggtagagacggggtttcaccatattggtcaggctggtctcgaacccctgacctcaggtgatcctgccaccttggcctcccaaagtgctgggattacaggcatgagccactgcgcccaacctaataggtttattttagatgattgagtcaagtatattttttcttctacctttttatatttttcagatatttgaaaatgattacttattacttttataactagtaaattaaaaatttgagaaaattagtctgtaaataattgtatttgttatgtctatatagttcatggtagtaagttctgagaaccactcaaattgtaactttcagtcaaaccaattaaaataatgatgtaacttacagaggccttaaaatacatgcccttctaactatgccgtatgtgtaagcagtcccagtcaaagtggactggagtttaggatgggaactgaccagtagtatggtcaaaagtggttaggaagaaggctaagaggcttgagtagtttgacattttttagatttccttcatttgaagcatccttccaaatttaaatattttaaaattttttagattctttactttcccacttcttaaggtcagataaacataataatattctttaagaaatcctgctagccacttctgaatcttgactcttttccttccttgcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtaatcaaaatataaatgactcacagacactagtgacaaaccatctgactgaagtttatgccacgatagtcgtatgatgaactctttaacctctgacattcagtgcttaccaagagatttaaaatcctacagtagtggttacaaagggtaaaggaaaccagtactctaaatatgaactcagataagaaggaaagagtagatttatgtagaaacatccttaaaaacaaaaatattaacagtcatctatgtttttctataaatttttaatcttactgggtcatgataacttagctagcatattaatactaatttttcagatacaaatggtaaatcctctcatttggcaaaatagtaatataaataataattaaaataatctgtactaatataacaattatatttttataatgttgtgatatgtttaaagtttggttatattcttatgtgttgtacccaatattacatgacattttatgcttgcagtagccaaaataagttaaaatttatgttcttgaaatgttctcgtatctcttgagattattatagttactctgaggagttgcagaaacagatgaattaccaccctaatttttgtttgtttgttttttgttttgttttgttttgttttaaggcagggtctcactctgttgcccaggctagagtgcagtggcaggatcatgactcattgaagcctcaagctcctgggctcaagtgatcctcccatctcagcctctcaaatagctgggactacaggcatgcactagtgcatgtggttattattattattattattattattattattattgtatttgttttttggtagagacagacccttgctttgttgcccaggctggtcttgaactcctggtcataagtaatcctcctgctttggcctcccaaagtgttgggattacaggtgagagccactgtacctggcccatactaatttttaagaataatgctttgaactctgttcttcagaatgatgacattaagtagtaacttaatagtatttaatgttttggaaaaaatctaataattagcttaacattatttaaatattttagatgattttgaccaaataatcactgtactctttgagtaaatcatttctcatttctttaaaatctatttaatctctaatgctatatgagattgaaaaaataagcctaccatctcttctaggaggcagtagtgggtggtatttaagatctcaggactgagtttaaaagcctggttcaaccacttgctagcagagtcatcttagttgggcctgctccctcattattaaatggggatcataatggtagcatcaatccatagggtttatgaggattaagcatttagccaatagctggcacatggtaagcaatagagcctggtggttaagatgcagactctacagcccagagtttctagattagtaccttggctctgcagctcactagctgtttggccttgagcaaattgcttaacctctctgggccatattttctcatctacaaagtgcaaataagaatagtacttgctcctagagatgttgtgaggattagatgagttgattcacaaaaagtatttagaataaggcctggcacaaactgaccgaccaacaaaattagctacatatgcatgttatctgtactattatttactacatatggttttaaactttgtaacaattgtttggtaatgtaatgaaaatattcagagattcctcatgggtcaaattcaaatgtgttaaaatcatagaactaaatctgggtaaaaagaaaaaaaagtgaagcattttcatgccacagtctctagtggtatgaaagactttcaaccctcacatttactaaaatcatattgcaaggagctttaaagccaaacaaaatggccatacccattatttctattaaaaatatatattatatgtagctatttctgtaattcaattaactgtaattattcagcatagccctaagacaaatactaattttaaccactcagtaaagaaagtaacatcatgcatttatagaccttcttctagctgagcagctggaggtcatccagagcacttaaaggctatagatgactaaaacttaattttaccaagaacacatattttagatctttatttttgacactggggctccagctggtttacttcatgctgaactgctttcttccttgagcccggagtggggcagtaattgctgtgggacctggaatggggaaatggggagaagtgagtattaatcaacttggtatacctaggcaataacccagttaaagtatacagtgtatgggagatggggttacaagtgagcttggtctactgagatgaggagaaccagataactgttggaaataacttcgcatccctaaaaagcaggctcttgcgaaattcctgtagagagaggtgagactattgggcctgttgcggttatgctgagtcagtcatacttctttctactgtcgctgtccagaggtcactgatggagatttgtttctctatataaagcttactgatttacagaaaaactattttagtcattgtttaaattcctcatccctctcctagtaccataaacacagctagtgctgaatcagagtaagttgaatacttaaactggattttacactaactctgatgatacctcgtggtcttaacttcacttggcaccttataattcttcatttttgaattacaatatgtgtaaagggaattcctaccaatgtttaactcatacagtggaaactcttatgcaccctggagtgaagataaatgagatgtcgtctctgtcctcagaaagtttaaatgggagagatgcacttgaagtcaactacctttaatgcaacagaaaatgaactcagctctataatggagcctgagccatgatttcactggaacaaagtggaagatgtgattcgtcataactaggagagacaaaatggtccagaggatttaaaattttcagcaaactaatgcagtaacagaaaaccaaacaccacatggtctcagtcgtgggagttgaacaatgagaacacatggacacagggaggggaactttacacaccagggcctgttccggggttgtggggaaggggagggatagcattaggacaaataactaatgcacacggggcttaaaacctagatgatgggttgataggtgcagcaaaccaccatggtacatgtatatctatgtaacaaacctgcacattctgtacatgtattccagaactttaaaagaaaaaaaaaacttaacatgtgcatagtttatctgaccttccttgagcacatgggtacaatatagtaagcatcaaaaatgtagccaactgagctaactggattgaattatgtatatataatacagagttatctagatatacattaatgtagtccttcaatgattcaacaaatacgtattgtttagtatgtacctggcacagatccagacaatagagattcacaaagaaaattcagatagttcttgctctcaaggagatgatagcctggtggggaaaacacctataatataaattgggaaaagtactaggaataaatgtaacagattgttaagggggtgccaattaaatagtgggtcaaaggagacttctgtaagcaagtgtcacttaagctaagctttgaaatataaattaaaacagacatttagccaggtaaagaatggggtctcgagagcatcccagatagaagtagaggcatgtgagtgtgatggctatagtgtaggaaaagatcttgataacttctaggagtctaataatatgaaaattaattacatgaaatgatatggctgagatgagcaagggccagatcatgcttagctttgttcaccatatttgaagatttgtgtttatattgaaatgcaatgggaaattattgtgatattttaagcatgagtgacacatgataaaatatgtaatttttagaaggtcattctggctgctatgaagcgaatgaattgaagagggcagaagtgagagcagagatcagttaggggttacttggaggaaggagaaaaaagtaaatggatttgagctatcttgatgccatttattggtaaaatatatggtggtgtttcaaggatgaggttcagttttttagttggggtgccatttgtgaggtagggaagattatgaaggaatctctgaggacagagggaacctctgatgtgtctgaaaaggaaatctcaaggaagcagaactggagaaggtctgtctaaaaaccctgccaaattaacatattgatttttcactatattttgtgaaatatctgggtttgggaaaatatttttaaattgacttttttcctttttattaatcttaatataaaaaatatgaatatggctacttcagctattttaaagagttaatgcatttaataaatctattttatagattttatagattattaatgccaagaatgttttcagtttggggattgtgtttgtttttgcacagaatagaggataaacagatttatccctttgtatgctgtaggtaaaacattaagagattctgtgaaacagtgatttgtggcaaattaaatttacagtttttcaatttcgtactctgtattgatttggtctattgcaaaaattactaatttgagataacctttgatgtatgtgattttgtctttatagcagagctaatcttcccaacactcagatagaatcaatcatctcattggtgatttatagccatatatttcagtaatggatatttgggtaatactcattctgacttagaatgtcttttctcaaaataggtagaaaccttgctaacatcacagttatagatttggtcattgtaagcacctggggtgtctgcatgtgggcaatcaattgagaagaaaataggtaattatatgtaggaagaaagtattaggcaaatccatttaggcttgccaagcaaccaaaaatcaagcaaaggaaggaaatctgaagtgtgtatgtgggtttccaggaaatagatttactgtaaaaggcttcctagtgactttcgcaagaacacattaaatcataacttccaaggagctattaatatataattaaacaagtacagaactgtttgtttctatggcctgggccaaagaagcctaaagctacaggagaaattagatgacttcttttaagatgctgttgttgcttaggaatcatataagtggtttaaggctaagttctaaaaccaaaaatgtgaaagctacagttttattaattgatatccaaaggtggtcttgcttgtagctttattttagccaccttactcattaataaaaactgaaagagtgattaaatctaggtagtgacaatttttagcaattctcctccattattttttaaaatgtttttaaattctcatatctctatagatacatactttttgccattacagagctctgtatcagtgtaaactgagaatgtagtaaagattgtgagtttatgttttgtacaggaaaaatggtaactatgaaatgcacaaactgtagaagttactataccaatgaacacttataatgttcataattcagccattaaagaagacacatatgtaatgaagaagttcctggatatcttcaagcagccatgagcctagaacaaagatatgaaccactttatgactcactttccgcatctgcaaaatggctatatctaaatatgtaattcatagagttattttcaggataagaattgtaaattcttaataaattcttataatctttttactcttattaccatatttggcagaaggggaaataaagaaaagtagcaaagaactcattaatactaagggactaaaggattagattgtatttaatataatatttaatataaaatactatgagaggttcttttttttccttcaacttttaatttaagttcagaggtatatgtgcaggatgtgcaggtttgttacataggtaaacgtgtgccatggtggttggctacacagatcatcccatcacctaggtattaagcccagcatccaacagctattcttcctagtacctgatgctctcccttcctcctgcttcccctccaacaggccccagtgtgtgttgtttccttccatgtgtccgtgtattctcattgctcagctgccacttgtaagtgagaacatgctgtatctggctttctgttcctgcattagtttgctgatgataatggcttccaattccatctatgtctctgcaaaggacatgatctccttccttttttatggctgcatagtattccatggtgtatatataccacatttatttatccagtctgtcattgatgggcatttaggttcattccatgtctttgctattgtgaatagtgctgcaatgaacagacacctgcatgtatctttataatagaatgatttatatttctttgggtatataccctgtggtgggattgctgagtcaaatggtacatctgcctttaggtctttgaggactatcttccacagtggctaaactaatttatgttcctaccaacaatgtaaaagcattccatttccacactgtcttccacaatggttaaactcatttacactcccaccaacagtgtaaaagcattccattttctccacaaccttgcctgcatctgtttttttttttttttttttgactttttaataatagccattctagctggtgtgagatggtatctcattgtggttttaatttgcatttctctgatgatcagtgacgttgagctttttttcatatgtttgttggctgcatgtctgtcttcttttgagaaggttctgttcatgtcctttgcccactttttaatggggttgttttttttcttgtaaatttgtttaagttctttgtagattctggatgttagacctttgtcagatggacagattaaaaaaatttgggggaggtcctttaaaagcactagaatatttgttgaattaatgaattgactatttattaaaagcttttaatatttagcgattccagatagaaccaatatatatttggcttatgcatgcatgtatgcatatatataatatgtaaatatatttatgttatgtgtatatgcacatatatgttatgtacagctgtattttttctttagctctatataaatttgtttctaacaggtttgagttatgatgtgtcatataactctatgctttatgaaaatgcacatatatgtttgggatttttctttggttttcccagtttgggcatctgtgtcagggtatgccatgtgcagaaatagctccaagtatattaaaacttagccttatgatatctccttagcaccaggttccatcactcgcccctcacccatatgacctactcctgcttttgacctctccatttattcaaacgattgtcttagtcacccacagtaaaaggccttggacgtcctttttttccttttggttctctcttctttgctgctttaataaatcaggcatataccttttggaagccacttacaaaatattaatcctctctttaaaatctctactgccattattatggtgttcctgtcttctttttttttctttttttttatattatactttaagttttagggtacatgtgcacaacgtgcaggttagttacatatgtatacatgtgccatgttggtgtgctgcacccagtaactcgtcatttaacattaggtatatctcctaatgctatccctcccccctcccccaccccacaacaggccccggtgtatgatgttccccttcctgtatccatgtgttctcattgttcagttcccacctatgagtgagaacatgcagtgtttggtattttgtccttgcgatagtttgctgagaatgatggtttccagcttcatccatgtccctacaaaggacatgaactcatcatttttgatggctgcatagtattccatggtgtatgtgtgccatattttcttaatccagtctatcattgttggacatttgggttggttccaagtctttgctattgtgaatagtgccacaataaacatacgtgtgcatgtgtctttctagcaacacgatttataatcctttgggtatatacccagtaatgggatttctgggtcaaatggtatttctagttctagatccctgaggaatcaccacactgacttccacaatggttgaactagtttacactcccaccaacagtgtaaaagtgttcctatttctccacatcctctccagcacccgttatttcctgtctttttaatgatcgccattctaagtggtgtgagatggtatctcactgtgattttgatttgcatttctctgatggccagcgatgatgagcattttttcatgtgtcttttggctgcataaatgtcttctcaatcctaagccaaaagaacaaagctggaggcatcttgctacctggcttcaaactatattacaaggctacagtaaccaaaacagcatggtactggtaccaaaacagagatgtagaccaatgcaacagaacagagccctcagaaataatgccacatatctacaaccatctgatctttgacaaacctgacaaaaacaagaaatggggaaactattccctatttaataaatggtgctgggaaaactggctagccatatgtagaaagctgaaactggatcccttccttacaccttacacaaaaattaattcaagatggattaaagacttaaatgttagacctaaaaccatacaaacctagaagaaaacctaggcaataccattcaggacataggcatgggcaaggacttcatgtctaaaccaccaaaagcaatggcaacaaaagtcaaaattgacaaatgggatctcattaaactaaagagcttctgcacagcgaaagaaactaccatcagagtgaacaggcaacctacagaatgggagaaaaattttgcaatctactcatctgacaaaaggctaatatccagaatctacaatgaactccaacaaatttacaagaaaaaaacaaccccatcaacaagtgggcgatggatatgaacagacacttctcaaaagaagacatttatgcagcctgtcgacattcttgatatcttatctggcgtactataataggcttcattgctggtccctcccttccataccaacacatatcttctataccaatcttccaaaaattcaaaactgttcatgattctcccctggtaaaaaaaaaaaaaaaaaagtctccagtagtttttcattgccagtaagtagcattttaggcactctgtgatctctttctcctccagccacaaaacttggtttcagtcttctcttcttcattgtcccattcacatctctcctgatgcaggtgagctgccctgtgtaccatttcttaaacatatgccatattttccttcctctaagcctttgttcatttcattcccaactttgaatgtcttctcttactattgtgaccactatctgctgacatcatatccatcccccaagagccagttcagtgttaacttctccataaagctatcactaattgacgcaatcagaagcaatctttcatttctaacaacttctgatgtgctttatttcttccttttctgttcattcttttattatcaggccaagtaacccatagggcatgaaaaggatgaatatcaacaacccagattaaggagataaagaaaccgctaattctaaccctaagtcattaatgtaatgatgtctatcctggccaatgctaaatttgaagcattaagtgatacttaaaaggaaagtacaagctccagtctgtgacccagttctgggtagtaaatgggaagaattggggcagagatgagtggggagtgcaaggtagatcataaccatcaaagcaatgtggcaaggggaaaaggaatggctcagatggaagctgacagtttttcaactgcgaagagtccgtatgagtgaagcccatgttttggcaccttaccttttttcactccttacagaaattgtatgtacaagaaattggaggcatctggcacattgcttaccagtccacttaatcaaaaaacaatttctagatatttgatttttactttattgtataactgatgtgacaaatttcatgtccagcttatctaaatatcaacttgacttgcatctgatattatagatgagaatttattaaatatctaacttaaataaattttaccagcttttctatttatcatactcatttcctttatcagatctgttcttactcctccatctgctcctggtttttgtttttttttctgatgcccatatggccaaagtgaactatccagtcttgatgtgaggaagtcatctgaaaatttcctgacattagtcatttggctaattgataggcctagagctgtcttattgagaatgaacactgaatgaattaaaattttaattgaaaattaaatgcactgttcttaacacttagtaccgagactgtctgcaccaaaattcttcttttttccctgatctgtccatggatagctttgtcaatagtgtgtgtgtgtgtttttttttctttaacaagttggattttctatcttgtaaccataataacttggagatgtttaggttagcaaaggtattagttatctgaaattcagcagttcatgaccaagcattttaccagaccactggtagaaactaaaaacaaagtttgtacaactggtttgattactggcacccaaccgtttactgtatcaggggacctcatgcattttcttatttcttgccatggagtaaattactatgtttattcattttctaatgcatgtgcaaaaatgtctctgaatacaggaaacagtttactttttattcaggctcatgtcctgggatcaagttcctagtggtaggtggacctgttttaggtgaaaggccatgctggaacaatgatttgttcaataagcacgaatagcaaatttaactatttggcatgagttctcaaaacactacattttccttttagtgctaattttttaaatccttttgaattaccacaatggttccctggggtacacaaggaaatttacttgagtatatatatagtgcaaccttctattggaataaaatatatggaataagaaagaaagtggtgaactatttgtcttaaaccagggaaacagtcttcttagaaataaattgtagctaaattaccgctctcctgtctaccagagagcaaatcttttattattattattattattattaaatgaaggacaccatatttgataaattcaccttgttcccaggtacttttcctgtagaatttcttgtgcatgcacgttgttaatttctgattatttctggatataagacatatgcttgtgaattgggaggctctttctctaagctaatatttggtcaatattcataatgatgtctgtaaacaagctctctcctaagattgtgtagcaaatcatttatcatgaaagaacaaactacaaatattgccactgtaattcccactgttctgtataatacaacattatgagagaattaatcacatgattatgtttgctaaatctttttggaaattaatgaatgatgccactcctgtcatgtgccctttggggataacatgaccactgtttcttttcacagttttcttatttgctgtttaaagctgatctataattttttaacagaatatatgatcaatggctccttgaacaaatttttgaagtcaaaattatttttacaatgaaaatttcagatttaaataattgcactgtactaaatgtacttttggtttttcaacatttaaagttttatcattcacacaacaagccctgtgaaaagctgtgaatagttactcaaggtaaatatttacctacatggaattgtttgtaagctttaaaaaaaatgctgctgtggtaaatacaactataaattttttaaatttatggccagcagcaaagcaatttgatgaaaagactgggatttggagctaggacctaagttgaaatccttgcttaacttaaataagcattagagatattgggtatgtatcggcatctaattaaattttaagtgttcttctttttgtttacttttttaaaaggaaatatgcacagaaaacaatcatctattcactcaataaatattttatttcaaaaacatattaggtctggaagttgtaatgctaaattaaaggaatgagaataaataaagtagttttggcttttttcccaagtatcttcttagaagactggcatttacctaaactgaaataatgcagtcctcctctgctgactgatactgacttcatgctaaattcttcatgatccctgactaaatccattttggttcctcaactcatggaccaatgtccgttaaatttttcgccttctatggaacactgagatccaatacattaaaacttgcagtactttctattcatggaccatgactcctaatgccactaagctgtcagtcaaaagcctgtactacatagactttgtctctgaacataactcaattgtagatagatactttgggtactttatcgcatatagaaaacttactaggaaagataaaatgaaatctattttaatatctgtaaagaacaccagcttatgcatttttaaacatggaaaattctatgggttatctagttatgagatcccactgagttcactgaaaattgaaaaattgcaaaataaaggttgatattaggcaagattgagaattattagtcaaggctgaagaaagagtagttaagaaaaaagaagagtaaaaatgacacaggaaacaaactaggtacatttctggaagagtcagtgccttatcgtggtgaatgaaggtatatacatatgatttgttcagtataagccattagtcacatgaagcaacagttcaatagttacttcccagggacctaaaaatagtcattgagtttttagtagtagtagagtcaaaatgaaaattttattcttcatagttccatttatttgaatcaactgaatgtggtagcagtttttttaattataataattttgatgttcaagaattctaagatgtcaaatattctgatctctctcaatacacagattcactcatatattttcactcattacgtttaatagcaaaaagcacacaattacttttgcaccaaactaatatttaacaaagcattaattgaacatgctctgaagacaagactaaaaattgggtatagaaacatggtgtgccctcaaaggaaatagtggtcacagtatagtgtgtaaaatgtgacagtactataaatatatgcccaggctttttctaggaaaccgtgaccaagtcttcaatttatgctttaatactctggagagaaagttttcccatactaatggtagctgttcacttgggagactgtgcccatcactggatttttttttctataattgagctgaaagtagaattcctctaaaattttccattaatcttgtttttgctttctacggctacagcggacaactcttcacaagagagcccttcagacatttgtaggccactgtcaagtctcctttcaggactctttcctttagattaagacccccagttcattaaccattcttgattcatcatcatttttaatccctttattttgctgtagagaaattttctctacaaatttctataaattttctctacaaatttctataaattttggcagtatcccacctaagtaacaatacacagaattggatatacagatccctttgtgtgcttgtaagcacagaccatagtgagtgaattttgtgcacgtgagctccatactctacttctgttattgtagtataaaattgtgttagctttgtttttaagaatctttttgttggttcatgtcaagaataagacaattgaatattatttcatatgaagttttggctatcagatctattacattttattttagaataattttgtatttgtagacttatacacttgttttatctctattgaatgtaatattgttggactgcacctagcatctggacctattgatatcaatctcagtagtgactcagcaattccttatattcaccaccctttcctcatctatcaattataggtaacctgaaggtaaacaaattggattatcagaaataagatggaatttggcaagtgcatatgttacccagcacatatagatataaaagtgaataccacaggtataaggaagggctggttataaaaataatggaaagataaacataaaaataatgtccttagggaaagttttttatgaaacacaatgtgcatactactaaagaactgttttccagattatgagaacaggttattttctccttcagtaactcacaaaatgagtaaaacttagggacaattagcaaccaaaaccattagaaaattttgcctacagtgacaaaagaagcagtggagcacaacttaatgcaatacacttaaaaacctgtgactaaaagaaggaaattgtagcagaaaggcttagagaggctcagatgctacctgactcccatttccctcctgagattgtacgggtgattgacaaaatcctaagacttctcactgataccattaaatccagagaagagcacactgagctagtaggcttatctttttcaaagagtagttgaaacttgtgattgagaaagtctaaagggggtaaagtgagtagctatgctgatattctctggtggaaataaatgttctctagccacactccaaattagagaaatttctccaattagatgcaacttggtgtaggacatttaacaaaatctcaaaagctaacagaattggggtcttacaagaaaaatgacacacttgcctgtagcctctaccgagatctcttccaacacccttgccagctattgctcaggcacaaaatgtgatgagaacacaaaatagccagacctccactcccactgtaacttggcgtgggaaaacaaaataattctaggcacaaaggacaaaggtaaaccagtcacatgcgttatatcagagcaaatagaatgtccaattgagctgcccaatcatgagcaggatgaaagaatttagtaactctgtaagaatgccgcaatcaaaaccagaaagaagcgtattattgtaatctaatctattaagcacctggtatgtattaggtggtgttctaatgttttatgcatacatattttagtccttttaagaaaccctataggtattgttattttatgtacagtttggaggtttaataacttgcctaaaatcatacaaatgatgacagagccaggacacaaatcactggtgtctggctccagagctcatgctattaaccctgtgtgatcttggtcttcataacctctaaaaaaaagaagaagaaaataaggaagagagggagggagcaaaggaaggagacaaagagtttaacctatagttcaaggggcagaagggaattaattgctcatgatttatgctgtaggaaaacttaaaataaattcaattaaaaagtgctgaaatacaaaaaataaaggtagaaaatggggtgaaaagaaagattgaagcccagggaacccaataaagggcctaaataataccattacagaacttatgaatatgttacaaataggaagaaaaaatagatgtcactgaaaatagcgacaaagagcaaagcttgagataattatgatgagcacagacttcacaaaaattaaaaaaagaagagagaaaaactttaaagctataccaaacaggagctatagagcttcaagaaaatgagctagtggcccaaggagtattgatttagtcaagcattcaaaaaatatatcactttttcagagaaacaacatacactggggcctacttgagagtggagggtttggggaggaagagagtgagaaaagataactgttgagtaccaggcttagcacctgggtgaagaaataatctgtacaacaaacccttgtgacccgagtttacgtatataacaaacctgcacacgtacctcagaacctaaaataaaatattaaattaaaaatccaaaaaacatatcactctttcctaaaatatgcccttcatcaaaactgttatttgtatcattttagatgtaaatctgatgatgaattgaaaagaagaaaaaatatatttatgatgataaaccaaaggaaataatttaaaaattattttaagcaataaattttttaaatttatttatttaatttatttaagcaataaatttaattaataaattgctcaatttataattaattaataaattgcttaaataaatttaagcaataaatttttaattaatttatttaggcaataaataagatggccaagtttaaaatcagaatatagaaatcaatagcatatacatatatgtccatatataagcagtagtcaactaaaaaatataatgacagaaagtatatcatttacaataccccaaaatatcttaagaatacacttttaaaagcccagaatgcattagctctttttcctgttgctctccctccctgcacctcaccccctacaggccccagtatgtgttgtttttccccatgtgtccatgtgttctcattgttcagctcccacttataagtgagaacatgtggtgtttggttttctgatcctgctttagtttgctgaggataatggctccaattccatccatgcccctctaaaggacatgatctcattcctttttatggttgcatagtattccatggcacacatttacctatgtaacaaacctgcacaccctgcacatgtaccctggaacttaaaaagaagagaataaacttgataaacatttgggatctatataaaggtaactttcaaatgctaccaagagacatataataaaggaataccataatgtgccattggaaaagaagagcaacatcaaaaaatttcaatttttacttttatactaaaaattttaaataaaaataacaaaaattttatgcaagaaaatctgatttttaaatttaaatgaaaaattaatgagcaataatagcaaggaaaatttataaaaagaacaataatgagagagatccaggcttaccatttattaagacatcatacaaaattttaataactaaaataaaaattaagatatatcaaagttaaagactatagattctgaaaatagacaagacacataaaggaatttagtttataatatagttggcaatttgattaagtgggaaaaaatggattgttcaataagttatattgggaaaactggacatctatctttaaaaaacagttgtgtccctttttcacaacctacatctgtacaagtctgttttcatgctgctgataaagagatacctgagactgggcattttacaaaagaaattgtttattgaacttacagtttcacgtggctggggaggcctcacaatcatggtggaaggtgaaaggcacatctcacatggtggcacacaagagaagagagcttgtacagggaaactcccagttttaaaaccatcagatctcatgagactcattcactatcacaagaacatcacaggaaagacccatccccataattcaatcaccgcccaccagtttcctcccataacacatgggaattgtgggaattacatttcaagatggaatttgggtggggacatagccaaaccatatcaacatacaaaaaacatttctatatttaaatataaatgtttattttaaaaatgaaagcgtacaactataaaggaaattgggtaaattgacctatattaaaattaggaaattctattcattaaatgatgtcactgacagagtaaaacaggaagacatagagtggagaaaatattcccagtaaatttatcatacatttatataatgttcagccttattcataataaaataattgcaagttaaaagtacaagatgccatttttttaactatcaaattgcccacattcaaaaattgtgacgatgcactgtgttaggaggtgtggtaaaagaggctctttctgagagctgaaggaggctggtggagtataaattgttccatattcttggagagcaataccaaaatatctttaactttataactgcttaaaccctttggcatagtgattctacttctaggaatttatcctatatatgtacctgcctatgagtgaaatggcaatattaattgcaacagtgtttccagtggcaaaaatcgaaccaaaaaaatctaaatgacaaaagaatagctacaataattgtattgcatccatatagtatactgtaatgccattcagctttttaaaaatgaggagctgacagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatatgaaggacctcttcaaggagaactacaaaccactgctcaaggaaataaaagaggatacaaacaaatggaagaacattccatgctcatgcgtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcccgcatcaccaaggcaatcctaagccaaaagaacaaagctggaggcatcacactacctgacttcaaactatactacaaggctacagtaaccaaaacagcatggtactggtaccaaaacagagatatggatcaatggaacagaacagagccctcagaaataatgccgcatatctacaactatctgatctttgacaaacctgagaaaaacaggcaatggggaaaggattccctatttaataaatggtgccgggaaaactggctagccatatgtagaaagctgaaactggatcccttccttacacattatacaaaaatcaattcaagatggattaaagacttaaacgttagacctaaaaccataaaaatcctagaagaaaacctaggcattaccattcaggacataggcatgggcaaggacttcatgtccaaaacaccaaaagcaatggcaacaaaagccaaaattgacaaatggaatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccctatcaaaaagtgggcgaaggacatgaacagacacttctcaaaagaagacatttatgcagccaaagaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagagataggaacacttatacactgttggtgggactgtaaactagttcaaccactgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccatgaaaaatgatgagttcttgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgttgtggggtggggggcggggggagggatagcattaggagatacacctaatggtagatgacgagttagtgggtgcagcgcaccaacatggcacatgtatacatatgtaactaacctgcacaatgtgcacatgtaccctaaatcttaaagtataataataaaaaaaaaattaactagaaaaaaaaatgaggagctgaaataaatatattaaatgaatgaatgcacttaaagtactgaatgaataaaatgaatgtactgaaatggaacaaaatcctgtgtatattgttaaattacctaaacattgtgggcggtatgcgtaatgttatatgatttgtcttaaaaaacaaataaaactttaaaacaaatctcatcttgtagttcccataatgcccacgtgtcatgggaggggcctggtgggaggtaattgaatcatgagggaagttacctccatgctgttccagtgatattgagtgagttcttacaagatctaatggttttataaggggtttttcccctttggctcatcacttctcattcctaacatcatgtgaagaaggatgtgtttgcttcctcttctgccatgattgtaagtttcctgaggccttccaagccatgctgaactgagagtcaattaaacttttctcctttataaattgccaagtcttgggtatatctttattggtagtgtgagaacagactaacagacttatatatacatagaatatggataatatctggaatatcttgaaaagtaactgacaacagtagttgccccagagagggaagctatgtgggaagaaaatttagtttttctgtttgttctttataccttttagatttttctaccatgtacatatattacattatttttaataagcaaatacttttttaaaaaaacacaaagtttttataatagccattccgactggtgttagatggtatctaattgtggttttgatttacatttctctaatgatcagtgatgttgagctttttttcatgtgattgttggctgcatgtatgtctaattttgagaagcgtctgttcatgtcctttgcccacttttttatggggttgtttttttttcttgtaaatttgtttaacttccttataaatgttggatattagacctttgttagatgcatattttgagagaattttctctcattctgtagattgtctgtttgctcagttgatagtttattttgttgtggagaagccatagaggggaacaaccacactggggcctagtggaaggtggagccgggaaggagggagaggatcaggaaaaataactaatgggcactatgcttaatacctgggtgatgaaataatctaccacaaaccgccatgacacaaatttacatagataacaaacctgcacttgtactcctgaacttaaaataaaagttaaaaggaaaaaaagaaaacacaaagtttaaaaatggaaaggtgagcaaagatatgcaaagagaagtagtctcagcaagaaaaaagtgattactttttgcccatacaaataaaaatactatgtaccatgaaattataaccagttaatagaaatattaacatcaacatgtatgaaactgaaaatgttaaaaatgcatggagaaatgggaaaaactaccatttaatatacattttgaaagacatttggctcagaagaggaagaataagtggattcatttcaaataattcaacaaacatttaatttagtatctaccaccataagccaggaaatgtgctaaagacagggagtacataaatgatgaagacttttctctctccttcattgtccatgatatattattagagcctttaaagaatatcctttaatcagaactgtcttgaaatacagttttttacatttaagtcaatatgttatataaacagtctgaacagattcacattaaccaaagtgaatcaaagctattgtttttcctgtatatcaaacctattctctaactaaaagaaactgactttattttatgagtcttgtctttagaaatttcaactagctgtcttctttgatactctattctttcccaggtgttcatgctttgattttctgatgaattgaagcagtgtgtggagaagattttttaaaaagagagacattagaacaaaaggtgcataattttcagaagtatctttctccatgcttaaattcagactagaattgatattttcatttgtttaataggaagctaaccatttcagactccacatttgcattcactaataaaagataatcttttaggtatattacctgttacatggatctcctcgctgcttcaaatagcaaagcagtgtattcacttgcttatctgtcatatgtatttctaccctaaattgttactgataataagcatttcagatggccccagcaagattgataatgatctttttcctgatggctccattagatcagacttcagaagcattgtactttgcatgagtccttggaagctaaatatgaaagttgaatgtttggcaacacaccgacctagctgatgaaattggattgctctcttctaaatatttacttcagcactttgaaattagtctgtattcattcacagaaggtgctgtgacccactcagtgaggaatcatagctagttacttctcctattagcttagttggtacaattccttgttattgtaattcacaagttttaaaacttttagctggaagattttcttataattttttctaagaaaactcttgcaatttaagtaaccttaaaaataaaaattatctgggctttcatcaatgcaattcctcagtaagaaaacataattgtgagaaatggtatcatggaaaatgtaatagttgattgtgaaagcttcagttttgctgccatttgtattcatgatgcctttgagttaaaaacgttagtaatggaattgagatgggacatctgttagagtgaaacatttgattcattaatcaattgaaaataaaaaaaaacattttggagcttctggcttacttgtttttccttgtttctcaagccctagcaacaacatttcattttcatgaaggatatcagctattctgggaagaagctagtttggttttccaataatgtgctcccaagatttatctgtgacgatatacaagtagataagtttagataaggaaattacagaggttctcaaacttttttttttctttaacctctaaagcctagagttcccgaagattcagtgttggtacctccgtatttctctatcaacctcttctcctaggtagtctcatcaggacctatgcttcaggtttcataagttccatccctatgcttacatttttctttatgcttatatttaatatcatctttgatgtgataaagatctaatagacattttaagattaatgtatacaaaacacaactcttaattttattttccaaaaccagctttttctggttttggctcatcaaatgatatccagttgcttaggccaaaaacagaagaatcatcccggatttctctttctgactcacactcacatccagttcatttgcaaatcctgttagtctatcctcaccaactctgctttgctgctgtaacctaaaccatatcgtttcttgctcagactactgcagtagtactcaaactggtccctgttcccactttgcaccctctacagtctcttcacacaacagcttgagtaatattttaaagacataaattagggtatatcaaccccagctgcaaactatctactagcttcccctcccacttaatcaaactccacagccttaccatagtttgccagcccctggctacctctttggcttcatcttccatcaatttccccttgcccatgcaccttcaataacactagctttcttacaactgtttcaaagttctaagtatgttcctgcctacagcttttgtagttggctattctttgtgcctgtaacacacttttcatgtggctttctctctttattaagggctttatttttcctcatagtatgtatcacaaccaaacattgtattataaatatatgtatttgtgtacactagaatataagctctaggagggtagaaaactttgttttgttcactgctatgcccccaagaacctacaacttaatcaaagcagctctcacacagagtaagtactcaataagtgttggatacatgagaaaaatagagttgtaataggaaagaattctgtcattccagaaggcagaggtagggagagtaggtgttactgggcagcagaccttggcttagcggacagaaaagcttgagaaaaaatgaacagtacctgactctagaggatgaggctttgtaacgtagtgagttctctgttaccagaagggttcaagcagaggttggaaaggtcttgttctacagggaagctccatttgggtcatctcttaagccgtgttcacctatgttggagaagaaaaggcagagaaagaaaagcttgcattgattgattggataatagaggcatgaggtaatttattcacagatataatcatttaaggtcaatctgcaaaatgttccccagaaaaagataccaggtggcttctcacttcatccacactcaattccaggacaccagacaggcttgttattgtatctataaggaggctttctgatttacagagggcagcagtcccctgattctcttgctgcactctggctacttgctgtctcctatcagatgatggatatagtccactggatgcaaatttactctgttcctgcatttcagcctttagatgaaagaacttcccagaaccacattgctcatccattctaaatcatattgaggcaagactgacctctgcctaggtttttaagctgtaaaggattcactgaaaggttattatagtatgatatattatgtgggatattcaaggaaaagcttcaaaatttttgaaaaaatttatatatgcatacctcagagatattgcagtctcattctagaccactgcaataaagtgaatatcataataaagcaagtcacataatttatttttgttcccagtacatgtaacagttatgtttacactatactgtagtctattgagtatgcaacagtattacatccaaaaaaaccttaattaaaaaatactttataactaaaaaatgctaatgatcatctgaaccttcagtgagtcaatcatctttttctggcagaagatattgcctcagtgttgatggctgctgactgatcagggtggtggctgctgactgatcagggtggtggttgctgaaagatggggtggctatggtaaattttattttattttattatttttatttatttatttattttgagaccgagtttcgctcttgttgcccgggctggagtgcaatggcatgatcttggctcaccgcaacctccgcctcctgggttcaagcgattctcctgcctcagcttcctgagtagctgggattacaggcatgtgccaacatgcccggctaactgtttttgtttgtttgtttgtttgtttgtttttgtttttgttttttgtatttttagtaaagacggagtttctccatgttggtcaggctggtcttgaactcctggccttaggtgatctgcccatctgggcctcgcaaagtgctgggattacaggcatgagccaccgcgcccggcccggctgtggcaaattttaaaactaagacactgaagttttccacagtaattgactcttcctttcaggaaagatttatttgtagcatgtggtaccgtttggtagcgttttacccacattagaacttccttcaaaattggagtcagtcctctcaaaccctgctaatgcttcatcaactaaatttaggcaatattctaaatcctttgttttcatttcaacaatattcacatcttcaccagaggagtaggttccatctcaagaaaccactttctttgctttttcctgagaaacaactcttcatttgttagttttattacgagattgcagcaattcagtcatatcttcaggatccatttataattctagttctttggctgtttccactacatctgcagttacttctccaccaaagtcttgaattcttcaaagtcatctgtaagagttggaatcaacttttttcaaactcctgtttttgttgagactttgaccgcctcccatgaatcatgaatcttcctaatggcatctggaagattgtcaatttactttactcagatgcatcagaggaatcacaatttatggcagctatagctttctgaaagtatttcttaaataataagacttttaaaaattaaaattaccccttgatccatgggctgtagaatggatatcgtgttagtggacatgaaaacattaatgtttttgcacatctgcataagagctcttggtgactaggtgcatcgacaatgagcaacaatattttgaaagaaatctttttttctgaccagtgcatctcaagagtaggcttaaaatattcagtaaaccatgctataaacagacgtgatatcatccaggctttgcagtttcatttatagagtacaggcagagtagatttagcataattcttaagggctccaggatttggggattggtaaataagcattggcttccacttaaagtcaccagctccataaacccttaccaggagaatcagcgtgttctttgaaggcttggagctaggcattgacttctcctctctagctacgaaagtcctaaatgtcatcttcttccaatacaaggctgttttgtctacatcgaaaatctgttgtttaatatagttgccttcatcaatgatcttaggtagatcttctggataacttgctgcaacttctctacctcagcacctcctgcttcaccttgcactttcatgttaaggagatggcttatttccctaaacttcacaaattaacctctgctagcttcaaacttctcttctgcagtttcctcacctctttcagccttcacaaacttgaagagatttagggccttgctctgggttaggctttagcttaagagactggtgtggctagtttgatatttatctcgaccactaaaactttctccacatcagtgataaagctcttttgctttcaatggagtcacactttcaatttccttcaagaactcttcctttgtatttacaacttggctgtttggcataggaggcctagctttctacctacctcagctttcaacatgccttcctcactaagcataatcatttctagattttgatttaaaggatatgtgtgtgattactcctttcaattgaacatttggaggccatttaagggttattatttagcctcggggtcttggggaatagggtaagcccaagaagagggagcgagaacaggtaaggacatatttttggtagagtaagaacacacacatttatcagttaagttcatcatcttatatgggcatattctgtggcaccccaaaactattgtgatagtaacatcaatgaccactgatcacatgttactatatcagatataataatcattaaaaattttgaaatactatgagaattaccaaaaaaaatgtgacacacgacgtgaagtgaacacacactgttggaaaaatggtgccaatagacatgcttgatgcagggttagcacaaactttcaatttgtaaaaaatgtggtatctgtgaagtatactaaagagaagggcaataaaatgagataggcctgtactatgtttttgaaagaatatttcactggaaagagggagcagagaaatcatacatatgaagcacctattgtgtaacaaatgtttagatcgttgccattcgttaactttcaatgctgtgtgaagccttgtacatacattcatacctagtttactgaataagctggacttagtaaggtaaaagcagaaaccaacttcattgttttctctctgccttctcacaaacccctctaggaattaattcatccctccttttgatacaatctcaggcagatcatttattataataaaatctactcaagtctaatagtctcataagtttaacacggtcaaatgcaaaataaaaactatgaacccttatttgacttaaaatgtatccttttccccaaccttatcctgcttcaggccaaaaaatctacaacagagaagggaataagatttaattcttttttcaacctatttgcttcctatattcatttttttttttttttttacctttctggaatagaggagagatgagagagcaatcatgggaaaagtacttagttttatgggtggtataattgtaatttagtttcaatacccttctggtgatagatgtataatctgcaggtctttatcctttctggggcttttctgggttcatctgagttcctcctgctggcaaactcaagactatggttttccggatagaactgagctctcctcctgctgacaaaactatggttttctggatggaagcaaggcttcctttggatgaccacatttaactatctcttgtccctgagcttccactggtccacccctctattgagattcaggcagtcatcttgaatagagtctctttaatgagcaccccttgtcagtttccctcctctcaactcatatctaattcatgggaaacatacattttccctgttgttagaagaattccagctcctctccaatgcagctcccaatcttccttctgttttcaggtagaagaactctaaccttagtctatcacatattttttcaggaggaggcaactatctggatttatgatcctcgcaatctgggaaacatatcatgaattctgagtcaacccattgaacccctttctctaaacttgggttgaggagaatgcatccctctctcttcccctttaagagagtacagataaaaatattgttaattcaatgttttccaaaggaattttctttttttagtttcttcaacttcaccttccataaaggtatgtgttggaggccatggaagggcattgatcagctaagactgacaaaacaagtttgagatcttcttttcaacttgtatatcatagctatttatagttctatgcttttgaatatgggaaaattgggggagttattcaaaaactctaaccaataggaagcattatatttaagatgccattttatgttaatttgttctttcaaacaatcctatgtggattgaggattttcctcaattatcagtaatgtaataatagtgtctacctgtaggattattatgattttatttgataattgaggaaaattggtcccagaaaagttaagttactagaaggtcatacaatttatattggtgagtgaaaaatacaccatctctgtcctcaaaacactcatttatttgggggagacggaaggtaaattaatatgtaaggaaacaaatgtgtgagagagacaaatagataaagatacagatatatagatacagatatatgtgtatgtatgtgtatatatattacttgtaaattaggaaatgctgtaaggataaaagcagggtataatgataactgaaatgaacagaggtcaaggaaggccttttcagaaggtgatcattaaactgagtcattatgtataatatttccttaagtatgttgtttccttatgaaatataggaagagaacacttcatgcagaaataccaacaggcgcaaaagccccaaagtagaaaagagcatggtcagaacagagcacaggcctaaacctagtgaagtgtgagagaagttgcaagaggcatagctggacagataagtgggccagaagacaggcgagagtcctgggacctgccacttagagttgtgtggacttttattattattattgcttctcaaatatgcaatatgtatttttactgtattattcatatcacttgtttccctttcatcggtaaagctcatccactccaactaatactctatgatttatctctcttggaggaggagtgcactcccttcctacccatgtcccattttagcatatgaccttaaattttcgctcgcttttgagatttttttttctcatttctgcaaagagtgtgaatttcattaggacaaggaaatgtggatgatgtgtcctttgcttctgtatggtgagcattcaactggtaattgaacattgatcttatttacattaagatttggatagaagtagggtattaatctgagtataaagaagagattatactatcttttttattggtggtcagtgttttgaagcattttcttttatttctggcagactccacaattccaataggaaaatagtaactgattgagcttctagtttttaatcctgaaaagaaaatactaatttgaaaagaaatataggtataaattgctaatatactgcagtaatcctgtgtagagttagaaaaggtgccatatcctgacttttagatttacttactttataacagtaattgtttaaagttgatttgttcattcattcatttaatcatttagagcttattatataacagatattttgtaagaagatagagctataaagaaaatttttaaaaatttttctgaaattttcttcaagaggctcacaccctactgggaaagtagacatgtaaatagttagatcattttgagtactaatcaagaagagtgtcatagaagagacataaaagaaggagaggttattgctacctgggagaaaaggaaggttgaactgaggcttgaaagataggtggagattttccagggacaagaagtagtttggagaagggcactccagccaaaggaattttcatgaagcaaagaccttaataggcaggaggccatggtaaggagtaagaatgggcacatttaaattatatggcttcaagagagaattcatctgtaattggtctaatgataaaacccagcaaacctttttatcatgtgtgtttgcatctgttgagttctctgaaggttgtgaaaaaataagcctaccactcactcatgttcaaaaaaaattatttcatggttcaaggatcagtgttacagagtttcactttgagatgaatgtgatagagactagattgagttttgttttgttgttgttttctttcctgtgattaatcatgagcaagccaaatagtcaaaattcatattaataacctagttctcataactttgagaggattattaattcatgaatatgagatcacatgaaggacagatattatcaatacacacaaatcatgactctatatttgttcgactctctatgtcatgatcagagttttgtttgactctgtacattattatcatagttaatatttgaaatgaagagagattttttgttgctgttattgtaaaagcatagttttacaatgaggtcttctattttggtttgctctctctagaatacagtgataggtgttttgttttttttttttttaatctggacaagtaaacagaactaataagaaaatacattggttatacttttccacttgggaatgaattacagaatcagaatgttgtcactggtagattattggcagtcaattgtccttctgtacattcttatttctatttttagaaacaaaatcaaatatacaaacattttattgaaaaatgctctggaattttaaatagacctacattattttacaaatctttgtgttatggaaggaatatcactctgaactgccatgaaggagtaaaattttaaacatcattcttgagtctactaagtgatatccaacttttgctgaattaatatacaaagttaaatattggccaactgataaagatgagggtgagagttaataagtgaatggtaatatcaatcatttatcccaaaaggtgtttctcccgatgcatgttcattacttactttttgtaagtaatatgtttataacactttcatgtttaaagttgatttatccattattcatttaattgtctagagcttattatatggtagctattttgcaagaagagctataaagaatttttttttaaatttgtctcaaattttcttcaagaggcttcatgttttgatcattgtatattcattatgaaaaaatatgattgctcttacctttgtcttcactatcaattaagaaaagaatgatgagcacaagtatgatacatgtcctaagtaagcagcatatatgcacaaatcaaacatgagttagtagttgccaaaactttactgtaggagtggaaactctgcttttatttttctaataaaatcttaaccaaatcctatgtccatttaaagcaaagttactttaattgaagcagaagtgagagacctgaagccctacttagctacaaccctgtgcccttggggtcaatagttaattttgagtagtagttctatcccaccatctccaatacctttgttacccacagtggccatccctgtagctggggaacctcctagcaccccagtttattttagacccaccctaaaacccattgacacttgatttgaagagtaatataaaagaagaccgagggcctaaaaaatataataataaggaatataatagaaataataattctacagatataaaacgctttttgagctttttcttaatgccaaagttgtacacaactctttcatgcccaatttacagatggaaaaattaaaagatttaacaattttcccaagttcacaaatttaaaaaatagtgaattttgggatttgaacttaagcctgttagaatccaaagcctatgttccattagatggattatttttggttaaatttcttccacattagcccactgggaatatggagtggggaaggttaagtgtgttcatttattcattgagtcaataaacaaacattaatttagttaggcactatatctatagatatataactataagtgtggaactgtaaaggtgattaaacagaacattatgtgtctttacagtacttatttataattctatcttctttaccaataaattatagacttaaatattttgcttatttctctgatcctccattctctgtaaaggttggataataaactatgcaagtcctgaagtctctttcagctctatgattttacaagtctaatcgttataaggccacagtattgtattatactaactacctttcccctaaaggagtctagtatggtcctaattccatgactagggtggtttctgctaaacacacaggtcttttccaaaccaggcacgactcctttaaatgcacagtatttgtgtcacttcagtgggaggtaaaagcctttactccccgttagctttttgtactatattataagctgcaaggtcaacctcagtagagttcattccttatgtcttacaactctgccttggtgcctctactattttcctccctccgtcctataacttctcttgctaggactcttcatgtcagcataccatcatacatctatgcacctcatccctcaaatcagcctactcatttcaatttcttctggaaataattttttttaagtttcagaagtagaaaaataaactaattttaactactttgttttattttgttttctttcctgtctgatccaaccctctcctcttctcttttttcttggaaacatgttgtcaatataagaatgcttacacaatttggctttggtcctttctttctttgtctggatgctgtttgactcataaatgctggcaaaagcaggagacagaagacaaaatatctgttccacgttatggtatatggtaaaaaatcaactgctttgtagcaccttgaacagaaaagtcagttataaatactttaataaaatatggtgtttgttatttttaggtttcaagccagcagagttgtaaactggcgtgtgactggagaaaaaggtttccattcatgtttctagaagaatattcacaatgagattttaaaagttttcaattcaaataaatcatgataccataataaaacatttattagtgagtatttctatatattcaaagaaccatattcaagtattcttaatttcccattgtattatgaggagctgatatggtttggctgtgtccccatccagatctcatcttgaattcccaagtgttgggggagggacccagtgggaggtaattgaaacatgggggcaggtctttcctgtgctgttgttgtgatagtgaataaatctcaagagatctagtagttttacaagggggagtttccctgaacaagtctctctttgactgctgccatccacataagatgtgacttgctcctccttgccttccaccatgattgtgaggcctccccagccatgtagcactgagtccattaaaccattttcctgaataaattaaaaataaattgcaaccaccaactgacccatcaaccaacctacaactaaaaggtcctgtgaatgacaaacagatacactgaatagtctttttttctttcaacagagaaaactgggtttaactttattttttattgtcaactgacaacttataattgtataaatttatggcatacaaagtgatattataacttattaacacaatgtggaacaattaagctagttaatatatctgtcacctcaaatacttaacatgccttgtggtgagaacatttgagatttagattttgaaatatacaatagtctattattaactatattcaccgggtttggcaatagaacccaaaaaaaaaaaaagaaaaaatatattccccctgtctgagattttgtactctttaaccatcatctcctcattctcctcacctccaccctctgtaaccaccattctactctctgctttgatgagttcagttgttttcaattctacatataaatgagaatatagagtgtttatatttgctggacttattttgcttaacataatgttctccaattccatctatgttgtcatgaatgacacaatttctcctttttaaagggtgaatcatattccattatttatataaaccacattttctttatcagtttatctcttaatggacacttaggttgattctataacttggctatcattgtttccgtgaacatgaggtggctgatatctctttgactaacttcaaaatattttgtgtaaacaaacagaagtgagactgctggatcatatgataattctgtttttagttttatttatttgcctgtgatgctgctaggctgcaaggctgtatttcttctgttgaccctcaatctgcactaaagatgataaggacctttagttagatgtgtgtttctgagattattaactataggtcagagagtttgatgcattttttaccatatgagagagttaggaatgcagtgctttctcgtgccttcagatccctagacttctctttgcaggaaagcatgtattgttgacccttaaacaatgtagggttggggttcagataccagcacaattgaaaatccacatatcacttttgattcccccaaaacttaactatgaacagcctactagtattcattgacaggaagccttgccagtaacatagtcaattaacacatattttgtatgttatatgtattatatacgatattcttataatgaagtaagtgagataaaagaaaatattaagaaaatcataaagaagagaaaatgtacttggtgttcattaagcggattattgtaaaggtcttcatcctaatcatcttcacattgagtaggtaaggagaaggatgaagagaaggatttggtcttgctgtctgagatattttctggtaaataataaatagaagagtatatccctatattttatgcatttatgacatacctaactttatattaagtgtttgcaatatttctaggctatgcagttcatctgtggggtttttccaattgtcacaaatctccaaaaagttttccaatatatttattgagaaaccatctgcatataaatgggcctatacaatttgaacccatgttattgaatggccaactgtactattatatagagtagaagtagaaataaaactatttacttggctgtgaagccaagtaaatctaggttcaaatcctggcttttctacttgctactttagtgaactcaggtgatgtctttaaatattatcaagcttttataaaatagagataatagaaacaacattatctataggtttgttatgaagattaattaacccagttattgctcaatgtttgtctttattgctgttattaccaaatagcatgacttcgacttttgattatggtagctaggaaatcattaccagtcaatatcatttaggaaaatgttcaggaatcaacttattgaatactacatttaagaactgttttttgtttggtgatcttttatttcaaaacagtttacttaatttttggcagactatttataattttagtagtgaaataactcattgaatcttctagtttttatccccactccccaaagaccatgggtatcttcaggttggattgatagtatttttaaaaagagaaaaataaagataaatcaccattttttttgtatcctactgcttacatttattatctgctttaattctcaaaacaacacaagattaaaaagctgccttttcaaataacagctcttgctactacatcattgtttcccctccttgaatcctggattataacaggagagatttattgctccttgaggaattccattaacattttggctaccacctttgaaaacctgcttgtttaatatactttaacccctagatgtattttttaaaagcatgttttgcagtctacttcccaccaccctactccccccaaaaaaagtttctgatgtttcttcctccatttttctactttttcattttccaaaatattatctcaaaaagaaccgttctttcagtattaaaagatatgcttttgctcaaaagtcagataatgcaaaatgatttctgcctcactaacatttctttgttttctttggagaagagaatgaagaagaggtttttcctctcctgctagcagctgagtccttttgtttggctggcccagtgaggcttttgtttctatagaagagagccctgttatttctcaaaagcttttgtgtgcaacacttcctcctgtgtttctgctcacccagcacattttgcaggagtaaatgtcaaaaagactaagtgttgttgagcttggttgtgttttatgatgttgttgttctccctacaaatctttttatgaacagagactgaattctgttgctggatagtggatgtgttggccattctggttttgtttgtttgattttggtgttttggggtcagagaaaaggatgccccgaatgtttttaacaagcttttcctgtgagtcctgctgtttctgacaaattcctggaatctgacagaagggcatctgtggatataatggtggtaacacttgaaagtatttttcatctgtaatggtgcctgcattgaaggttgcttctttcctgatgtgttcagtaagaagcggttgttttgtccaggtggggtgactcacacctgtaatcccagcactttgggaagccgaggcgggcagatcatctgaggttgggagtttaagaccagcctgaccaacatggagaaaccccgtctctactaaaaatacagaattagccaggtgtggtggcacatgcctgtagtcccagctacctgggaggctgaggcaggagaatcgcttgaacccggtaggcggaggttgaggtgagccaattgcactccagcctgggcaacaagagcgaaactccatctcaaaaaaaaaaaagaagtagttgtttttctcaataacaatgagaaaaaagtgaaataatatactcaggtttaaaaaattcgctaatatgtaacttatttccccagtttgatgttaccagatatcatccaatgtatctagacggcagtgatttctttctctacctggaattccacccacaggtactgtcatggactcatacttcctaagcagttgctgctgacaagcatatcagagaggagtatcctattattagcagctgcttaaggaccagactggaagaagttctaagacctgtcagctccttctcttgagaactactgcagcagcacaaccagggtcagctctttcgtcaagaataggttgaaacatgaacttttggggagaaagggcttataacagattgtaaatcatttttttttttctttctcagcttggtgaagttgaaatagtacaggtttggttgtcagattaggttcagttgctggatatgattcttatttgtacatgtccattaacatagaaattctgagtctcagttactttttctgtaagatgagaataacagtaataccaatgttaaagtgtggctttctggtttaagtaatgtaatagtatataaaggggctagaaaataggtactgggcacccagtagatattccacaaatggcagttcttattatatgtgttctagagttaaatactcatctctatagtccctccttctgtttctgtaactttctataccctttctatattgtttgctgatttgggacatcaatctgcccaaggcctactgatttaggaagaaagtgtgtgggcccagctctcttagtgttagggccacttaaagtagtatccatagtgaaaaagtcaccctctaattgccccagtaattggctctagcactttaaggctttgaaaattttataaccgaaagaacttcccacacaatcttttaatggcaatcgttctaatttacgggctttgtatgccgtcctgagagagctgaatggaagacattattgtgaaggggctatgcagatagcaatacaaatgtccttgcccacaaggcatgaaagacaaacactgaaaatgaaaaaaggaaaaataaccaagcagtacacttgcagaaataactcttatgacttcaaaacattaaaaataaaactgctttcctgtgtgtctgtccttgacagtgatttcatctttttagctgcctttcagcttgttttatttacagctgcgaaggatacaagccactgaatgaagagtacattttctctttctcacattcaaatattacatgtgtgtgtataatattaattaaacatacagtggactcatttttatttatatacctgtttgtatgtatgtatgtaagtatgtagtgacaacatgaatgtatactgcatgtatatgaatatatatacacacatatcatctatatctatatatatttcgtaacatacacatattccttttctgtttcagtgcaagtcttcctcatgtatttactcaaaggcataaagaatacctaaatattaacaacttcaatatatacctggatttataaccttgatgtacaaaattctctgccttctcaaatccccttttcctttaatatcccaatttagagttcaagcccccagcttgaaacctccagtgcctcctcagcatttctcacagttgtctcctggccacctctagtcctgaagttccttagccatcccccacaggcaagttctccatgtgcttttccctgtagtccagaatctgccatcttcttcctctggcatgccctctctctgtgttagtttgctacagctgccataacaaagtaccacaaattaagtggcttaaacaacaaagtttgtgtctcatacttctggagggtacaagtctgagatcgagatattagcaaggttgtttccttctgaagactgtgagagagaatctgttccatgactctctcccagcttccagtagtttgccggaaatctttggcattccgtggcttagggatgaatcactcttctttctccttcggtcttcacgtgtcattctccctgtatgcatgtctgtttctgtgtccaaattttccatttattaaaacaaacacagtttcattggattagggaccactctaataacttcatcttaacataatcatcttcaaacaccctatttctaaataaagtcacagatactggagattagaacttcaccatcttttgggagaacaagattaaacccacaacactccctctctcaaaaaatcctccttacgtcttttcgctatgtatctaccagggaaacattcaaaattcatgatctgttattttgtagagaaatgtacctttctttgtttcacccttctagttcattcttggggcctattttgacagaattaaaattttcaatataaacttggacttataaccttgaggtcacaaaactctgccttctagaatcaccctttcctttaatatcctggttaagagctcaaactcctggaaatacatagaattttctttactaaaaaacacaaatacatgcacacatagagaatactgaacggcatattgtgtatgcattttttttaccattttgttattcaataaaacacagatacagaaaagcatacaaaatacatattgtttaatgtattattttatataattattatgagacaaaaatcctgtaactaccacctagaacaaaaatagaactttgccagctaccagaacacttctacatgcctattataatcacagttctttctctccttctgaaagtaaccactaatctgactttaaaagtagtcctttatgttcttttcatctattcctttatgttttaagctggatgctctattcctatatgttttcctggatacactattttagtcttgcccattttttttttagcttaatttgtcttttcagtcttctttaatttgttgaattccactctatattttatttaccttatagtttatctgctgaagaactcaggccattagacctatatagtttgccaaatctactcatctctaatgtatacccataatatagttcaatatgtctctctctactctttcaaaaaagaaaaaaaaatggcagctggatctagaggtattatcagactcatgtgtgatccctttgctagactataggtgatggcacgcccttttataataaagcaagtaatattattttcacccttttttacattagcagccattaatgttcaattcttaaggtgataatatttctatcaattttgtttctatttattatctggaataattttgcaaagagccatttatcctcatttattatagttgtagagcttatataagaaaggcattgtaagtgattgattcttttttactacttacccagttctcaagataatgagttgtttccttgtcatcttgaaaggtacaattagttgtattattatgactattattaaaagtattattttgaactaatgaatttaaacataactgaaatgaacaaaaaatggattaaggaaaagtgaacagagcttcagtgacctgtacagtaatacctagcagtttaatatatctgtaactggatcctcactaggagagggaagagataatgaccagaaaaaaagaaaagaaaaaaaattagctaaaattttctcaagtttaatcaaaaacgttaacatacagatccaagaagtttcaaacaggataaatacaaacaaataaagcaaactactaccacaatggatatagagacactgcagaaaaccaatgataaaataaaagcagtaagagaaaacaaatgcattataaaatagagaaccagataagaattattcctgacttctcatcagaaacaacagagcctagaagccaattgaatggcatttttaaagagctgaaagataatatggaaagttaaagtgcttagaacagtgcctggcacatagtaggtactaaatactttttaagtgttgtaattattgttatgagctttattttcaatgttcttctttaagacgatagagaccactgagtgaatatggcatccttttcttagtacttaaaaggacaatataatgagctactttctaaaagaaaatgtaatttttgtgtgaaacaccaggcccccaggtgtcatggtagctatttcattgatattattccaaaagagctagctaaataaatgaaattaaaatatctgcatgaaatttgtagctctctttattcaagcacacatatataaacttcactttgattagatacataatttgtgagatatttttcaaatatttgatctcagaataacaatttaaaaatggaaaaataaatgcattttcatttaaaagcttaataaagaattcctttccaattgtgactgatttaatttatatataacattggtttcaaaatcctctatgagtacatttttattcttctctttatttgtttataatcatctgtgaatttgtaggcagaagactatactttattatgtaatgcattattcaaatagagtaatatttgaaaaggctatgcttatttacacaattttaaaaatacccctttttaaaattcattggctagttgttctctttgctcttcccagtttgaaataataattctctacaatgctgaactgacatacttgtttcctcaaactgccatgctatctctctccttttttttccttgaagtctttgcatatgctatgttctctgtgtagtactctccccaataccacactgggttggctcctaatcttccttcagaattcaacagaaaaagttacttccattggggaatactctcctctatgttctcaaagtatggtgtatttattctcatcattctgtttatttaggcaacatagtataataattaatactgcaaccttgactcagattctatgtaaatcttggttgtactagattcttgctgtatgaccttgggaatgttttacttgatctcttgtcctttgtttcctcttcaacaaaataagaataataattgtacctatcttataaggtgatgtggcaatctagaaaaggttaacaatggaacaaaatagagaacccagaaataagaccatgcacctacaaccatctgatcatcaacaaacctgacaaaaacaagcaatggggaaattatttcttatttaataaatgatgctgggagaactggctagccataggcagaaaattgaaactggaccccttccttataccatatacaaaaatcaactcaagatggattcaggacttaaatgtaaaacccaaaactataaaagccctcaaagacaacctaggcaataccattcaagacataggcatgaggaaacattttatgatgaagacaccaaaagtaattgcaacaaatgcaaaaattgacatatgggatataagaaactatcaacagagtaaacagacaacctacagaataggagaaaaattttacaatctatctatctaacaaagctctaatatccagtatctgtaaggaacttaaacaagtttacacgaaaaaaataaccacattaaaaagtggacaaaggacatgagcagacatttctcaaaggaagacagaggtgtggccaacaaacatgaaaaaaaagctcaacatccctgatcattagagaaacgcaaataaaaaccgcaaagagataccatctcacaccagtcagaatggctattattcaaaggcaaaaaaacaacagctgctgatgaggctgtggagaaaaaggaatgcttttacactgttggtgggagtgtaaattagttcaaccattgtggaagacagtgtgaggattcctcaaagacctagggccaaaagaattcaacctagcaatcccattactgaatatatacccaaaggaatataaatcattctattataaagatacatgcacatgtaagttcattgtagcactattcacaatagcaaagacatggaatcagcctaaatactgatcagtgatagactagataaagaaaatgtggtacatatacaccatggaatgctatgcagccataaagaggaacgaggtcatgtcctttgcagggacatggatggagctagaggccattattttcagcaaactaacacaagaacagaaaaccaaataccacccgttcccacttataactgggagctgactgataagaacacatggacacatggggggaaacaagacacactggggcctgttggagagtggggagtggaaaaagggagagcatcaggaagaatagctaatagatgctgggattaatacctgggtgatgggatgatctgtacagcaaaccaccatggcacaccgttacctatgtaacaaacctgcacatgctgcacatgtacccctgaacttaaaataaaagttggaagtttaaacaaaaaaatgtaaaaggttaatacacacaagtcttagaaaagtgcctggcaatgatagtgctaagtcagtgagtgctaatagagctttcatacgtaatcatctttctacttggcacatgcttctttatatttagtgatcaactaataattatgatgtgaatgaattaagccatagtagcctctgcttataaattgtttgtaaaatcaatctaattaatatttattgagtactgagaatatgttttgacacttatttattgaataggtgaatgattaaatgtacaaaatccaataatgaatgctattctacaaaagtaaaggtgaaaaaatcaatgtgaggtggtttctttgggaacaattttttggaagaaattaatgagtatctacaccaaattacgtatgtattcaaatgggtaaaccgaggaaggggactttccagaacaagaagtaacattctcgagggtggagatatgctgtgtagatgttggccttttttttatctcaaaactaattatacagaaaaaaaaaaaagtctgtatcaggattaggatgtaggcaggtgcacctgtgcaagaaacatcattgattttatattggattgtgaaagagaaagtacattgtaaaatcatgcctttcataacagcggattggaatgccctcttcctgatttattagctgtgggaacacaaacatgttgttgaacttttctaagactcattacatgttaagttgtagtaatagttggcccaaggattaaataaaactatgcaggcaattctttcagacaatgtgcctggcacatggtacgtagtcaataagaactcatttgtgtaataggaacaagactagttgaccagattggtcagatacagagaagattctttaaacattttattttcatttaaaacattaatgtatattaaattgcctatttttatttaaaatggtcgccatgggtctcaaccattttttgtgaagaaaattgactgataataaaagacattgggaaagtaatatgagtgtccaaatacttctagactttgtttctcctcaacctttcataattatcttgcccacattaatagcatgttttaaacatttggtgtttcacaagcctttccaaaacattcaccttacattttatagaaacattaagatgagtattttatcacttcacaaaatatttaatcaaattacataattacagcaacagcaacagcagctgacataattaacaagttaaagggagataaatgggttaggtaaaaaactcagatgaatcttgataaatacacaactctactaggtatgtatacaattctatttggtaagtgtacaactctacttgtttgcagagcattgtgaagatatactcaagagcagctttctagccatgagaagttagcatctccaggtccagtcaagacagttatgagttttggttaattaaggaagtttttaactgaagtaggggagcttttttttttttttttttttttttgagacgcagtcccactctgtcacccaggttggagctcagtggtgcaaactcagctcactgcaacctctatctccctggttcaaggaattctcctgcctcagcctcccaagtagctggaattacaggcgtgcaccaccatacccagctgatttttgtatttttagtagagatggggtttcaccacattggccaggctgatctcgaacttctgacctcatgatccaaccacctcggcctcccaaagtgctgagattacaggtgtgagccaccacgcccagctggagacttctgttatgtaatactactattgctgtaggctattaaagaggtcaaatcagttctattaactgaaatatcacttcaataacgttctgcaatcactctgatatctatgttcacataggaatttaaacatatttcataaatatagcacttctcactgatgctgcagttatttatttttccattctagaccatgagctcctcaatattagatacttgttctctttgtgaagcttgtccctagcccatagtaggtactaggagatgtgtagtatgaagtctagaagcttagtgccatgagaaaaagtagaagaaactaggtctgcttcacttagagcaaagaagataaggtggctataatagctggcttcaaaatctctgctttccatgtaactgagccaggcttttagctcaggttctgcaattaaacagctttgtaactctgagaaattacttcatttctggaggtcttagtttaatccctgaaaaattagagaagtaagacagatgatctggggaatcccttctaaaggtagttgttctacctatttaaagggacatcatttatagggacagacaacccagcttattctcttttcctttaaaagacagatctgagacctgttgatagaagtaataacatcatagccaattaattaatatagagaaaaaagaaatgttaatggttccaccttggttacagtgtatttaagtaaaggctagatgaccatatgcatggacctggagcgggtattcgattagattaaccccgagatcccttccaattataagattctttgactattaaatcaaagggccaaatgaagcaaaagtgctcaacttcctttttatttaacttttctgactgatcctgctttcctcctgtttattcacatgtgctactctacggggagtaatcttaaatgtacttttctccccttcaacctaaccacagactctgttttgaaactctgaatattttgacagtaaagcagaaacaagccacaatctcatagtctccctggtaaactggagagaatcccaactgcatttgccaactatattccaaagatttcagtagtaatgcctacatgcaatatataaatgccacaaaatgccaccatcgaatgacccaacagtggtcaaggtcagtggatgttggaagtctcaccaagttttccaaaggctattagagtaaacaggaagtcaagagtagcttgactccctgcttctgtcctactctgtgcgtttcttgccaaaaatcaggatctgtatttcttctgtcttacaaatagtacacaatgatctggagtacataaggacacttgcaaaagcctgagaccagagaaacaataactaaaatgtttcatgacagctactactgtattgtggaaattatttattcttagacataggttgataaacttcaaaatatagcattagcagattttgttagtcttgaaaagcaagcgaactatccatttaaatgctaggaaatctgttttgttattttctatatatgtaagtctcacagagaatatcccattttggattttaatcagggtaaaaaacaatcttcatctagcaaactattgctccaaaatccaattgattgaaggattttataaacaatacaatccacattatatttttatagctttgaattgaaacacatgtaattttttaattttaaaaattaaaaaataaatgtgctatggacatgtatttctttatttgatgaccagaaaacattagcactaaagggtggtagtgttttttagtgccaaggttttaactctcttgtactcatagagcatagcatggtccaaatgctatatttggccacattcattgtttcatttcttaatgggcaaagctgtcactgaaggactaagctttttccttaccctcagaaatgtagatccagattatttttattattagatgcagagctttgacttagccctagaaagtaccctgaattataactgacttaaaggagtaaaaatgccaactgacaataatgagtcttctcacaatctgtaacatttagaagagtaaagctggtttttcttgttattaattaattaattaatttatttatttatttattagagatgaggccttactctgtcacccaagctggaatacagtggtactgtcacaactcactgcagcttttacctcccaggctcaagtgatcctccagcttcagcctccagagtagctggaaccacaggcacatgccaccacacctggctagtttttgtatttttttatagagacagggtattgctattttgcccaggctggtctaaactcttgggctcaagtaatcctcctacttcagcctcccaaagtgctaggattatgagcataaaatgccatgcccagccaagctgtctttatttaattggcttattgtatcctttaaatacacatttaaagtaatattaccaaaatcaacatttttaagttcactcaacctgttttattttttattttttatagtggccaaaaagatttttcatgcttctcaaagtaaataaaataattttaaaagcttataagacaagaggaaggagaaaattacatagtttgtgattagaactaattcgaaatacaggaaagtaattgcttagaaattaaagatgatttttaatttggtcaagtgcaaagatttgataatgcaagagttgtatacccagtttacacattaaaattaattgatcgactcgagacttcagcagccactgtctagtgcaaagacacaagcacataattaatgataataatgctcaagtgtttacatcatgtcagtaggtattttgattgctctcattttgctattggtatcaaatttaaaactaaacaattccttttaataattatgttgtcatacttcagttggtacaatatttgagaaaggagctaggacttttcctagcatatcaacttttggttttattaaaatgcacacatcagccagactcagtagctcatgcttgtaatcccatcaccttgggagacggaggcaggaggattacttgagcccaagaattcaagaccagcctaggcaacatagcaagaccctgtcattacaaaaaataaaactaaataaaaaaattggctggggtagtcgtatgcacctggagtcccactgacttgggaggctgaggcaggaagattgcttgagctcagaagttcaaggttacagggagctatgattgtgccactgcactccagcagttagatccggtctcaaaaataataataataataataataatacaattaaaatgcatggatcattcattttatcattcaaaataaatgtcagtggtcatgatcatttatgtcattctcagaaatctttatatagatctaaaatttagcaacgtgtgttacagttaaatatgagttctagctgatgccggtgtgagaaatattagtattttcatactatttagattttttcttgagatatattttaaattcatttttattgtttctgctactaagattagtatgtatttgtagaatgcttcagagtttgtgataccagaacacagtgcacagactgggaggctgaatagaacaataagcttaggaagaaaggctttgctgccagacagtcttggattcgcgtcttggcccacaggttgttaaatcattgaccttaagaaaactacttaacatctttaatctttattttcttgtttgtaaaatgttataatacctgcctcattggttttattttaatgagatgaaatgagataaggcatagtgaatgaaatgtaattttctttgtacctagcatatagtaaataataaaaacaatcattattgtccctcatttaatattgttatctcattcaatattattttctccagagaataacctttaaaactccacactgcacagcatcaaactagacagaagtattaacttggtcacccacccaagggcccttccctccttcactttagctgttctctgctcacccttgtaggaatcaaataaaaactcacttttgataaaaacaaataggcagcttagcttttccttgctaaattcacccttcaagttatacaacctcattattgaagaatagatcagaaaaaaaatcataccatataaagaataggaagcatacaatatgctcattttagtatgtgagctttagaagcttgagttagcatctttatggatatatttctgcattttcacctctagaatcatttcctataggtttggggataggttttgtgcgatcgaaggtggtgtttgtttgttttgcatcttgaatgccaaaatatcatggcaaatgtgagagggatttatatcttaacatttcgaaacttctaggcatattccaacttaaaattcctgaatcaggaccaaaatggtatactattagtcctatacatgaagtaaaatataagaaaccatagttaaaagctagaggaatcaaaaatctaagatgctgatacaaaaagaaaacagcagcaatcttgatttgtttattcatcctgttaacagatatttattgaaagtctagtattttctaggtatggagcatcaagaagagaggtagtttgagtagtacatgcttgattcccactctaggtcaaaaaacaacaacaacaaaaaaaaaaaacaagaaaaaatctgtagataaagacagacactagatgtaactgcacaaagaagagagtgatccacctaatgacaactgggtcatcccaggaactcttatttgaatggtcccctattcctcctagatctattaatatagtactccttgttttacctctacccaaaggatcaaatttgttttagatcttgttttgcctctacccaatgtgcaaatttatttttgatatgtatgaattcacctgacttcacttgtcagagctttttttcttctttttctttttacccttctctctctattatcaaaatacctgttgtggatatttttgtatgtctgtctctctagtcttctccaatatgcttattaaaagcatttgatgatcttttggaaagggaggaatgttctggaacagttcttaaaccaaatttccatctgtcaacagctgtctgaatagagatacataccaaaattaccaaaactccatctccaaaacatgtgagctaactatatcaatcattgagataacttcatacattctgttacatttggaattgtgctgcaaaagccaaacattgcatattaattaaattgtatttatgtccatatgaaactgatagagactcttaaagaattcacaatttaagcataaggtagagtaactggagggagttcactaagaagatgatacaagagtatagggttttatacccagatctgtaatttgtctcattttatttcatgggattaaccaattatgaggataaatgaaagtattttaagagagtttgagaaataaaatataagagaatagatgatgtgagtgaccatgatatgacatagttttgtgtgtctaataactcattttatattctagtattttgctttagatattaataatacctaaaatttaaataaatgtaaatggtttaaagtgtatgatgtattacattacatttgtctctcattacaatcttgaaagaaaatgcaaagggaatagatatcctttcaatactggaacttatactgtgtggttccttctcatacattatcataattaattctcactgtgatattatgaggtaagtattagcctccttgatatcattttcctgataaaactgattctcagagaagctaaacaacatattacaaggtcatacagtttttaaatggtagaaccagggattataccagtaatctttctcctattccacatggtgcttgtgtcatatattatctctttacgtattagaaaacagatccattaaaagtgacttgttccaatagtccatttattattttagcatgcaaaatattatatcttttaagcagtcattaaagatgttcaattatgtagctgaatttatttgtgtaaattaaactaagttgggcaaaagtataagattaaataaagacaaaaggtacatgctataagccttgtacaattggatatgcaagataggatagattgttctaaagattaatggatttgatataaaagatatttagttgcaataaaatagattttatggcaaagtaaagataccttaactcaactgctgtgtaattgaaaatattaacacttgtcacataatataatgagggagcatctgttacccagtggtttcagacaccttctttggcatgtctgaaaccatacaataaatactggaaatattgtttagttacttcataaatctgaaccataatgagtaagccctctgttgtttcatagtgagcaagatgtccttgcaaaaagaaatgcttgtataattgtttcaattacataacttccactctttcctaggatgcaagctgagtccagattttccaattatctcttttacaaagagccctataagggtgatcgagtgaggtagtaaagttagcttctactaataatgcccacttgacagttttggtgaattaaaatgtttataaatttttaaatttaaggttagtcttttagtttcttagcagattgcagacatcttttgtgttatattttatttttcacaatttggttttgtgaagaagatatgacaaacagtcagtgttgggggaacaaggaaaagctcaaagtaaatcatgagcagagagaaaattgagggaaaaagtctcctagagtgagtttttaatgagtgattactgaatatagtaaagaaaaaaggcaaatttgagaaggaataaatgatgctttattataaaaagagaacatattaccaatgacacagaatataatttgccatatctttattgatacgtaatattttacatctttatggggtacgtgtgatattttgttacatgcatagaatatgtaatgatcaaagcagggtatttgaggcatccaccactttaagtatttatcgtaaatacttaagtattaaatacttaagtatttattgtaaatacttaaagtgttaaatacttaagtatttatcgtaaatacttaaatacttattctgtgtgttgggaacaattcaagtcctctcttctagctactttgaaatgtacaatacattgtttttaactatagccactctactctgcttttgaacaatagaacttatacgtttcatctaagtgtatttgcacccattaacttacctctcttctccccaccaacctttcccagcttctagtatctgccaactttttagctcccacatgtaagtgaaaacatgcaataattgtcattctttacctgcttatttcactttatataatgaccactagctctatcgatgttactacaaatgacattttatttttttctacagccaaataatattctgttgtgtatagataccacattctcttcatccatttattcattgatggatacttagattgatttcatgtctttgctattgtgaatagggctgcaataaacatgtgagtaccagtatctatttgatatactgatttatgttcccttggatagatacccagtagtgagattgctggattgtatagtagttcttttttagtttcttgagaaatcaccatactattgtccatagtggcaaatggctgcactattttacattctgactaacagtgtatgagttccctttgtctccatgtccttgtcagcgtccgttattttttgtctttttaataatagccattctacctgggataagatgatatctcattgtggtttttgatttgcatttctctaatgattaatgatcttgagcatctttatttgaatgtcatcttttgagaaatgtctattaatgccctttgcccatttttaatgggattatttttgttgttgttgagttgtttgagttctttgtatgttctggatattagtcgcttgtcagattaatagtttgcaaccattttctcccattcaatttgttgtttcttccctctgttaactgtcttttctgctgtgcagaagtttaatatagtccaatttgtttatttttgttttagttgtccgtggttttaaggtcttagccataaaatctttgcctagattagtgtcatgaagtgttttccctttgttttcttctgtgagttttataatttcaggccttccatttaaggctttaatctgtcttgagttgatttttgtatatgatcagataggggtccagtttcattcttttgcatgtggatatccaatattcctaggatcacttattgaaaaggatgtcctttccccagtacatgttcttagcagctttgtcaaatgtcagttggctataaacatgtggatgtatttctgacttctctattctgttccattggtctaagtgtctatttttataccaataccatgcctagtaatatatttctaagtcaggttgtatgatgcctccagctttgttttttgtttgtttgtttttgtgttttgttttgttttgttgtttttggttttggggttttttggttggggggatttttgttcgtttgtttttgctcaggattgcttcagctattctggctcttttttttttttgattctatataaattttagaattctttttctcatttctgtaaaaaaaaatgactctggtatttttatagggattgcattgaatctgtagattgctttgggaagttagctcattttaattatgttaattctttcaacccatgagcatgaaatgtctttccatttatgtcctctttaatttctttcatcagtgttttgtagttttccttgtagagatctttccctttcttggttaaatctgttcctaggtatttggtttctgtaaccattgtaaatgaaattgccttctgaatttgttttttgactattattgttgtacagaaatgctactgattttttatattgattttgtatcctctaactttactgaatttattagatctaagagttttttggtgtagtattttgtgggcattcttatcttgttccagttattagagagaaactttcaacttttctccattcagtatgatgttagctgtgtgttagtcatatatggcctttattatttggaagtatattttttctctgcctagcttgttgaacatttttattatgaagtgatgttcagtttttcaaatacttattctgcatctgatgagatgatcatatgattcttgtgcttccttctgttgatgtgatatattatgtttgttgatttgcatatgtaaaaccattcttgcatcccttggtataaatcccattttgtaatggtatattatctttttgatgtgctgttgaattcagtttgctagtattttgttgaggattttttgaagatgtgttcgtcaggaatattcatgtatagttttcttattttgttgtgtccttaggttttggtatcagggaatactggtcatagagtgagttagggagaatttctttctcttcaatttttatggagttgtttgaggaggattggttttagttctttttatgtgtggtggaattcagcagtgaatccatctgatcctgcactttattttactgggagactttttattactatttcagacttcctacttaatattggtctgttcaggttttccgtatcttcctgactaaaccttggaaggttgtatgtttccaggaatttatccatttcctctactttttccagttttttatcacatagttgttcctaatagtctctgataatcttgtatttctgtggaattaatatggttaggctttatgtccccactcaaatctcatatttaattataatccatataatacccataatccccatctgtcaagggagagaccaggtggaggtaactgaatcatgggggtgttttcccccatactattcttgtgatagtaagtcctcatgagatctgatggttttataagaggctcttccccttcccttggcactgcttcctgccaccttgtgaagaaggtgtctttcttccagttcaccttctgccataattgtaagtttgttgaggcctccccagccatgctgaattgtgagtcaattaaacttctttcctttataaatcactcagtcccagacagttctttatagcagtatgaaaatggactaatacaggaaaatggtaccaggagtggggtgctgctataaagacacccaaaaatgtaaaagcagctttcaaactgagtaacaggcagaggttggaaaagttttgagggctcagaagaagacaggaagatgtgagaaagtttggaccttcctagggacttggtgaatggctttgaccaaaatgctgatagtgatatggacaatgaagtccaagcttaggtggtctcagatggagatgaagaacttattgggaactggaataaaggtgactcttgctatgctttagcaaagagactggaggcattttgcccctgccctagaaatctgtggaagtttaaacttaagagagatgatttagggtatctggtgaaagaaatttctaagcagcaaagtgttcaagttgtgacctgggtgctcttaaaagcattgagttttacgcattcacaaagagatagttcagaattggaacttaagtttataagggaaacagagcataaaagtttgaaaactttgcaacctgacaatgcagtagaaaagataaaacaattttctgaaaagaaattcaagccagctgcagaaattttcataatgaacaaggaaccaacgttaatcaccaagacaatgggaaaaatgtctccagggcatgttggacatcttcatggcaacccctcccatgacagacctggaggcctaggagaaaaaaatggtttttgtgggcaaggacgagggccttgctgctttatgaaatctctggacttggtgccctgcattccagccatgagtaaaaggggccaacgtagagctcagaccattgcttcagagtatgcaagccccaagccttggcagcttacatgtggtgttgagcctgtgggtacacagatgtcaagaactgaagtttaggaacctccacctcgatttcagaggatgtatgaaaatgcctggatgtccaggcagaagtttgctgtgggagaggagccctcatggagaacctatgatagggcaatagggaagggaaatgtcgggtgggcacccccacacagagtccccactggggtactacctagttgagctgtaagaagagggcccccatcctccagaccctaggatggtagatcccagtcttgggaagttatctatagcagtatgaaaacagactaatgcatgtatcaatggtcgtgtctcctctttcttttctgattttgtttatttaggtgttctctcttctttgctattttaggtggtagtttatcaattttctctttctgaagaaccaatatgtcattttgttgacccttatattgttctttaaacctattttgtttagttctactcttatctttattatttctctatttcggttaatttggggatgggtttgttcttgcttttctaattgcttgagttgcatttttagattgtttatgatgtttattgctataaaattccctcttagtactgcttttgctgtatcttacagattttggtatgttgtattttcattttcaattgttttaagaacttttttgattttcatcttaatttctatgttgacccaatgattatttaagaacatgaacatgtttaatttccatgtacttgtatagtttccaaagttgctcttgttattgatttataattttattccatgtgatctgagaatatactcaataagattttgattttttaagttgttgagacttgttttgtgacctgacatatctactatcctggataatgtttcatgcgctgataagaacaatgtattctgcagtcatgtgataaaatgttctgcaaatgtatgttaggtccattttatctaaagtctactttaatgtttctttgttaattttctgtgtaaatgatctgtctaatgccgagtgggatattgaagtaccccactattattgtattagaatctatctttctcttcagaactagtaatatttgtattatgaatctgggtgatccagtgctgggtgcatgtatatttagcattgttacattctcttgctgcattgattccctattatcattatataattttctgatttctcttttttactgtttttttttttttacttgaagtctgttttatccaatataaggatcgctactcttactcacttttggtttctgttattatggaatatcttttttcatccctttattttgtgtcttcatgtgtttttataggtaaagtatgtttcttataggcagcatatagttggatcatgtttttgtaacctttcagccagtctatatcttttaagtaaagaatttaatctgtttacattcaaggttaatattaatatatgaggttttgttcctgtcatattgttaattgtgttttggttgttctgtatgttctttgttcctttatttttcttttattgttttccattttggtttggtagctttctgtcatgatgctatttgagttctttctctttttcctttgtatgtgtgctttaccagtgagttttatacatttgtgtgttttcataatggcagatgtgtccttttccttccaggtttaggactcccttgagcatttcttatagagctggtctagtggtgttgaatttcttgtttttgcttctttgtaaaagactttattttttcttaatttattaaggataatttttctgtacatagtatcattggctggcagtttttcttttgaaacttttaatatatcattgcatttcctcctgcccggtatggtttctactgagaaaccaattttagtctagtggagattcccttgtaggtgactagacacttttgatgctttttgaattctttgtctttgactttagacagtttgactgtaatgtgccatggagaagatattttgtggattgtatctgtaaggatatctcagagcctcctgtatctggatgtctaattatcttgctagacttgggaagttttcatgcaatattatgttaaatagtttttctaaccctttcatcctttcttcatcttctgagaccctgattatttgaatatttggtccctttatggtgtcccatgtgtcatgaaggctttgctcattctcttttcttcttttttctttatttgtctgactggtttatttcaaaagacctttcttaaagttcggagattcttcttcatctaatctagtgttgaagctttcaaatgtattttctgatatattcaatgaatttgtcagtttcagaatttctgtttggttcttttgtatgatatctatctctttgataaatttgtcattcatatcctgaattgtttttctgatttctttgtattggttttcataattctcttctatatcactgagattctttagaattgataatatgaattcttttattgatttactcatgtttctttttgcttgggatctgttactagagaattattgtgtttctttgacattatcatattgagtttttttttttaatgtttccagtgtcactacattgatatctgtgtgatctggtataagtcacttcttctcatttttttaatttgcttttgtaggggattacttttttcctgaagatgtatctatggtgttggttgtgtagggcactttggctttgattcttgttgtgtgcaataatgtagtctttgtatgatttttcttttgactttaaacagcattatttgcatctgtgatttccttggtggtgtacagtgcagttataagtggaggatacgatgaagttctactggggagtgggatgccaagcagtccaatctttgggccccaggggtggcagcagtgagctgagcatgtctgttcttgagccccagtatactgtatggttacactaatgttagggggtctaggtgggccaattcttgggcctccagttgacttattcagtgtcagtagttgcagcagtgagccaggcaggtgggcaggttattaggcccctgggaacttggcatggcatggacaatggcagtgatagtggtaggacaaccctctaggtcctgagtggtatacactggcattggcagtggctgtgatgggctgggctagccagtctccaggcccacaggtggtacatgcaggtaggtgccagctgaggagtaagtggctggctaggtagacccaatctcaagcacatgggaggattttttcacctaccaatggtgatagactgggctgggccctggcccagagggtggaagaagggacaaagccaggccaggcaggcttgtcctcaggcttcctaatggtggatgccagcatcagctatggtaggcagaggtgtcatgattcccaggccaccagcagaatgctcaggtgtgactggtagtagccacactgctgtcctgccactgtggaaggttggactgctggcaaggcgggaatgtttacatcactcatgcctcatccctggcagcactcatgcctcaattcttgttgtgatagccactaccttacttatgcttcagtccccaatagctgtagttcatgccttgttcaggaactacatgcctgagccctggctgaagtagcccacaccttccttatggctcagacccagggattacagtccacaattctcttgcaccttagccctggcactgctgggttccagggcagtacacagactgttgggggcaggactctaaaacggtggcttgctgtagctgcttaggtgtcacagagtgtgtaagacccagtgcaacctcccttcttggagcagtgccatcacagaatttctgcatagatccttatgttagtttcaggacccacaagagttgaggggttctcccatgtctaggattgcaggagtccacagtgggaatgtggaccactaaagatgtctcatttatacttctcccatattgaggagtctctcatctcccagctgatcctggtcaagcaggatgccttgcttcctttttcttctttgctttaggtattttgtgtcacttttctgttgaatttattacattccagtattttctcttcagggaactatacgaagtgtgattatctactcactactttggttctttggtgtggaggagacaagtacaaaactcctctagtcagccatcattaggctgctcctgatttgatgtattttttatttattttataacaaaaatattttatattgctttacagcaagccaacaacaaacaaaattgaaaaattataaacatgacacttctaaattctcaaatggaattccaagaccagagtgtgctcctcctccactttaattgtattcctttctttctttttttcttttttttgagatggggtctcactctgtcgcccaggctggagtgcagtggtgggatctcagctcactgaaacctccacctcccgggttcaagtgattcttcatgcctcagcctcccgagtagctgggattagaggtgcacaccaccatgcccagctaattttttttgtatttttagtagagatagggtttcaccatgttggccaggctggtatcgaactcctgacctcaagtgatccacccgccatggcctcccaaagcctgaaatctgacttctggcaagtacttcaatattctcagtatctaaaattgtcacctcttctttcctgataaacgatttgggtttcctgtttgtatgagggactatttggcacaccttttttttttttttttttttttttttttttttttttttgagatggagtcttgctctgtcacccaggctggagtgcagtggcaccatctcggctcactgcaatctccgcctcctgggttcaagcaattcttatccctcagactcctgagtagctgggactacaggcatgcaccaccatgcccagctaaattttttgtatttttagtagagatgggatttcaccatgttggccaggctggtctcctgaccccaagtgatctgcctacctcagcctcccaaaatgctgggattacaggtgtgagccactgcacctggtcttatttggcatagtctttacagtttttatcaggccaagttaaaggctgactacattttctatcataaagaaagaagtagaaataaggcatgaggtgctgtgcattgttggacctagaatgattttcttgacaggtctttttgtgaggtttgtagaaagaaaaatgtgttaggtgcttaaaagtgcccatgatggtcacttgaaatgtgtagtaatagaatgcctgaattgagcataaaaggtttttaaatgtatagtcagaaataaggcagtaagtctgataatagtttttcacccctttaagtatttttattttttatttttttttttttacttttagtttttgtgagtacatagtagttatatatatttacggggtacatgagatattttgatacaggcatgtcacgcgaagtaagcatatcatggagagtgggatatccatcctctcaagcatttatccattgagttgcaaacaatccaattatactctttttgttatttttaaatattaagttattattgactttacttgtctttttggactatagtaggtcttattcattctttctatttatttgtacatattaaccatccctacttcccccaccaagctccctgctacccttctcagcctctagtaaccatcctttactttctattgtatgtccatgagttcaattgatttggtttttaggtcctacaactaagtgagaacatgagatgtttgtctttctgtctcttgcttatttcacttaacataatgatctccagttccacccatattgttgcaaatgactagatctcattctttttgtggctgaatagttctccattgtgtatgtgtaccatattttctgtatccattcatctgttgatcgacacttaggttgcttcaaaatcttagctattgtaaatagtgctgcaataagcatgagagtgcagatatcgcttcagtatactgatttgctttctttcggtagccataagtaggatcgctgaatcatatagtggctcaatttttagttttctgaggaatgtccaaactgttctccatagtggttgtactaatttacattccaccaacagtgtacaagggttacctttttcccatatcccagccagtatttgtcattacctttcttttggacataggccattttaactggggtgagatgatatttcattgtagctttgatatgcagttctctgatgattaatgatgttgagcacctttcatatgtctgtttgctgtctgtctgtcttcctttaagaaatgtccattcagatattttgcccatctttttatcatattattgttttttttcttagagttgtttgagttccttacatattcttgttactaatcacttgtcaaatgggtagtttacaaacattttctcccattctctggactgtctcttcactttgttgattgtttcctttactatcagaagccttttaacttgttgtgatcccatttgtccattaactgctttgattgtatttgcctgtggggtattgttcaagaaatttttgcccaaaccaatgtcatagaaatcttccccaatgttttcttagagtagtttcatggtttcaggtcttagatttaagtctttaatgccttttgatttgatttttgtatatggcaatagttaggggtctagtttcattcttctgcctatggatatccagtttccccagcaccatttattgaagagactgtcttttcaccagtgtatgttttggcacctttgtcaaaaatgagttgattctagatgtatagatttgtttctgggctgtctattctgttacctttgtctatgtgtctgtttttatgccagtatcatactgttttggttactatagctctgtagcataatttgaagtcagggaatgtgattcttccagttttgttctttttttcttaggatagcttgatgtattttttaaacaacagcaagtattaacaaggaaaatggagggagaccaaatctgatcaagtcattttcatggttaaaatttttcaaagtctctctcctcattgccactaatataaggtctaaactttttaacatggcacttctggagcctcatgagcctctatttctacatgtggacttgcacttgactgtcattatctcctggaagttcagaagttttgcatgatacaacctgcctttcttcattttttccaatgtactaacatatgctgtttatttataattctttccacattggtctgtgaaatccttgacaataggaactgcattctgttcatatttttgtttcccagttccagtattatgagttgaattgcgtccctgaaaaagatgttgatgtcttaacccccattcctatgtatatgaccttatttggaactaaggtctttgctaacggtcaagttaagatgaggtcgtactggtagactctattccaatatggcaagtgtctttacaaaaaaaaaaaaaaaatggacacagaaacagacatgcacatagggagaattcatgtgaagatgaagactgagatcgggatgatgcatctatgagataaggagtgccaagtactgccagcaaatcaccagaatccagaagaggggcatggaatagatttactcttatagctttcaggaggactcaaccctgctaatgccttgatcttggtcttctagcctgcagaactttgagatagtaaatttctgttagttacgatgcttactttttagtactttgttattgcagccctaggaaactaagatagcctggaattgagtgttgttttaatgaatgatgaagtagctcactgcattattttaccccgatccctttcttgcatggtttgttaaagtatgcttatggaaaaaagatccagtgatttttatttagttcagtaattcattttaaaaactagttttgaagctgggtacagtggtgctcacctatagtcccagctacttgggaggctgaggttgggggaatcccttcacctcagaagtttaagtccagcctggacaacatagcatagacccctgtcttttaaaataaaaataaaaaattagttttcaagtatctactttgtccataaaacccctgggcatacaaaataaaagggttattttcccctccaccttcaaagtggtaactatccaacgtgggggaatgagatattcctacaacatatttgtgcatatcacagcagttatttatggcagctacgtattgtgattagttggtgttcatttcataccagctgttaaatgttctaaatatcaacccttcctataaataactatattctaattctatgtagaaaatgatgtatcactaaaaatgagataaagacagataaaccgttagatgtggtcagtggagagagagagtacttttaagttaaaggagtggcgactaggaggaagaacttttcagaggagatgttactgaatacaggcgtttgtgaatggaaatttttcaagatccaccgagttacccttcagatatttcagcttgctttctccagcaacaaccctgccagtgggacatcctcatcaaacttcaacatgtgagatgatttttacatcttttaaataatctatgtaacttttgtggctttgtgtgctggaatctgtatacttccaagacagtgtagacagtattcagaggtcagtgtttaatgaccttggtttgcatggcagcaaaaattaacttggaaaaactgcatagacagatgtgcttgatagctagaggcagtgcctataatttggttatattttaatgatggaagcttggaggatattccatttcaagtgtaatgaagtagtccataaacaagtaggacagcatctaatcacattctatcatacagccccataagcagtcaacttgtggtttgactatttgatctttaaggatgaaaacaatttggtcaatgatagttctttgagtaaagaaatgtaattgtgtctgtcattggtcatttttaatgttcgtttagggaagagactgacatactcttcattaattcttcaccagccaatatagtagttggcacattaaaaatgctcaacatatactttttcccccttgagctaaagcaatcaactaaagcatacatatctttcttaatgtaggatgcttgacatttgaaagtatacctatgagatgtgaccatttggtctttgaacaatttagtcattaattatttctgcaaatatttattgaacaattactatatgtcagcactgtgctaacatagtctattttgtgcaacccctactttctaggatcatataattttgttaaaaaggaaagattagtgcacataagagattaatatgtaaggcaattcaatctaactgcctatattttccatgcttatatctagacttctgagaattactggaggaaaaaaacctagaacagtgctattattaatctacagtctccaaaccctcactagacaatcaacacagctctttgccattttatgcaattctctaagcaattatatcttccattttccctaatagctattccaacacatctgtgatttcttcattctctgacctcactacttccctcattcttggttgatgatcatcctttcttgttaccagagtaaatggaagatgagaacttctttagtgtcctgttattatcctacaatcttagcattcatctccactgtcctttcctccttttctaattcagtggagggagtgacctcttatcttcatttattcacttattggatacttggatatttcttgatatccaagtaccaagggctgaatgtacattaatggttctacagacatggttctacagtcatggttcttttccttgtggagactgcactccgcctaaaactacttattactttcacctaaacatttctgagtttctcaactaagccatgttatctctcaatgctgggtctttgagtatatatttccctctgcagggatgatgtctccccactcccttattttcttggttcattgttatcttccaggtctcagattgcatataatgacctgaagttatccttctctgacactaccccctctagcccaaggtaggccgcccacctatatgctcccatagccactattcctctcatagcagcacttaccacactgcattttcatgatttttatacttgtcctattctgtagtagaaaataagctgcatgaggacaagaacactagatctctaatttattgatgtaacaacaatatttaggctgctacttgacacataagtagtcatcagtaagtgtttaatgagttaaatagaggaagaaaggctggcacaggttagttctactggagtacaacttagaaatgcaagagtttgttccacgcttcttccctagcttttagtggttgcttacaatctttgatgttccttggcttacagatttatcattctaatcgctgtgtcacttaccacataaattgctccctgtgtattttttatttctgtgtccaaatttcctcttcttataagggcaccaatcaatggaccctaatcctaccctgatccaatataacctcatcttcttaagtcacatctgcaaagaacttctttccaaataaggttaattacattcacaggtaccaggagttagaacttcagcacatctttctgggggacatagttcaacctataacagatgccatgtgagtagattgtggtgtatggggccagatggatgggattaaggatggtttgtaatatagaaatagaggtggaactacagatcagtgtctaaaaacttcagttattatggtaaggaggctgtggcaggttgaagagatcttttcaggacaggacagaggaatggccaaatccataaaagaagaaaagcattgaggctaaggaactgaatactctagagagagagagagaaaaaaagaaaaaagaaaaaagtaaagccctaacgtgcaggggaagatttcattttacaaaagagaaataatgtttcttcctttgaacaaagggaaagcagaaaggataggtatagaaatgtgaatttttcagaataaaataggtattaaagcaatgtgctaaaggtatgagtgggtattacaagatatgtaatagaagaaaaagttttgggctgtggctatagtaagttaattgggtgacctgtgagcagttcttcaagcaggattgaagatgctttgtcagtgccttagaaattttaagcagaatcacttctttcaacctcagattttgtctttggaatccagagaatatccaaagagtaagaagataatgctttggcttttaattaaccatattggcagtcgccagtgtgattaactactctctcaaattaaaataaaacatacttttttttggtatttgttaaagcaaaattttctttctaaaaaggaagagatgacaagtagtctctcatcagtgtagaccagttcctacagggaagggtttttttgttgttttttagctgaaacttatgcacattcataagttaagttgcctgtgagggtgggtgttttctcagacagggccagccagggttcaagatagattctgtgtttcctttaataaaaccatgtagacagaatgtgcagaaaactactagtgctttctgtaaagcagtaaacaccttacctagcagatcctaaataaactctgacaggaccagtatgcttaataattttgaattgtttagagatggcccagagctctctcctaagaaagtcacatgaaataaagttgaaccaattcactgaatgattataagacatcatggggcttagttctctacacccgcaaagaatattcgggtacattgtaatcataacttttcaaagcatttgagtatttattctgagcttcagcacagtatcaatctctgctgccaagcttctgcttcaggccccacctctcactgacacctcctcctcagcgtaggcgggcagcaagggaaaagagtgaaccacgatccgttcatggtgttctctttttacaggatgggaaaaagattttgtgtggaaaaactttcagttaaaggctttaatcaggttcagacttccctgtgcttatgcctgcatttcttatgttgacatgagaaatcactgcttggagatatgcaagaaaattggaaagatgaacccagctttctataattgatgtaatcctgaaattctgtatgtgcgtcaagtgattgccaaacaggtcatttttaattacttgagcaattaggtgcttaaatttggcatgcctttttcttttactagagtactgaaatattcactgattttacttccttttgtgaaatgattacttacatttttctgtgtcagctttgtttatgacccacatgcagtaatgtttagtcttattcttaatagcccaacattccacagtaggtggtgttataatcagcgttttggggtgagaactaccaactctgttcactgactttattttataatggactagtttgtcatcatgtgatggtccagagctatttctttttcatggacacttcttttcaaaatggtaaccaattttctttagttgttacaaaactatcacttccccgaaatcagtattttggccattttaagtgttccttacacaaatcttcatccaatttgagtcaggaactcattgtattcatttcagtagggactaccctgtcttactgtatcataaatacatgttttgattgccaggcatttttgcttcaatttttggatcagtaaagtgggactttattagccctgtgtgacataactcaggacggttgactctttagtcatttatccagcctggaatctgaagacatgttggttttaaatgtgcattttcttttatcagttctaacttcacctatcaagacccagtccaaatgctaaacttctgttaattattctccttctcctctaagaagtaagtcatgcttccctcacataatgctggtagcaatatagaactcatccaaaccagacagattatgccaaagtgttggtgtcatgttttcccaacaacctgacagtttattgagagcactttatttatcaagtatctattattgctagataatagatatacttactcctttattacaaagaaatggaaactcaaatttgcatagttataagacgaaagaatcagaaagtgaagctgcctctgctgttgtcccattgcctgctcagtgcttaccataaaccctgtacaggttgaggatggagagctcatcaaagtttacctgaggcaatgtgatgccttatacagttactgactgcagctaccatggctcactgtttctgccccttgctcattcaaagccactaatttcatctttaaggggggactttctcagagacatgggactttccttgtcctcttatattcatttgttcattcattctttcacttaatacatatttatgaggcaagtatgtaactggttttgttctacttgcatagtacaaaatagaccaaaaaaccattcattacagagcttatgttttcaccaaggagacagaacataaaaaacatataaacaaaatatgtagatgacttatatagtgtattacaaggtaataagtgctaagagaaaatgaaaactagagcaggataaggaaaaaaatatatatagtcaggggacagcattaaatagggagcttaggttccagctcctacagaaattgagactggaacaaagccctgaaagaagcatattccatgtagcagaacagctgtagcaaagaccctaaattgacagtctatgactatgtcggagtactctagaaatatcaaggctgtaagagtacagctaacaagagaagtgaaggacctcttcaagaactacaaaccattgctcaaggaaatcagagatcacacaaacaaatggaaaaacattccatgctcatggataggaagaatcagtatcatgaaaatggccatactgcccaaagtaatttatacattcaatgctattcccatcaaactaccattgacattcttcacaaaactagaagaagctattttaaaattcttatggaaccaaaaaagagcctgctaagcaaaaagaacaaagctgaaggcatccatagctagccacatgcagaaaattgaagctggatcccttccttataccttgtacaaaaattaactcaagatgaattaaagacaagtataaaagccaaaactataataaacctagaagaaaatctaagaaataccattcaggacataagcacaggcaagaattcttaacgaaaatgccaaaagtaattgcaacgaaagcaaacattgacaaacaggatttaattaaactaaagaacttctgcacagcaaaataaactatcatcagagttccagacaacctacagaatgggagaaaaattgtataatctattcatctgacaaaggtctgatgtccagagtctacaaggaacttaaacaaatttacaagaaaaaaacaaacaaccccattaaaaagtgcacaaagaacataaacacacttctcaaaagaagacacccatgctgccaacaaatgtatgaaaaaaggctcaacatcagtaatcattagagaaatgcaaatctgcaaatcaagaccaaaatgagatatcacctcacaccagagagatggctattattaaaaagtcaaaaaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaattgggaatcatttccccattgcttgtttttctcaggtttgtcaaagatcagatagttgtagatatgcggtattatttctgagggctctgttctgttccattgatctatatctctgttttggtaccagtaccatgctgttttggttactgtagccttgtagtatagcttgaagtcaggtagcaagatgcctccagctttgttcttttggcttaggattgccttggcgatgcgggctcttttttggtcccacatgaactttaaagtagttttttccaattctgtgaagaaagtcattggtagcttgatggggatggcattgaatctataaattaccttgggcggtatggccattttcacaatattgattcttcctacccatgagcatggaatgttcttccatttgtttgtatcctctttcatttcattgagcagtggtttgtagttctccttgaagaggtccttcgtgtcccttgtaagttgcacttcatgtctaaaacaccaaaaacaatggcaacaaaagccaaaattgacaaatgggatcaaattaaactaaagagcttctgcacagcaaaagaaactaccatcagagtgaacaggcaacctacaaaatgggagaaaattttcgcaacctacttatctgacaaagggctaatatccagaatctacaatgaactcaaacaaatttacaagaaaaagacaaacaaccccatcaaaaagtgggcaaaggacatgaacagacacttctcaaaagaagacatttatgcagcccaaaaacacatgaaaaaatgctcaccatcactggccatcagagaaatgcaaacaaaaaccacaatgagataccatctcacaccagttagaatggcgatcattaaaaagtcaggaaacaacaggtgctggagaggatgtggagaaataggaacacttttacactgtcggtgggagtgtaaactagttcaaccattgtggaagtcagtgtggcgattcctcagggatctagaactagaaataccatttgacccagccatcccattactgggtatatacccaaaggactataaatcttgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcttgtcctttgtagggacatggatgaaattggaaatcatcactctcagtaaactattgcaagaacaaaaaaccaaatgccgcatattctcactcataggtgggaattgaacaatgagaacacatggacacaggaaggggaacatcacactctggggactgttgtggggtgtggggaggggggagggatagctttaggagatatacctaatgctaaatgacgagttaatgggtgcagcacaccaacatggcacatgtatacatatgtaactaacctgcacattgtgcacatgtaccctaaaacttaaagtataataataataaaataaaataaaaaaatctattggtttaaaaaaaaagtcaaaaaaacaacagacactggtgaggttgtggagaaaaaggaatgcttttacactgttgatgggaatataaatttgttcaatcattgtggaagagagtgtggcaattcctcaaagacctagaggaaaaaaattcaacctagcaatcccatcactgggtatatatccaaaggaatatatatcattctattataaagataaatacacatgtattttcattgcaacactattcccaatagcaaagacatggaatcaacctaaatgccaatcaatgatagactggatgtagaaaatgtggttcatatacaccatggaatactatgtagccataaaaaggaatgagatcatgtcctctacagggacatggatggagctggaagccatcattctcagcaaagtaacacaggaacagaaaaccaaacaccacatgttgtcacttgtaagtgggagctgaatgatgagaacacatggacacatggaggaaaacaacacacactagggcttgtcaaggggagggaagcagggaagaagagcatcaggaagaatagctaatggattctgggcttaatatcacattgatgggttgatctttgcagcaagctaccagggcacacatttaccaatgtgacaaacctggacatattgcatatgtaccccagaacttaaaagttaaaggcaaaaaaataaaaataaaaaaagaaacgtcaaggatgcaagtgtgttttgagtggaatgaaggagggaaaaattagctaatgaagggaagacatgtgagattaataacagggatgggggacaggggcattagtcatggcatgccttagccagtctaggtcttataaggtagagagcctgcccctgctttaacagagtctatgcaagaaaaacccaggtaatttgtgtttggtcttattgctcagtggtcctagcccacatttgtcttcatagaatagctatccaaaaattgcttgcattatctgggtttagaacattgcttcagacatgtttcaactacactcactcatatgaactcacttttgggtcattattattacagtgtttctggtcaatggataaaaaatacagttagataaaagaaatagatctttctagtgttcagtagtgcaatagggtggctatagttaataatgtattgtgtatttcgaaataactaagagtagaattaaaatgttcctaacactaagaaatgataaatgtttaaggtaatggatatcccaattatcctgatttgatcattacacattgtatacttgtatcaaattatcatgtgcaccctatttacatttattatgtatccataacaactaaaaattaaaaatggaaaaaaaattctttacatttactttggccgtgctcgatagcagcaggtaatacaacgcacagtatgtactcaggagatgcttattgaaagaatggatgtgtgaatgaataaatgaatgaggatagatgcaatcttatagcacagatagatatttccacctgtaaataaacataaattctcaatgtagacataaactacagatttattcatcatctgaattgaatatttagaatatgattaagtgttaaataaattttaattgtttttaaacacatgcatgttatgtcaaagtaaaggaaattggaaaaattactagttgtgtacattcagaaacatgctctggctctgagaggaacatttactaaaaataccttgcttcaccttgaatagagtcactagttaaaaagaagcacataaacccaatctcaagaaaaaatgttactcgatttttatctatctatctatctatctatctatctatctatctatctatcatctatctatctacagtatccatagtgctttcattgtctttgtgcagtcttcaacttcaaatgtcaactacatacttgctctgtttgttgaacttacccgtttttatggtggtaatttatttctacagctcttcttgtagctaagaccgtggcatttactgctggcatagtggatgtaaattggagtctctgaatttgttttagccttctcttttcagagtttggaataacctctgtacttttataaatatggtagattgaccttagcacgtggctaagaaacttttgtaaatacattttttaaaacttccctattttcatgtataataaagtaacagttttgggaaacatgagctgatatgtattttaaattttataggaaaagccagtttggggtattttactctttggtcatcatttgcttaataaacaaattgtaaatctgaggcaaacaaatatattcattgttccatggggtggcaaagcatcagtaaaaataattactcacatcacaaggaaattagataacacttgctttaattgccctatcaatttaaatcaattttccatttatttttaacaactattatggttaatttaacgatcattgcatttcaaatataattccagagatgttgctttataatttactatgccatcatttttcaattaactatttatgctatcttaagagtgcataaccttacccaatatttattcaataaaagtatagtgaagtagagttaatatttttaagtattttttattattgttgtataaaatgccaaatattttaatgatagctttattattttactaggtgtgtggtttttctaaaaaagtcttaagccaagtaagctatagaaattatgtctgtagtcaaaaggcccttgattaatatctgtcttcttgagtaatttgcatgttaattatcttatgattgtaaaatgcaatgaaaatgtatgctgcaagtattgtactgaatgagcattcaaacatattctgaaagagatttttaaaaattcttatacgtttaaagagtctattaattattcctttaaaatgatctcataataactttttaaaatacattcatgtgtcatttaacaatgggcatgcattctgagaaatacatcattagacaatgtcatcattgttatgggaacataatagagcgtacttagcaaactgaaatagaatagactactacaagcctaggctatgtagtatagcctgttgttccttggatacaaacctgtataccatgttactatactgcgtactgtaggcaattgcaaaacaacgataactatttgtgtaacttaacatatctaaacatagaaaaagtacagtaaaaaataaaagataaacaacggtacatctgtacagggcatttagcatgagtggaacctataggactgaaaattgctctgggtaaatcagtgaatgagtaatgagtaaatgtgaagtcctagtacattattgtacactactgtagacttaaagaacactgtacacttaggctagattaagtttatttttaaaaagtttcaataattaaccttagctcactgtaacttttttactttatgaactttttgactcttttgtaataacacttagcttaaaacaaacatattgtacagctatacaaagtattttcttttttctattcttattctataagcttttctttttttttttttttttttacacgttaaactttttgttaaaaatgaagacacaaacacacacattagcctaggcctacccagggtcaggatcatcagtatcattgtcttctaccttcacatcttgtccaactggaagatgttcaggagcaataacatgtaaaatgttacagcatggatctgtcatctcctgtaataataatgccttcttgtaggatacctcctgaaagagttgcttgaggcttttctacaattaacattttttttaataaggagaggggtacactcaaatataacaataaaaagcatagtgtagtaaatacataaaccaggaacatagttatttattatcattatcaagtattatttattgtttacaattgtatatgctatacttttatatatgtgactagaaatgcagtaggttcatttacactgcatcaccacaaacaccttagtaatcattatgctatgatgttacaatgactatgatgtcacttggcaatagccatttctcagctccattataatcttttgggcccatcatcgtatgtgtactctatcactgatcaaaacattgttatgcagtgcatgactgtcctctattcttgttattgcttcatagtttaatataagttaagattgtataagccatagtacagtgaaaatcatctcttaaaagagacaatcgccatgtttaaaatgatttgatattctgccatgttataaaaataatatagcctaagtatacattttaaagtttttggcaggacgtggtggctcatgcctgtaatcccagcactttgggaggccaagttaggtggatcacctgaggtcaggagttcaagaccagcctggccaacattttcagtgtctactaaaaatttaaaaaagtagtcagacatggtggcgtgtgcctgttatcccagctactcaggaggctgaggcaggagaaccgcttgaagccgggaggcagaggttgcagcgagctgaaatcataccactgcactccagcctgggcgacagagcgagactatctcaaaaattaaattaattaattaattaattaattttttaacattctttttattctttattttccaatagaatatttttaaggaatatttttaattttttagactgtatactggaataattcacttttttgtgtgactagtctcacaattagttaatcagttaataacaataaatgctaggaaatataaaatatgacaaggtggcaagagaacaaaacatgaaaggcaagcatctagcttcttttccttatcttctctctgaaattattacatgtatataaacagtgtaacttattcatggctcttgcctcagaatttgtgcaatttttgaacaattctatttctcatcttgaaatatcaagagtatccaggtctctgcccaagtgattggcagtacttctgttctctatgctagagtaacaacagcaatgaaaatgagcccatagagtcaacaatgagcaggactatacttgtctttttcctggctcacctaggattcctccacacccttcacctgatccctgctctggccagttacccttataaacaggatagctgaggaacagcagttaggcatacagtctggaaatagaacaaaactactcacatggggttgacttcaaaatctttgcctcatttgcattaacaattcttcaaatatttaaataacgagattgaaatacagtttttagtgttatttattgctgttacaataagttgaggattcatttttaaaaactgttaaaatgtggctaactgcattttctaaaaacaactacaacaacaaaacaaggctttccattttctgttcctttcttataggtttaggcttcagtattgcaggaggtgtggggaaccaacacattcctggagacaacagcatttatgtaactaaaattatagatggaggagctgcacaaaaagatggaaggttgcaagtaggagatagactactaatggtgagtgtgactccagcaaaactgtgtgtatatttataaagctcttgttttccagtgtatgactgtctttgtcagttcaggctgccatcacaaaataccacagggtgggtggcttaaaatggcagaaatctattttctcacaattctggagactacaaagtccaaggttccaaccgattaggtttctggtgagggctctcttcctgacttgcaggtggccaccttctcactgtgtcctcacatggcctttcctgggtgtttatgcagagagagatctgtctctctctttctcttcttacaaagccacctcttacaaggcccagtcctattggattacagcaccatctttaactcatttaaccttaattatctcctatagagcctatcctcaaatacagtcacagggaggttagggcttcaacatatgattttgtgaggggtccacaatttagaacttggacaaaaattgaaaagaagagacagcagatttatgagtaagagatttcaaaagtacatgtacaatgtatctattttgttgacattttcaaaacaaatctaaattttcattaattttcttagatacacatggcatagagattatctgttgttcttccaacataatgtgtctcctattagggagagcaattactatttatagactgctggagaggtggggtttgcataacaatagaaacaacaccctggcttactgataagcgtatttccacagtcctttgtgcaaccagtatagacacagctcctgacttccaagaatttataatctgagttctgctacatgtgtaaatggatctcttcctttcctccccttagacagggttatagctatttcatttgccagcttctcacatgcttcagtagtcctaggcagtgattgacattgacacacagccagtctttctgaaccatggagttatatgataacctaaagcaaaattaaggcgattataagcaacaaagcatttgggactgtgttaataaaactgccttatgtccatttactgttgtatgccaaaatctacaggataataatcgaatattgtaaattaatagtaggtagctctcaagtaagattagtgtatctgtctagtcacatgtctacccttgtaaaacaggacttctaatctgtctgcaaggagccattatctccaacaattttgtgagaagtgtctggggaggatcaacccccaatctcaacagaaaattaatttttatgacctgtgcaagttttggaggttgaacctccaaattttatatttatttgcctacttccctcagctttagagagctgtgtttaatcgcagtggtctaatttcatagttgccaatgacctttgtgttcagtaagctttgtgttagataagatctttgtaataatcttgatagctaacattgacctggcatttactaagttccatgttcttttataaagggcttttttgtaatgtaacatatttctaacagcagtacattttatataagcaaaaaagaattgagatgtagacaggttttctgacttgcccatagtcatatgtttaataatggacaaaactgggtttcaaattgaggcaatctggctagcaccactcattactaccaagctatactgcctcttgtgcaacatggtttcattagtttccttgaatttgtcagtcagttctttcctttcctcctttattcattattgtcattcattaattacttttttaataagtacatgctgcccacctactgtgtctcaggcagtagctgctattcaggaaggaactttgtcttgagaaaactggatgggcaaaaaatataccattaatgacttcagtcaaagttaaagttaacagttgtgggctgctttaccacctgaagccactaccactttcattctcaagcaattctgaatttttgtttgtttgtttgtttgcttgtttgtttttgatgtaaaagtttgttcttatgatgttgttctatcttctggacaacaaaggttgtcattaaggtataagacctgaacaacttctttctggaatataaactttattgcttgaaatgttgtcttgggaatagaataaattgtgataaccatattctacatagtgctaagttgaaaaatgaagaccgtttcgttctcaagtaatgactgtcttagatagttactggtttgacctttgactcacggttccatatgagtttggttgcaggcagctcttctggtatttcttcatccactgctattgtaccatcatggtaaatgctatgtgcttatttcttgaagttttgtttaaattttttgttttgtttccaaatttaaaaaaaaaaaaaacttgctccaaataattctgtcaaaggattttccaggcactacactattttttattaccattttgttgatattcatcgtagatataatgatcagtctagttaggacaaaatagagattgaataaattaacttttccaagtttacagagtaaaaatgagcagatctctgcctggttttgtgaaaaagccttagcactggtaaatagaatatttctattcctacaccattctttcagtatatcatcactgaaaacagaaagataggcacacagattcttccccgtagtaactcatagtgcactaggtgaaagagatgaagtatgtattaaaagtagaatgtgatggcatttattattcagataatcccaggattctagaagaaaacaaagaagagtgacagtcgagttagggtgtgaacttccagaggagcattgcttaagctgaacttgagagcattgtgcaaaagcacagtagtctgttaagaactagaaataacctagcttgtgccacttcgggagtattaagacataagcctagaaaggcggacaaaggttagatcttagactgtcttgtatttttctcattcctgttgattacctacctcaaaattgaatatgtttttcctcctgcctaaaacaaaactacttaagggcaaaaatttaaattcttccttggtgtatgtgcaaacaaggttgaatatattcatgcctaccttattttggactaggaatacagtagtgtactttccgaaggcttgcctgaatagtatataaggtggaggcaactgactagttaggtcagtattttttagaaactcttaatagctcatactcttgatgccaaaagcagccctgattgttaaagcacacacctgcacaagaagcagtgatggttgcgtttacatttcttgggtgcacaaaaaaaattctcaaaaagcaaggacttatgctttttgcaaagcctttgagaagttactggatcataggaagcttataacaagaatggaagattcttaaataacccactttctttggtatccagtaacagtagatgttcaaaatatgtagctaattaatactagcattgtgaacgctgcacaaccttttggttattactaagcaagttactactagcttctgaaaagtagcttcataattaatgttatttatacactgccttccatgacttttactttgccttaagctaatctccaaaatctgaaatgctactccaatatcagaaaaaaagggggaggtggaaatatatttcctgtgattttaagagtacagagaatcattcacatctctggttagttcatatatgtctagtgtgtaatagaagtcaagatgaactctcaaaaaaaaatgatttcgaaaatagctgtgacataatccttaattgttttgagttttaaagcatagttttttttaaagaaacttcaacagtaataggtctctcctctcttatgtaaggaagacagaattagtacttccaagttgaaactggaaatgaaagaaaatgattcattttatactttgcaagcaaaataaccctgaaaaggagaataaagacaaaatcactgaagccaccctaaaagaccaattatcttgcttcaacccaaaaatatttattaatgctctccttctgtcattcctttctacctcctcttctctttactaccctacattcatattctttgtatcttccccctcttctactctcctcccacaaaggaaggacaaatgatttagattctatgatgtaccagctgtaccacactctgcatatttttctctaaatatgctattctttctaaagcaatttgcaccacttccttctgacacttcttaggaaaaattccaccatatattattcactcagagttctgtaagtaaactggtctaaaataaaactccattaatttctttaggctttcatggctgaatactcacaattcaggaagtctcctagcaactgccctctactgagagcacagtcattttttaaagagttagtaataacaataactcttttagtttctcaagtaaaatagctataatgttgggcaccacctgaatcataccatccatattgggtactttttctccctgaaattcttcttatatctcagaatttaacgtatgtatcttaaaggtcatcttttatcaactcttgcttggtgcatcagaaaagcaagcatgtgaagcagtctctgacctctcatagaacctcctttaaggatggataatacctcccgaaaactatttattaggtaataagtatcattaaaatgttttccttaaaattctgttaaaatatattttcctgtaaatgtccccctttattcatagctctgtcacttgaaaacaaaaaggtgaagactaattcctcttccacatatgtttgaaagagctatgtctttccacttctccacttctcagttttttaggatgttttagaccttttctctctcttccagtaaattttatcacatattcatttatcttctgtaaatagattatacttattacaaaacttctttatattccttacagttttatttcctactttaaaaattccatgtaatagtatagtatgtgacctttgtaaatattctacttaaagaaacaattactctgtctgttacctttgcaataaacctcttggtattttaaataagatgaccataatatcagaccactctgatgtttaatgggtcacccaaatacatggtatatgttctttttagcaaaataatatttttaaaaatttcctttgtcacttagaatttattgttcactagaattttgttttgttttttaaatggtaaagtgacagtgacattggattttgtggattgtaccagtggtttagtgttgtagtctcagatgaaatagattctcttggccttgaatttcagtggtagtcagagtttaacagcataacagatttttaaattctttcatatattttcacatattggctttattaagcacttccaaggtgatacatatagcccaatatattagaaaagtgttaacttcttcccctttttctatataaaccagaaatgttgaatccaggataatttgattgtcttctctgcagggacagcattagttattagttgacaaagccccttggcacattgtaatttaaggtttaaaatcttagcctcttctttccataacccctgctcgacatttgaagaaaaaattgtcagtgagagaacttttataccttttacagagaattagttcttgtgttttctttccttaaagggaagtagtaagtgacaggaaaagtaacagagacattgaagtcgagcggaaagacactggactcagatgagaaagctggatttcagtcacaggcacctagcactgattctacctaatctgtcttgggcaagtcacatccatctttggtcttctattttggcctctgtaccatagtagcattatattagattggtatttccaaaagtatgctttaaaatattgttctcttttctgtgtcacgtgaatagactctgtgaccaaatacgtttgctaaattctgcaacttgtatcccaattctcttgaagattctcaatgaattttagcatattaaaaattctgtgaagtcctgccatcaagtaagtgatttgattttgattaacaaatctgttttatcatggagccttcttcttagagtaatacttaacaaaacacctaaaactagtgtttagtggaatatactcaggatgtgctatgtgtgagcatatcttatttttatttgaaaataaatatcctagagtaaagccatgaaatactttaggaaatgtgagtagaaacaatgcaagtttctgaatgagtattagttgtgatgactgaaattgttattatttttggtaaatctacaaaattgcctgatttcatccaagtatcaataagaaaatcaaattgaagacattgcgaatatgtagaaattatctgaataatgaatgggatgttaaagcatattcattggttataccaaccttagatatcttagaatcaagacctgtaactctctgagcatgtctctttcctaccaacaacacattgctttcatcttgaaaagatcttttgcctacaacacctcatttattcttaacccccatctttgagaggtagttaggacagtcattactgttattcttatttttcagaaggaaagttagaactcagttagaacttagacaaagggatttccaatattacataactagtaaattgtgaaattggattcagacatagattttgatgtcctgaagttaaattcctttcactggttttgtcaacatctctgattcttgattttggttacacatttgaatctcaagataagctcttgaacactatgaatacccagtcctcagtcaaccctgaataatcaaatctggatttctggggtagggatcatgcttcattttattttatttttttaggttttccaaatgattttaatgtgcagccgggttaagaaccaccatcctaccttgatctaaccacatcctagcccattctgctgctaccactgcatctcctaaggacaactttggtggtagtgctcattctatcaagccagtagagtataatttagcaattacctgcaattggctaaaaaaaatttagaacagttcactctcaaaattctgtcccctgagtttaaagtcacttctgaaacaacaggataaaacctggacaactgtttcttgaactctcttctaatttatctcaaatgtaataagttataatacaatgtaattgctatgacatattttatttaagggttagaacctcctattgcactcttttttattttgcttatactcagtgtaatagccctctttatagaatctgctctgtaagtatcatgttgctgtcattttaaaattatcttaatagcacactccaaaggttgccactaatatatttctctactctaaattacatatatattactatgctaatatattgtttacattttaaaacatatgaaaatggaaatagaaatataaatatccatgtgattaatattaatagaaatgcaaatgtttttctcttgtacccagtggattgccctagggttcatatcatactgtccattttggtgacctctgctagagaagaaatttgagtaaatcaaaacaatcactcttgcttgctctctttctttatatggagtaaaaggttaagaaatgaattaatgattaatgaaggaagaatagaatcacaatgatggagctttgactgtgtaccttataaactaatatgatctggtgctaagattctgtaccagcttttcatccttatatcctgtgcctggcacagagtgggtatccaataaatgtgtattgttgcttgaatgaccttcattcttattgctttactctctgactcaacacaaatgtaaaatagaatgcaacacaaatgcttcattctttctataaaatagggaattttgattgcttttcctttggtgttctgcgatcatttttttaaaacttagcttaatacctcaacacttattaagtgccaactatttatattgcatcagctaggggaatagagatgaatatgatctaatcagttgcccttgagaagatcattcttggaggtgggaagaggcactgtaggaataagtgtttcacaatatagggattgataatttctacataaagagccctgaacagcagcaggatcaacaaagcatgatgtctgattatggctgtttgatttctattcgtatgctactttatatcatacagagtcttttcaacttcatggtattattcttttctcataaacacaaatctacaaataagtataattcccattttacatgtaagaaaatgaattcttagtaaatatgttaactgacttaaattcgtgaaactaggaattaaaaccagatctgatctgattctatgttcaaaattattctccctgtatcaagttgccttcgtttctagaaacagcaaggtttaacatatgaatattatttctagtaaatttaagtctattcattggccttgagaaattaactttcttttttcccattccgattttcattactcatgagatgctgctgtgtgtgtctcataatgacaccactgtacttagcttctgttctttcttaaagtttttgttcttgctcatttagagttaattttgctctatgacatacatattcatttctgaaaagatgaaaaacaagaaaatatttattatccaaagataaccattactaacatgccttttatttattaatagttattattttgaatacattttattataatagttaatttcagagtactatggagattttaatccttggtttatgcatatttattttcatagcattggcattactacattggattggtctgctttttaatttatcttacaacctaatgatcagccactttgtttcctgtttaaaagttaactttagagttttcttaccaatgattctagagttccacatttccttgtactatgccttaggtaaccttaatgtctgtaatcacctcccagttcatcccaccatactgatattcctgcaagaacatggaaaggtcagtatcttgccatctctatattgctcattcctctttattatattctcatgcccccacacctcccacctttgtattattacatttatgtttgcttacacacatttgaattcccacaaaacttgccatgtctccttgcaagtctcctggcacctctttcttcagctggtttgccttcctttgtctgcatcatgttcaaattcagtgctccctcttctgtttgagagaatgagtcatctcacctccagcctctctttcttggcctcagtcctctttcctattagcaaacacacagccaggctgcacatatgtccccgtctgtgtggtgcaccccacagagagcacttcaatcaaattcacatgatttttttccttgaaaccaggccagttgctcagtgttcaccattataggcagatatttgatgcaaatgagaaaaaaaagaataaaaaagacaatgacaaacaatgacaagagcaactagccaatcagtgtaatgtcccttctcattgcatacaatcagctccagctgtaggccctttatcttgagagttcataggataatgcacacacataattaacccaaacaaactcacttttgtggaaaacattttgaagacttcagcacaaaagagcactttttggtccaaatccggtactattctgaatttttaaaaagaccacacagaagcttcatcagcagcaccctaattaaactcatcagttcacagatgtttataagaaaatgatcagcgaaaattttcaccaagaaatcctgcttacagatgatgacaatagtattagtgataagagctaacattaagaactgtattgtgcctgtcactttatataggccaacacattttaatcaatagccttttgaagcagtaactgctatcattcctgttttgcagatgtcaaaactaaagcttacaaggttaaacaagtctccccaaatcacacagctaggaagcaccagggtctaagcttcagtatgcgtgactcaaaagcatgtgcttttaatcactacattctgttgccagtatcataataccacctgttctgtgactgaaatctaagtaaatttttcaatatttcagtcaccaaatagaaactgagtgaactaccactattttaaaccactattattattctccccagtatcctctttccccatttctcaccactacctttccctcaacttctgctttatggtctaaaaattttcctcgtggtctgaagactctgttagcaaagtcactctatgaaaatgttgttgaaggtaatattttctggatcatttcactgcccaccttaaaaatggcaaaaggtgcaatttaataagcactgaccacatttctctttcactgataatctaatgagctgtgtagtttccatactctgaggagagagacaatgagcccttgtcagaaacagagctttgctgtcacttataatctaatccagttagtttctagcctttggtttttatttttaattattattgacttctcattccccctgtgttatgccaccagatactgtttctcttctgttctctcagtatagatgtttttgtgggccatagtcacagtattaaaagctgccttaggcaatcttttttttttttagaggaaacacccactttcatatacattttaaaccatagaacatcacatgtaaatattcattatcggccaggtgtggtggctcacgcctgtaatcccagcactttgagaggctgaggtgggtgaatcacctgaggtcaggagtttgagaccagcctggccaacatggtgaaaccctgtgtctgctaaaaatacaaaattagctggcagtggtggcatatgcctgtaatcccagctactcgggaggctgaggcaggagaattgcttgaacccgggaggcagaggttgcagtgagccaagatcacgccatggcactccagcctgggcaacaagagcaaaactccatctcaaaaaaataaaaagaataaaaaataaatcattatctaagcacaagtggtaatggccctaaaataaatgattaatcaaatgtataagaaggttttgaagagacagtgagatcagtgagatatgttaagctgctttccattttacttatttattttttgactggtcagtgtattaggatgatgcagtatactattaccactggattaagcaggaaatataatgattcctcaagcttttataatactttggaatttattctacttttatatgtaaactcggaaagaaaccctgttctcctaaagggagaaagaacaggtgatatgagccctagcttttaatgaatcaacatacaaatataatctcattttcatctcgtaaggaggcttgtgatccaattgatggctttgacaattggaggcagtgtgacctctttgttgcaagttaatctctttaaaaaacagtttttctcatctgtaaaatttgcctgattaatagtatctacttcctggagctcttctcatgataagttatatgattcatgtcaaaatatgtgacataggactcctaaaatatatggcatgcaagtattaaataaatgttagttattattattatcgtgttatttctgtattattaagggctgccattatcaactatgttctccatacctgaagttcctctacattctccctctctgcatgagtctattcttctatccattcattccacaaacaattgtgtattattaatgtgggtttcatgaaagcaaggaccttgtctatctggaagaagtagtatagctgagtggttaacagcatggtttctggagccaaactgtctagctttgaattctgcctctgacacttaccagatcaatgacttggggcaagtttcttaacctcttggagacacacttttctcatctgtaaaataaggtaattataatagctacctcataagttatcgtgaaagtttgattgtgttaatatatgtaaaatactttaaaatagtgcctggcatgtaatatgggctatatgtgtttactatgattattgattatcatttttattatttatcatatctctaatatctggcccagagtctgacacataacaggtatgcagtaaacatttgatcagtgaataaacaaatgccagacactgaaatgaaaaaagatttaagggaacatgtcttatctagaagagaaatgtgagaggtgctagagaagcttacggcttaatggagaactcacagccagcattcaaacacatcagtcaggttcaattctctccagttccacagtccctaacctgggctacatcaccaaggattaactagcacatggaacttacatagcaacatggagcaaaataataaagattacgaatagtagtgctgcaaagtatggtatagctgaagtgctaattagatagtatagataatgtgtactataggaattcagtccaatgcttttgggacatttattttaattttacattataccagtggaaagtaattaaacaattatgtcattaaagaaatagtagccaaataaattcaaacatatatggtcaactaagttttgacaaagaaaataagagaacatgatgaagaaaggctagtcttttcaatgaatgatactgggaaaatggaatctccacatgcaaaagaatgaaattggactctaatgccatatgcaaaaatcagctcaatttggctaaaagacctaaacgtaaaacctaaaaccataaaatttctagaaaagaacataggggaaaagcttccttgaccttgtcattgacaatgttgttttggatatcacgttaaaagctcaggctacaaaaggaaaaataaataggactacattaaattcaaaatcttctgcaaagcaaaggaaacaatcaacaaaatgaaacaaattgggaaaaaattgcaaaccatatatctgatgataggttaataaccaaaatttataaagaactgatacaactcaagagtagaaaaacattaacaggattttaaaaatgcacagaggacatgaataaatatttctccaaagaagatgcaaaaatgtccaacaggtatgcaaaaaggtgcttaatatcactaatcatcaaggaaatggaaatctaaactgccatgagatatcacttcacaactgttaggatggctattatcaaaaagatgagaataacaaatgtcagtgaggatgtggagaaaagggagcacttgtacactattgattgggatgcagactggtgtagccattatggaaaacagtatgcaggctcctaaataaattaaaaatagatttaccatgttacccagcaatctctggtcttgttatatacccagagaagatgaaatcaccaccttgtaaagatatctgcactcccatgttcaatgcagcattatttacaatagccaagatatggcaacgaccttcatgcctgtcagtggataaaaggataaagaaaatgtggtatatatgcacaatgaaatattcagccttaaaaaatgggagatcctgccatttaccacaacatgggtagacttggagggcattatgctaaatgaagtaagccagaacagaaggaacaatattgcatgatctcacttatatgtggaatcttaaaaaataaaagtcaaatatacagagatagaggataaaacagtggttacagggggaggtggaaaatggggagatacagatgaaaggataaaaagtagcagatatgtaggatgaacaagtctagaggtctaatgtgtaacataaagactatagttaataaaattgtattatattaggaattttgcgaaataagtagattttagctgctcttgtcacaaaaaattataactatgatgatggatatgttaatttacttcactatagtgaccactttattatctatatgtgtgatataacatcatgctgtgaacctgaaatatacacaacaaaatttatttttttatatagtagccagatacggataacctaggtatttgaaatacttcctgaattaacgtttattctaatttcctcaaagtttaagtctttttagagagattatcttaaaatcatttcagagaagtggtgcagagacccactgtaatgccactgccatgaagtcagtgtatcatttgtatcacaggcttttccatgcaataaagaaagaggcatttctgttaacacaatgacaatagggtacccttgaacttgctcacctgaaaagacgtgttctgaatagactcatattaaatgacattttgatgagaaccattttaaagtgaaaaaatcaaggtttggcgaagctataaggaaatgagggctctcatataatgctggtatgagagtaaaccggttcatctttccagagggaaacaggcattttcacactaggtatcaaaagccctgataatgttcatatagtttggtccagcagtttcacttgtatgggtaaatgtgtatcaaagaaatattatcagagttgtgcacaaatatagaaaaaggattagtgcaacattatttatagttttaaaaaattagaagcaaactaaacatgcgctagtaagaaactggttagatcattatactgtagtcatgcaacataatgctctgcagaaaacaaaagtcatcttgttaaactacattgctgctacaaacaactagtcactctaggtttaaaaagcaggttccaaaacaatgtgtataataaagtcaaaattgtttaaggcaatatatctaagtagggagatgatgaatgatttttattttcttcttttttaagttttcttccactaatatgtgttacttttctatcatagaaactatagcataacaaaaaaggcatttgactccttattttccttcccacaaatactattctgaattccattactgtatatcacttcctcatttaaaaaaaggcagaagcaaccttattttatagaatcattgattgtacttatctgctttgactaatgcatttaattcatctgttatgtcaaggatactggacagtaattatcacaatttataattccaggtatcttcttgcctgaatatttttcttctgctccatagatttaactctaatattgatctttttcaccctttcaggtaaacaactacagtttagaagaagtaacacacgaagaggcagtagcaatattaaagaacacatcagaggtagtttatttaaaagttggcaaacccactaccatttatatgactgatccttatggtccacctgatattactcactgtaagtaccattgtcatcttcaaatagcatgccagacttgcagaactggaattctataaaactgttgacaaagtgttctacttgtaccttccctcttggttaacttctggaaatacttcagagggagtatcctaaactccactcctatgttgccttgcaggcccttacctcctgtttgaagatgagatctcctaatgagttggcatgcccaccattatggaaaggcttaatgttgaggacagtgtgattaaagtagtgtatgggcaatacattttgaaaggctatttctcaagctcctaaagcatgatcactctcatgccatcatattatttcttccaacttcagatctctgtagtagtagattagaaaagagactggcaaatagaccagaggtagctctatgattcttcctgaaaaaggggatcttgcaattgaatggcgaaattatgatcctcaatcaccatcacatagcttttactttacttgaatttgttatattggcaagtaagctggagaaaattatcagtcactatggcaatagaggtgagctggaagtgggacttctgcagcaacaactaacaactaatgagactatgctggggtcctcaaatttccactgttgcataagcctcatatgttctcctcttcttaataggtcaacacgaatcttaactaagtttctgtctttgaagactagatttagaagcaatttactttgttatgtaaatgtaagggatagttgtgtcaacagtagtaagcttgctcattctgaaatgttgagagtccatttgtgagactggaaacttggaacgtcttcagaactggccattaattagtactatggtctcaagcaaattgttcaagttctctcagacttacatgtttctcttgagagaaatgtgttgaacaattttatttcctgcccattgcattagctattgcttttcttaatgatgattctgaaacaacttacctccaaaatatgtatgttttcaagctggcagtaaattgagatcagacttaccttagaatatgaaagagttttaactttcagagtttttcaaactggaagaatgtagcaaaatcagccctgatagtctgtgagccacttcatgcagggcatataaggtcaatgtcaaagacagaaaagggagaaaacgactctaataaacctaacaaataagtattgagtaatttcagtatgtacaaggcacattgtaaggtaatatgtgggatgcagaggagatagaatcatggccttcaaagagctttgttgggaggaaggctaactcagatatataaataaaagcaatatttggcagaataagaggtatgcatatgccatgggagaggtgaatataaatgttatttgggaactcaaagaaaagagatacatcatctgtctttggaacatcagaaaaatatgcataggatggcatttcagttgcatcttcagaatgagatttcaacatctgagatgggttaggtaggagaggcaaattctaggtagatggtacagtggaacaaaggtacagatgtcaggaagcacagcctatgtttgcggatgataggatatgtgttggggggtattaaaattgattgatcttgcaagaatggcaaagaggagagtttatactatattaaatacataacaacaatggagaacatttaagtaagagaatagtgtggtcaagctgaatttcaggaggttttacctcatctcaacatataaaatggatttgaggagagagaaaggagcaagagacccagttaggaggtgtttttagtcacctaaaagggagatacattaggaaggaggaatgaaaaagaaaggccagagttcttggcctttgtgggatgggaatagagtatattttgggagaaagtctcacaggagaacctgatccttaggaggcttttactctcagtaattggatattaattatgtgaaaacaatgtgagctctgaaattagaaagctaacattttatttcaatagaaaattaatcattgttctgaaaatatgtgtgctggatctcttctccagttcttctcttcaccaaattagactaactggcattacagacttaactattattaagtctttcctatcctaaaggtcaccatgtgcttgtatatattaaatgcaaataagctgcaactcccccctctgggaggacaagaaaaaccttggcatgcagcaaagcctttctgtttttaatacatttttctgaagtatagcatgacacattgaatcacccacataacaggtttcttttctctttttcccccacctcttagcttattctccaccaatggaaaaccatctactctctggcaacaatggcactttagaatataaaacctccctgccacccatctctccaggaaggtactcaccaattccaaagcacatgcttgttgacgacgactacaccaggtcagatatgcctgttagttaattggatttgctcttattaccagaaagaaatcacatttgcctaacatgtcaggtgttgttttggatgctaactaaagcttctgggtcccattcaaccttattgtagttttgcctcaggtgcattgcaactgtgtcattgtcctctgataggcagcaaaatcacaaaatatttgtgaataaatagtaagatacacttatacatcactttgccatttattaagactttctatatctgatcacatttaagctttacagccatagtgtaaggtaagtattaatacttgagaagagaagatagtgctgagattcaaaaggaaggaagtagcatgccaatattatatatttggttagtggaattcaatgggtaaatgaataataaagaaatgtaaatgtaaaaactttttgtctttaactggtcattacatttggcaaaggaatacaaagaagatcaaggaacaaaaatttcccccaaactccctccagagtgacctgtcccagggtacccaaggtgacgacctggcataaacctttcataccttctccatgttcttacaaacatatacaaatgtattttcagatatacgtggggcctgacattatttttacaaaatgagtttatgttttacacattgttccacaatttttctccatgaacaatacttttatcaaaaatgagattacatgtatacatatgtgtgcttaatttcgatatgtgtttgtgtgtaaagaatgatagatgggttgttttggttttataccctgcctgtctaactgaagtcatttgtcagcctttcaaaaagtagagactttctgccggagaggaaagctttcctcactggtatatgtggatgctttgatctttctgttctttggtgtatctttttaaatgattaagcattttccatttattttgcaatatcaggtttgctgaagtagctctttatatctttagccaaggaatggaatgtttagacgctgaaaatgtgcatccatgtaaatcaaatacaagcttcttcctatgctgaaatgtctgatctctatgctcttaattaaaatgagggctgcggcaaagataatcctcacggctctctaaggaattctgtaaatacaggcacctttatccaccagagtgatgatctctttgctctcatcctattactaatatttgatatgattttaatttagaaatgtcactttatgttactaggccccatagcgaattaacatttattcaagccccttcataatccagaccctctgctagctgtttttatacactatccatttaatcctccgaaaaacacacagaaaaaggctttcatctccattttagagatgtagacattgaagttcaaagaggttatggaacttgcttatggtcacatagcttttattaataagtagaaaaactgagtgccttaacagctttaaaatcctagctaagagaaaacgttttaattttctaatattaaaaatgaaaaccaagtcatataaaactatgttcatcatagaaatatgtggctagaaagggacctcagagttttgatgagctctaaaaacaactagaccatagttgaaacctacctctaccactgactgtgtgaccctgggcaagtcatttaacctctgcaagcttcagttttctcacctgtacaagggaatagaaagtgagtctatctcaataggttgttgtgatgattaagtgagctaatgaatgcaaagaacttagaaaggtgcctggcacattataagtactcaacgaatgttatctatttacagtaactatacttactgtaatcttaatccacttcagatgtcacatgaaatatttttacggtacacgtgagatatgcctcaatatcttagatcctgcccctgcctcctttcctgttcccctagaggacagtctcactagtatttccctacaaaatcagaatggttggtgcctggcaaactgttaaagtaaattatgttagttcacacacataaacatacacatacacacccctccaccactctcttaccattgttggtgttctctcataggtgcttcacactgtaggcgttaccatgggtctcagaggtatttgctcagaggcagattcactttctcattcataaatattaattgaatacttcctataagacacctggtgctgcactagagatgcacaaatgaataagaaatagcatctaagaactattcaattgaggcaaaaaaaaaaaatgtgtaaatcaatggattccccaatgcctgttccctaatttatgcagaaccccctccatgaagttttccacaaagcctaatttattaatttttttcaaaatcttgagattatatattttgtaatcaaaatgccctttcttttgtaaaagaatttggcaattatttattatgtttttacttagaagagaaaaattggcaactttttgttagtcttcattttttaaatgttaactatctgtaaaattcaaaagtctgagaattactaacagaagcaagcaagcaaaagtagggtcagttctctaaagtgcccttatgtagcactagcagagttccctaacaccacaagagacacttaggaaatactgctaaatgagtatgagtattacatgaatgccataggaataacctatggcatcaaagaaagttttaaagaggatatgactctaattagtacttgaaaactgtgtaggcattggtcagagagtcaagagatgaggaagggcatttgtggtagtgggatagattgtgcagactcacagaagaatgtgaaatagaataaaatgaaagcaagaattagaacttgaaatataagactcacaaaggaaaatggtacctacctttggatcatctttatattcctgttccttctctcctatgcaccctagctgtaagattaacaatacatagagtaataaaaacaaaaggatcattactattcaccgttaacaataagtgctgtaatatatattattgctcctatattatttatatgatattcttattcttgatttttacagattaaaaaattctcagagaggttaagtaattgcctcatagcatacagcaatcaaatagaatcaaaatttgaattcaggtctgtctgttttcaaaggccccatccctgcatccctggttggtagtgctcgtcctaccacttactacctagataactctgaacaagtcagttcatctctgtgagtcttgattttctcatccgtagattcgctataaaggatcttctaatttcttcatggaattgtgaagttttaatatgttaacatgcacgaatgttgtcatttttagaaggctctgtaaattattattctaagttcatttaggtgcttatgtttgagacctactttgtattttcctaaaatagtaaatcaagaaaataaatctctaataacggaacttgggccagtagggaaacatgtctgtgaaatgggaactttcccataacctataaaatcacatcaaattggaaaacttttgttccatgtattcatatcttaatctattgtaataaatgtttctctactttcctgatttatagtcacgtttgttatggatgtacggtaagaattttaaagcaattttgattcaaataattctacaataacctaggtagattttttaatctatttctattaaagaaatgtacacctgcataaactgggaagttttatttttccatgaatttagaagaaaagtcacaaataaaaaaagttttggatacaatctcttagtagcatgctcactgagtccctataaatcggcattcattgtgatgtagatatctgattttcaatttttggaaaataaagctattacaacaatactgagattgtttttgtctcaggcattatagactgtcagaatagaaagggccataagtaaatatagagtctaatctctctttctggttgggccagagacacagggcccagagtgatttgttggctttccctggtccagtatttgtaagtagtataatcagatttagagcccatgtatatgtgcactatttttttggctggagtaagaaagtagcaattatgaaaaactatcttcaatcaaggattacctggtaacagtgtctattttgtatgttaccggtaactatgagttctatctttactgggccaagttttccctagttactcagaagagaggcaaaccacacatcatcactatctggctgaaaatacttaggatatgcaaacagtactaaaatgaaacaaaaaaattggtaatgcaaagtaaaactactctttcaagatgtagggacctaatttcccaagttatgaatgtgataaatagcattatgaaacccagggacctaaattataactgtaaaagatatatttctcagtgttagaaaccaagtttacctagctgtgaatttagtgtgtctttctggctgcctctacttattggtccctcacatcatttagttcattaaaaagcatcatataaaaaaagcctcaataaagatttcttgtccacagacactttacaagaactgccccaaactgtaactctaatattcaccagtttgactctgtcacttactgaacagacataatctcatcagtctggagtccacatctactctattgtctccgaattatagaacactagcttactagccatgtcatctaatatatattcaagttgccttttctccttcgttcagttatttgctcattcagtgaatattcagcttctacccatgtcaagcatagttattagcaacatagtcacaatggtgaacaaactggtcaaggtgcttgccctcatggaatttacattttagtatattgaataagagatgtataaataaatgcattaagttcagttagtgctaagtgctacaaaggaagtaaaataggataatgtgatgagcagtgattggggaagagaacaatatgaagtaggataaccaggcagtgcctctctcaggagatagcatatggactgagacctgaataaaaagtagaaagtggtgatgattaaagatcagagaaatagcattccaagaagagggaatagcaaagccaaagtcattgaggcaggaataagtttactgtgttcctgcaacataaagtccagtttggccagaaagagatgagataatgggagcaggcagaaaattaggttagataaggaagcaggaagcagaagtaggacttcacaggtaatgagaaagtgtaggtctaattttaagttcattgagaattcattgaagagtactaatcaggaaaactgatctgatttatgtttttaaaaaaaaaaaaaaaaagttctggctgctgtgtggagtagagagaccactggaaaaaaagagggaaaagattatgacacctgggactgaagtgagggtagcaatggaagagaagaggaatagagaaatccgagctatatctcagagcaaggtttaatagcccatgttccacgtgaagagcagacctggcttagtcagactgttttgactactgaccatttttatagtttttattacctatggagtagtctttcaggaacagcataagtatttgccactgttatttgtttctttttgttctgtttttcttatctcttattgtttaactttgtggattagaactggttagaagccagcccactgtttgtcaaatgtttctactcacatgcccttaacttagaaaataaacttgttctcctcaggctctgaggtagaacatgaagatttctgcccaagcataaaaacacataaaatcttgtatattttatcacaaaagcttgcagaatattgtttgctttaaagtaaaaatattcttattacaaactacgttatttttcttccgagtcttaaaatgaagtcgacacaccagaaaggttttctgaagatattagtaatccctggcaaataccacaaaccccaaggtacacttaagtacccaagtttgagaaacactgagctaagttacacaaacttgccaattattaattgtgttttatataaactgtcccttaataatggctcaaggtttatggtacccattaggaacaagctctcgaaggatcagacaacacctcatcagagtacagtacaagcatgttctagcctctcttctttttagtttacatttaatgacttaaaaccattctgagtgaactagaagtttcttcttatacaggaaagaaatcttttcttatatgcttttgatgcaggatttctcttggccccttcactggactcgcggtaggggcaccctgtctacttggcccaccgtgctcaaccccttgtgggagggggcatgtgagtgagtgagtgtgggatccagctggttgcttcaggcactggcacaggagcaagctccgtgtggggcccatggccagacaaggcatgtctcctggaggggagcgtggtggcatccaggtgagggtgcccataatcccatagccccagagagggtgtcacagtactcttttagttctgccatttgtagacagcagtatgttagcagctcagttggccccttgcctcatggtgtggggcggctgccctcctctggtggtggcaaggtctggtgtgacagcctttctgagtacctgcactcagtggtcccaagctctcgtccagcatccatgaagaatgaggtcacacagatgattaaatgatagtgaaggcggataatttgactgagcgatgaaaacgtctctcagcagggaggggagctagagaggggacaggaagaacaggtcttcttccctgaagtcaggctgtagtcagggttcgctggaggaatagaaataataggatggatgcataagaggagatggatgtataaggggagtttattaaggaggactgactcacatgatcacaaggtgaggtcccacaataggccatctgcaagctgagaggcaaggaagccagtccaagtcccaaaatctcaaaagtagggaagccagcagtgcagccttcagtctgtggtcaaaggtccaagagtcccaaagctgaagaacttggagtctattgtttgagggcagaaagcacccagcacaggagaaagatgtaggctggaagactaagccagtctagtctttccatgttcctctgcctgcttttatcctagctgcactggcagctgattagatggtgtccactccaattgagggagggtctgcatctcccagttcactaattattgactgagcctggagtctttatatacataggatgagggcaggacaggccataggtagttttggaaaaggcaacatttgattggtaaaaaggcattatccagaaagaaccaatcaggggagagtgggtgaacaggagtagaagttatcactttgggccatgggtttcaggctgttatttttgcttgaaggtggggtttcactggttacccacccctatctgcctaggcgtttggctgcctcctgtcactgtcacttttagtcaagtatggtggaaaacagctagagtaccctaagcaggcaactgacccggctttagaattacagtagaataacagagtgattaggtgtgtgggtcctggagctaccctgcttaggtttgaatcacaccatttcctagctgtgtgaccttgaatcagttatgtaactcccctttgcctctgtgttgccgtttataaaaggggcaaaataatactttctacatcataggtttgttgtgacaataaactgagttagtacatgtaacgtgcttggcaaaaataagtacctgataattgttagctgttattaatactattgaaaaaacaaggattttaagatgaaccgtgatacaaataaaaccactttttggcaaatatcctcaaattatttatggaactgtagccaacaatattacgcagctgctcaaacatgttgtaatctacgtatatggatttttcaacttatttatcttgtagaacacattagaatattttattacagagagtcatatagtctgactgctttattgagaatcttaatttttatgactacaatgaatatctaataccagctgcaatgaaaatctaatacagaaatcagtggaagcaaatatggtataaactagtctatcagttttccctctggctaaaatatgattttttgatggaaaatttgttgattttgcccttttaaaaaattcatagtgactctcaatagctaactctaggtagcttttcccttaaaaagttctgcaaaacatgacatcagactccttacagactttacaaagttcattataaaacttaaccaaattaaaggttcatgaacaaatgtctctgagattttgttttgctctgtgttgcatttctgatttctccaacatagagactggtactataatgtatgttttgaagcaaagtgtagaaatgaaaggggggagtgagacaaaactagtgagacagatagatcattatgtggaagcctcaaggagagttttctctttattaatgtaaataaacaataaagagaaaactgaccacacaaaactttaaaccacataggtttacttatataaaccatgaagaatcattcatagaactatcctactagaagtaggaagcagagagagtgggtatgctaatggcgaatctaacaaatcttaattcaaggggaacatccaaatatatattagaaaacacgttaagctgctgtttgctttcaaggaaataaatattagcaaaaatgcaacactaatgagaaatttaaaaccggctcctatagatatttatcatttcctatgtgctcatgagttagccagacataaacacacaacactatgctctataattttatggaaatggtaattgcatatacatagctattgttgctatacatgtaaaatttgaatagtaatttaatcaatgttgcattacatttttaatggagtaagttcatccttgctttcattctttagttcattgatgcaaaaaaggattgatgataggcaatggagaattttggagggaccgctgtagaagccaaccatcagttggtccctatcctcttacaagttaaccactatcatgaacacaatgtgaagcttatttctggccataatctgtatgacactgaaagaggatttatactgtgactcaagaaaatagacatggtctgttcttctaggagtttattttcatgttcatacatccataaggtgataatataggacaagaagatatctgattcctaattgcccacagatgtatactttagcaattgtccatgacactttgcaatccctgggtgatttcctgccatctcatatatcagtggtccctaacctttttggcaccagggaccactttcatggaagataatttttccatggacaggtggcaggggcaggatgggtttccagacgaaactgtttcatggttccacctcagatcatcagtcattcaattctcataaagagcatgcgacctagatccttcgcatgtgcagttcacagtagggttcgctcctttgagaatctaatgccaggggctgatctgacaggaagggaagctcaggcagtaaagctcactgctcacctcctgctgtgtggccagttcctaacaggccatagacctgaccagttgaggactcctgtcctatatcattagctgctgtgggtgagtttactatattaatattagtaattacctgaacaaaatataggaaaattgtgagatacaatcattgcattccaaagacattcttacgacactatcaatttataaatttcataagttttgggttatgtcgttcattttttacttctaggtaattgtattaatatagataatggggcaaactataactgtgtaaaaacacatcttgaaaatactgctttatatatgtctccagatattttttccatctttatatccatttgctttttattacctactgatctaccttatagccctccttaatttttttctttcaatgttttatttttgtctaatttcattttctctgattataaaagtaatatatatttgtagaaaaactgtaaaataaaaatataaagaaaaactactaaaattactgtttttcctaccacagagagataattacttgaaatattttcctttgagttttttccatgtctgtatgtttattcatgtaatttggaccatactatgtgcaatgagagagtttttgcttttattttttgctttagcattatatcttgagaattttctaatgttcttagtcttcaaaaacatgtttagtagctgtataatagcctatcgtataactgaaccataatttacataagtactttcctattaatagacatttatttttaggattttcttattgtgcttatacaatctttctgccttcatctcttgattatatatgtatttaatataaatgccaaatttccactgcctaatcagcatctcacttggttgtcttataaacattgcatatttaatatgtccaaacacaaactcttgctttttattcccagtctgtccttccatagtcttactctcttttttttgaggcagggtctcactctttcccccatggtggagttcagtggctcgatctcagttcactacagcctcagcctcctggggctcaagcaattcttccacctcagccttccaagtagttgggatagcaggcatatgccaccacgctgggctaatttttgcattttttgtagagacagggtttcaccatgttgggcaggctagtctcgaactcccaagctcaagtgatccccctgcccttagcctcccaaagtgctgggattacaggtgtgagctaccacacccagcttgtcttcctcttcttaataaatgacggttctatgggagctgttgctcaggtcacaaaccttggggtttgccttctctttttttccgcctttcatattctatatgcagtccatcaacaaattctgtgggttttaccttcaaaatacatccacaatgtgccacattccactaccagcacactagtcaattcatatcatctatcatttaattattgcaatagctccctaaacagcttccatttttgcctttgttactcatgctgcaccatacattactcttttaaattcagatcacgtcatctggagtgaaatctaaagcccttatttatgagactctttatgatttgactccagctggctgctctgacctcatcccccaccactcccttcactgatactcagacttccttgttacttgatcacagtaggcatactttgcttcaggaagtttgtgcttgcccctccttctgccttgaatgtttttcccttccacatccacatgtccacatggtttgcttttctttcttcacctctctggtcaaaagccattttatcagagaggccatctcagacctcagataaatatgagccatccacgatcaccctttcgtcctgtgttcccttttatttttctctctagtgcttattcctgcttgacatcatttttatttgagtatttgtttgttgtctgtcatcctgtactgggctataagctttatggctcagggacttatctgttttgtatattgattagtcccagcacaagtaagagtgcctggaacatatataatactcagtaaacatttgtgtactgaatataatataattaatgaacatttacagaactcttgatattgctatcagattgatttgaatttttttggtctcagtttacattcccatcagctgtatatggaaatgcttgttttaatactgtatctaatttaaatgcttatgtctcttaatttatctttaattcccatgttttctctttctccttttcctctacatttcttttcatttattttgttaatctctcgtttcatttattcaatctttcactttccatactttgatttattcaacaaatatttgccagtgtgtaatatcttcaaaaagacagcaaagtggaagtgtggaggggggggcaggcaaataaacccaaaaatataatagaggtgatacatgctgtgttggagagcagtactgaaagctatgtggagctcagaaaaggcatctaatccagactgatgagtcaggaacagcttcttccagggggtgactgagattggaaaagaacaataggaattagccactagtatctaagacttccttgtgacagcttcagtagggtccagggtataatgggagacaatattgtaaaagttacatgcaaggatacttaagcaggagttctattcattctgtggcccaagccatttgcttatttttgtttgtttgtttgttttttgagacagggtttcactcttcttgcccaggctggagtgcaatggcacgatctcagctcactgaaacctcgtctctcgcattcaagctattctactgcctcagcctcccaagtagctaggattacaggcatgcaccaccatgcccagctaatcttgtatttttagtagaggcagggtttcaccattttggtcaggctggtctcgaactcctgacctgaagtgatccacccacctcagcctcccaaagtcctgggattacaggcgtgagccactgcacctggccatttgcttgtattttttacaaacaatattcagggccagaacatcctcagttataagcagatattaattaaatacttcttagaattcataagaattgtggtaatagtgataactgatatttgtgtaatacctttcagtttacaaagtgctttgatatacattggttaatttgcatagtaattccaggaggcagctataattacccccttttacacgtgaggtaactgatgttgactaacccaaggctgactcagctggtaagtgatggaagctacaagcgataaaacattatataaaatgtacagtccatatagaaaataagaggtaaatagattaggcttaacatctgggaactagtctccaaattataacttataaaacttatggtgattaatcccagttgtttttaaaggtccattattgaaggccctacccataatcttgtgtaattcaatttttttcaactctagtatttctaagatatttatttttttagaggcaggaaggtaagtggaaggaagtagcatgacttttggaactggataagtctaggcacatgtcaagggggaaacacgaagatattagtcaaaagatacaaagtttcagttatgcaggatgagtaaatgctacaaatctaatatacagcatggtgactatagttaataatactacattgtatcctagaaatttgctaaagattaattaaaggctctgccattaaatagttctatgaccttgcactatttatcccttggtttctttacctgtaattaagagataataacttagttggcagggtagtgttgaaaaatagagataccatgtggaaatcaaataactggcatttaacgtatgttaaattgcttcctccttccccatcctcataggagcaacaattcttattttttattgttgataatctaaaaagacattaatccaagaaaatgggggtaaggaagggaaaagatcattagagttaaaacctatttgtgtagttatcacatacaacatggtattgaatcttaaagagctatgggaaaggaacaccatttattgagatctgcttggtgctggatacctttcaaatattatcacatttagtctacaatctcagttagtttacttggtttctacagtgcttttaaacccattagagaaaaagaatgtttcatactctcttgtaaattatttctaatcaacactggagaccatagggacaacaatattagaaaaaatgtaaaaattcattttgaattaatgttaataattactgtcatttattgaatttctaccatatatatgccagtctatgctaagtattttccataaaatatctcaattaatttttgagattggtgttattattttcactttatgcatgagtaagcagaagcaagaaagattagtgaaaagataagtatttgtctagcataacaatgtgttagacactctaagtatataaacccattaaccttcccatcactccatgaggtaaatcctatttttattcccactttacagatgaaatctaggcacagagcagttaagtccttgcctgcatagctagtaatgagcaaagctggtgtctaaacataggcagttgggctccaaaatccatatctttatgctattaacatgcagttggtatataacaaggtcaagaatcagaccaactcaagtatggcttttttttttttttccagtactacataggtagcattattaactttaagatttctagaattttctctctgtttcaagctagtcttggtttttcttttacttagaaaggtagaactaaagttttatgtggttgcctcctcccagaaacacaacctgttccagaaagcaatcaacttccatggagtgctgggtggggagtcagtccttaatgcctgtcattctggccattacatagaccccatgtggctgccttaataagcatttgctgaaagaacttagctgtggttgtgagggtgtctcactgcatgtaaacatttaaatatccacccccatcctaggttttctttaaaaaaattggattgaccttgaagtagaacaatgtgagtcctttctcatgtatactccttcctaatgggaatgttatcaactgatccattggagcctgagattttattttttgttttgctttaatctttttctaaagtctcattttccaccttgagataagagatgaaggcaaaacgaaatagctgaaataaatgtgatagtcaaatatttcaaagccaattttgtgaagccttgctctgaatttataatagtactagtaaactgtcacagctatctagtactgcacagatactttcctgtttctcattttaattcctatgactttatacaaaatggacggagagatgccattatatctgttgtacagatttggaacctgagatgatagattccatgatttcgcctttgacaattagaaagtaagtgacaaactcagaagccagaagccagaaggaggataacatcttggttaagagaacagatgttagactcaaaagagtctgggctcaccatttactagctatttgactttggatgagttatgtaacttctttgtgcctcagtttccccatccatgcctatgccacgggttattatcaggattaaataaattaatccatgtaaaacacttcaaacagagcctggcacaaaatgagctacattcagggtggccattattattattaatgttgacttttagtccaggaaaccatagtcattataggactggcttccgctgtgatgatagttgagctagctgggagtggtagagtgaggttaagaagtgaatgcgggggaaacactcttacagctagcctaataaaacatacatttacactacacttgtacctgtattaagaatagattttgtgactttatattgattcagtgatgttttctctatatttcaatgccttttaaaaacatatactgatgttaattaagaagaatctgtcaaaaaccaggcctaattgtaaaagtcatgcaaaaagaaaagtctatgttaaagaaactgattattcatttaaaaacttaaaaaaaaaatctagaatgttgagtaatcacaaatatttgcattccccaaatattcagatttcccattcaggtatcataaactttaaaaagtaaatgcagtggttatttttgtagaccatcattatatgagcacagaaattaaatatatgcatagcaacatctatcatgacgctttccagttcctaggagtggcattaattccatggcttcactgcataatattagtttcgatcatatactgtcgaagtttcatacagagtatacatctaaatccatataatattgagagtagctctaataaggttataccgaatttaaatttgtgagaactaagggaaactatgttggagttgcaactgagtgtggcactcacagtgagaatgtggtctgcctgactaaagcaaggtagggctatccccagaaccattgttttctgcagcttagagagaaatatttgtttaaattctgctaacaaaaattttttaaaaattatgtgtatgtgcacgtgtgtgtattcgccagtgaaataatgaaagtcacaattttttgtcttcccttgaaaaaagaacttaatatttacactctacaaatattaacatttatccatggaatataattaagtcataataagttagcacaataatttgtattctatagtaccgaaagagttaatgtcattcaaaaatgtgactatttccgacctttttcaaaaagagcgggtctaattgtagttctcaactctgatagcccattagtcacctgtgaaatctctttagaaaacagagtccttagccccatgccagatctaccaaatctggatgtccagggtggaagtgggacataagtgtcaaaaacagaactaaaatatccacaggtgattctgatgcacaggtagatttgggaatcactgtcttaaattcattgtgtctttgacctcagaaaatcatattaccagaagttggctgggtgtggtggctcaagcctgtaatcccagcattttgggagtccaaggcgggtagattacctgaggtcaggagttcgacgagcctggccaacatggtgaagccacatctctcctaaaaatacggaaattagtcagcagtgttggtgggcacttgtaatcccagccactccggcggctgaggcaggagaattgctagaacctgggagtcagaggttgcggtgagccttgattgtgccattgcactccagcctgggagacagactgagactctgtcaaaaaaaaaaaaaaaagagagagagagaaagagaaagagaaaaggaaggaaggaaaggaaggaaggaaggaaggacggaaggaaggaaggaaagaaggaaagagaaggaaaatcatgttaccagaagtaacagcaaaatgcaaaaagtaaaagcacattagaaaacacacacacacacacacacacacacacacacacacacagaggcatttctctcataggataaattttcattaaaatagcggacgaccctaaaccactgagactactagtgataatgtgcaaagaaaatcattgctcctgagcaagagttaccaaacacagaatttgtacaacagtatttagattttataactaaaggcatcagctatttaaaaacacctgtagcggatatgcacttcactctataaatgcattttgacagagcattattttattttctttaaatccaaatatataataataggctctatcttgcctgccttttctctcagagctcaccctgagcatcaacagtttaggagctcagatttttgaggaacgaaaacctggaagagagaagtctttgggaaaattctgcttttcttctgtattacagatctctactgaggcaagggaatataaaggtctggttatctgcttcacacttgggaagaaaaaacaggaagctcaaaactcacattaatatttcagttatcctactccctcccacttatttttgtatttatttatttttgagacagtctccctctgttgcccagactgtagcgcaatgatgaagtcttgggtcactacaatctctgcctcccgagttcaagcgattctgaagcctcagcctcctgagtggctgggattataggcgtgcgccaccatgtgccaccattatgcaaaagctatatgtaatatccaccgtgaaagtttgttgttgtacagattaaaggtgatggtatttgtgaccatatagtgactgagaaatttggggaccctccattcttgtaataatctagaattcaaccatttccctcctctacttcaccatctaaaaaacccaattccagattttaggcaaatcacatagattttatagaatatttcttaaggagacaaaagggaagataatggggtgactttgctccaaattctatattctgtataccaccctgctgcacggagttattctgggctgacctcaagattctgtggagcccgttggctctttgatattttgaccattacttttcactgtgcctggcttttattacaactctagcagttttgttgcctggtgtctatctaagctgtgattggaatgtattgtcctaaaacttctctcatctgttgaatctattccggattggttagatataatagacagaaggtttggctctattgctagtctttctaaaaaatctcttccatctagttctgttattccctgtgtcctcattccagtagttcacttaacagcacctctgacttccatcggctatactgggccagtcaggatcggtaataaagcacagttttctctagatcctcacaataggcaattaatgctgtctttcttgggcttcatgactagtcatctgtccctcagtttaatttgtgatcttactcaacctgcatgaaagactttggccaacagtgtacaagaaaacagctcttatttatttatttacttacttttcaaaaggttttggcggaacaggcagtgtttgattatataaatacattctttagtggtgatttctgagactttaaaagagcataaacgggaaagccatatgtatggttgccttaagaatgtgttttgtcagtgagggaagagtgtctatttccctcccataatgcttagtcatttttagctttattttgtcaaatacatacacgcatctccaagacgaagtaatggttgagggaagaatttatgtcaagagcagatttttatcttccatatcacataggttagtatctggtatataaatatagttgtttcctgagtatgtaccatatggcaggtgatttgtgaaggctttgcgtatattatctcatttaatcctgtagcagtcctataaggtagatcttaaaaggccatttccagataaggcagccaagattcaggcaatagagatacttccctgtagtcacacagataggtggaagaacagtatttgaacccagatcttctagcccaaaagcttgcgctctttccaccatgttcatagcctcccaatgtgttttctaagggcagtaaatatgttgagtgaatagatgcaccagtaaaaaagactatacttgctgtaaatttgctttaattttgtgtcatcttttctataaaatggctgtagctagcacataatttccccgaagtagactaaactttaagtagaatcttgttagtaacagaatatatttgcataactgaagacatttgagattgacaaatttaaatagcaaatatggtgataccagttaagccatcttgttagtcataaccagttatttataatgaactttcactattctcataatgccatgttagttagtacctaggcactacatagaaataaaagttgctcattaataaggaaacagtactaatttgaaaaaatacatattttctgtttctgggttaagaatgtgtggatctttggggctgaattgaaaagtacccaatacatatccctaacagtcctcccctggagttacaagaaaaaatagttttttcctccagctttattgaggtataattgacaaatttttatatatttaaggggtacaacttgatgttttcttgtgtatacattgtgtattagtccattttcatgctgctggtaaagacatacctaagactgggcaatctacaaaagaaagaggtttaatggacttacagttccacgtggctgaggaagcctcacaatcatggcagaaggcaaggatggcagcaggcaaagagagagaacttgtgcagggaaactcccccttataaaactttcagatctcatgagacttattcaccatcatgagaacagcataggaaagacctgcccccatgattcagttacctcccacagggtccctcccacaacacatgggaattcaagatgagattttgttggggacacagccaaaccatatcacattgtgaaatgattaccactaccaagctaattaacatattcattacctcacatagttaccttttttgtgtgtgtggtgataacattcaagatctatccccttatggggtacaaaaaatatttttaaaaaattaatttaaaatacaaaaaaaaatttaaggaaatcaaaagtacccataatcccgccattcagagaaagcactattaacatgttggtaacttttccatattaacctacagatgtacagatatgcctcttacaaaattggcatcaaactatatatacagatttataactattgctcagtttatgtcattaataattcttaatgtcatttagaaaacatgaaatagtgggagcaaataaaaattttatgtagacatatcattcataaatgatattgaacaaattccctggcgtatgcttctagactctttttaatctcattctctactaagtaaaattgggatcgtacttaatattttttattattcacaaaaactgaatcaaactgtatatatattattttaactcgattttttcacttaataatatggtgtgtctatctttatatgtcatcaaatttacttacataggaaagtttttaatgcctacattaaaactgtattcaatgctaatgaatttttttcacttaataatatcttgtggctgtctttttatgtcatcaaatttacttacacaggaatgtttttaatgcctacgttaaaactatattcagcactaatgaacataaatattttttccagtggtttgcttctacaaatgctgtgacaatgacaattctgtgaacacctattgtactcagttttgtagaacagatttctggaagtaacatttctgaactgtaggttcagcagtttatactaccaacaccagtgtgtggagagtgtttttgcagccattaaagaaaaggtagccggtgccatgtgtactgacacagaaaaacgtctaatatccaatgtgaaatttaaaaataaaagcagtggcataatatgtataatatgagcaacttttattttaaaattatctatctgcatgcttatgtatagatttgagtatagatgtgtatatggggatagatataaatagagacatcttaatgagcactgaaaatacaaaattaagcacatatgctgatttaaaagcatgtagcagaccgggtgtggtggcttacacctgtcatcccatcacttggggaggctgaggccggcggatcacctgaggtcaagagttcaaaacaagactggccaacatgactaaactgtctctactaaaaatacaaaaattagccagtcatgagggcacgcacctgtaatctcagcttcttgagaggctgagatgggagaatggcttgaacccaggaggcagaggttgcagtgagttgagattgcaaccctgcactccagccagcctgggtgacagagcaagattctgtctcaaaaaaaaaaattaattaaataaataaattttaaaaacaaataaaagaacatagcaaactaaagggagagtcagagtaaacaagtaaattttattacagagtaaatgtatatgctggaaggcaggttactagcaatgcatgggaacttgcaaggtgatggggctggcagattgccaaataaggatgcccagttaaatttgaacttaaataataatcaacaatgaataagtttcagtataaatgtgcctcatgtaatagtcacgtatttatactaaaaaattatttgttatgtttccaaaatagaaatgtaactggggcatcctatatttttattagctaaatcttgtaaccctagacatggccagaaacatggttttgtcctcataagagggaatcgtctctcatgaatgaattcacatccacagacatgacaagagagatgtataaaccggatggcctacagccagatttcctatttaaatatctatagtagtcaaaacatttactgattgtcttctaggcactgtgctattcatgcatcatttcgtctaatactcgtaaggccctaagacccaagcactattcctgggttaggggaggaaactgaggcatagaggtaaacaacctgcccaagatcacatgtcttaaaggaatagggccggacttgaatctagatagtgagaatcacagtttgtttcctctgtcctattctctattgcctttaaaataggaggtataattgctaatatgaccaagaaatataatcagatcactgagggcaagtatatactacagaaagtgtttaaaacaatgacaacagaacacttagtggtttgaacccagacaatctgggttcaaagccaagcgctaccactcacaagtcaggtatgtgaggaggggcaggttaatgccaacctttgcagataatagtattgcatatgtcttaggtttcatgggaggattaataacatcgggtatataaagcatatgtagcacagggccagcttcatagtaagttctcaagatatatgtgagttgttattattatttaaaatacatcaaagtacaaaaccaagtggcaatcatgaagaaatactgtatgggagttaagaagagagaaaaatctacaatcaggtgtactcaacagactttatggagaaagtaggagttagaccctgatagaaaccagggactttctaatgtttaggggtggaaggaaggaccaatatatgtaaaggtgcttcttagcaaaaagccttctctaaagagagcaaggcagtgctacaacaatctcttgttcttatgcatgtcttatccttccctcatggccaccaaacaatcttcataacctgtttacagtaacaggcacagaagactaaatggaaacagctgcatgaaacagagggaaatgtacctcttccaaggaatgtgaaagaaatccatttaagtgattcgattaaagccaccttatccttcctgttcacaagtagagaattatatctgaacattattttgccatctaggaagctgctgttatattcagtcttagcatctattcagttaaaggtataagagtgttcccccctgtagagtttgtcttagtaatgtaaaattggcctacagaagtatatagatgaataaacattttgaattctactttagaaaatgtgattttgctaaatatattcagaaattcttgtggggggtgtgaattttaaaacccaaagctttatcagatttggcaactttaggtgttactaatgtcaatcatcctcgagcctccgaggaaagaaaagaattattttagaggtagagtatttattctgtaatattatatttttgacaccatgataaaaagaaagaaattgtaggtgatattaagcttcagaccttctctttgggggcctttgtaatgttcctcacactttcctttctcttttgttatttccaagtttttctcaaaaaggaatggccttgctttttttctctacactgtggtttcatagtactggctaagaatatgaagatgtggggagtatactcaacagaacaaacctgaaaataccagtgggatacccagcttaaacaattgtgccctgcccaccggtctgctgaaaaagcaaaccaaactcataaggaccaggtcactcatctgctagcgagagctgaatagacagggagtgtacttggcccaaaggatgccaatccagaggctaacaagtaaccaataaggtggtttactcaaaaaggtgtactaagtccaacaaatactcagttaggaatgtttaattgaaaagcagttcaaccgaggcaatgatcagtgaaaggggaagctagtgatttatgatgtaaaggaggcccgatgatccattgtgagtctaatgccagctgatgtcattacagaacagaaactgagggcaagaagaagctatcaggtagaaagtatctcaattataaattagaggtcaaagtggtgatttgagacagaaggaacaagtagcacaaaagaaacagcgttatcttgaagggaaagctgtagagatccagctccttagatctcactcttccgtatttatcacacagctttttctgggtttctatgcacatgtgtcctgttacctaaagtagattaaataagtctctgttcctgcaatcagatttccttacaaacaaaatgtttgttcaacaaacaaagggaccattttttaaattgttttactatatacctgccacaaagtaggtttttggtaaatatttgtggaatgaatgaatgaatgaatgtacaaatgaatagccaaaatgattgtactcatttaattccaactagtaggaagaacactgtcttccataacttcttatcaactatggattttaaaattgtactcaagacctgcctaacttttcaattatctactcaaaccattaacaaactccctaaatggaacatgtttgcagattcctctttaaatctgcacgtgctgttaccactttctagaaagccctctttcacccctttcactctctttctcccttttcaccctctttcaccctttcaccctctttcaaacctgcactagaattgctactctcagcagtgtttactttcacatattcttagctcagtctctctctgaaatggtaagagaattaggtgctttcacttcctgctgtccccacagccccatatacaattttgtatttaactttattcaacattataaaataaagcattttcctgtctcattaaaatgttttatgaatattaactttaatggttaaacaataaaccgtcatgtgaatgtgtcttatattccatacccttcttttgctggacattttgattgttttgttttattctgttttgctgttataacaaatcacaatgactttccttctatagaaacttttgtacatattttttatttttcttcttcagatagcacactagagtagaattgctgaaccaaaagacaggattacttctaaaactcctgaaatatattgccaaattgctttcttgaaatgttttaaggaggttttacactccatagcaccagcaatatagtgtctgtttcaacataccacaactaaattgtgatttgtcaatttcaagatcctttttttaaaaataggtaaaagggatgtatcatttaatttgtgttatttttattcctagtgaggttatttatatgtgtgtgtgtatttgtcatttgtattttctcttgtgattggatactaattgtctttgttttttactaaaatgttattgcatttcttattgagttgtaggagcatctttaaaatattgataaatatatttgagcaaatgttttccccagcttattgcttgtttatgagttcttgcttcagtggtttcaatttttttttttttttttttttttgagatggagtctcactctttcgcccaggctggagtgcggtggcacaatctcggctcactgcaaactccgccttccaggttcaggccattctcctgcctcagcctccccgagtagctgggactacaggcacccgccaccaagcccggctaattttttatatttttagtagagactgggtttcaccgtggtagccaggatggtctcgatctcctgacctcgtgatccgcccacctcggcctcccaaagtgctgggattacaggcatgagccaccgcgcccggctggtttcaaatttttatgtagtcaaatctctcatcttttatgtgattcctcctatttatttcatgcttaattttttttccatcacgattcttagtaactactaacctgacattttgtagatctatatttatcctatgagttcaattaaaaattttttaaaaatcaatacaaagcctttaaaagcaggtttacaaaagtgtaagagtttaaacactagtataggacatattgaaccttcctcaaataattcaaatccatgtctcaacggccttgatctggccataatattgaccctgtgactcttagactatatttgtttaaacatctttcagaaagccacaaaaattctactatagctggacaccctcacccaataccaaaaacagagatccctctcccttttgttacaatcaccattgtcaaggtcattaatattcaacttcttattccaatgaaacactccataacccatttacaacccactgccgtgagagagcctaattttgttgaaacccaaacactttttaaggaaataaagcatcttaatattcaaaacaactttaaatgatgcagctcttactctgccctttgtctcctcaatcttccaataaactcctcaataaacacagtaaaatataactgagagtgatgtttacatagaaaaaatagtgaaccaatcctaatttctacttttaaatagtaagtatttgcagactgtggtatctaaactattattaataacaaattacttatgacccaacaatctgatgtgataccacagctgtgaaccatacgggaaagcaaaccattataaagatccaggtacaaatcgggcgttagagttggggctgctatattgttagaggcagtgaaaataattgagaagtacagagaaagtggtcatcaacctccagggctattaaagaggatcaattaccttttaaatatacagagcaaaagtgagtctttagaaggcacctgtgcagtaccttttgcgagactaaaagccatcgattgttacttccttggttcaaccctcttgtagagaattcacattacatgaaagtgctatcgtgtgaactgactgattctaagtgagtgggtgaagaatattatttgtaggaattctcacaaaggggaccaacattttctgaggttatgcatccttgtgagctcgagtgtctaagagtgataatcaagataataataatggctcctttttggtgagctctgagtaagtgccacggactgaactaagtgctttatgcacattgttcctatttctcacaatcatctttaggctgatattactattcccactttccagatgaggatgttaagaaatagcataaggtcatacaaggtagaatttgaaagagccagatctaaacctagtttggtttgcttgtacttaacatggtgctcataataatttaggtctgtgcataattttgcaatttataatttttctggtaaacagaaaaatctttttaaatattattttaggtctataaatgagaaagctaagatttgtaagagttaagtaagcgtggcgcaaataggcatctactccaactgcccccgtggaaattcttgagtgcccaattcagtggtgcttggaattaggggagcgaataggttcttacaaatcacctagatcaatccctcccctagatgtctctatatcatactttaaggcctgtataacaccttaatcaagtgactaatacctttctgcttaaagttcagtataagagaagtcagcctctttcttaaccatttttataatgtcatttcacatgttgagccacatagttcacagcctgatactaattctcttttatcccctaattacttttagggcttcccaaaatcccacccttaagagctattagcccaggactggaattcaatcctcttatacttttccaaatccttggcccaataaacagtgtattatttgtaaagaggagcatgaggcacccttttaaagttacaatcctttttcctcaaatgatatctggcaatatattagatacttaggcatctgagcccttgacgtcccagctgctataattaatgcagtttggttctatattctgcaaatacagggcatgcggttggatgccccctcctattatggcaacccaagaaaaccatagcaggataacctttggagaatctgaaagttctgcagatttagccatatcagtctatatgatgaagaaatttatgctcaaaatcatatacatatatgacccaaatccatctttttgtaattttagatgtccccttttagttctggctcgggaaaagagaataaaaggtactgatcacttttcatttcacagttcctttcattttctatgacagtacttcagtaatacattcttgcattgaggaaagtaatggggaaacaaagacacatgagatttggtcctgatcctccagggtctaatattctagagaaggagagagcattgtgaattaataaagacagtgcaatgaggtgaggtccctgcctgagacagcctgaaggctttgagagctctttggtagggagttagaaaactcaataaagtgtaagtcactctcattgttatctctgagagaagagagtcatattcctttgaccttgtaggttcaggtgctacacagatgaagactatttacaatcacagtcattattatcactgtcttaaacattatctctgatacagggcagggactatagtgaggtgagtgaggtactcatgttgggtgcaaaatttaaggggacaccgagaaacagcaattaagacaaaaatactttaatgaaatattttagaaaataaaattaatgcaaaagaatttataatgaacaaaatatcaaacttttaaagatagagtcagtctggtattagtctcaggtactatgtaattacatagaggcccaaggttttgtctgttggctttgggaggcatagtctagttgaggtgatatgaaagagatgtgaaaataaacaaggtgcctgttttattttcactgtagtgattgcaaacatgagatcagatctaacttccaataagggaacagggtgggagatgggtagctgattgacaactaatgtcatatgggaatcatcaaagaaattcaatagcatgagctctcataaccctgctgtaagaatgaacccagacagttattctagactcaaggaacctctagacattttagcaacaaaatttgatagagcttcactctggtgctctataattagtggacacagctacagctaccttctccatgtttgcatcttttcctttttctgttaactgaaaattttttctcctttattcacattattcaccttccataggagaatccaaatggcctaggccttttttttctctctttcttttttttgagccccaccatacagatcatggttgcaaggtgaggggcccaatcctaatccaatggtctaaactgctttgtttagggaggaaactgaatttgatagtgcaagtggtccaaatgggaaggagcagttataggcaaagtagttttcctaagaataaggtatagatgaagcacctccctccaacatacaccagtattgtggattagcaattaaaaatgacaaggaaatagaacaaatagcaagtgctaatggagttcagagaaaagagagatcaccaagggccagggtgtgctaattatatgctataagaacctgcaattataaacccatagatgtgcaaataaatgctgatggctcagcagatgagctacaacgtcattatctatggctctttataaatggacagcaagagaaatgatttgtttataaattcacttagagattgtaccaatatcttcaaatacttttccctccctctgtgggcatccacagataggcctcttgggttggattttcatattcactaccttctgacctaggccattctggcagtttataataggataagcaggccctttcaattatgactggctgattcacgctgccaaaagtcatttccccttggcacttccttaccaactaaatgggaagtgatagtggcatctgttctgccacccagatttcagtgatggtttataaaacggcatttcttgtttgtctgatgggcagaggtcacacagaatataactgcagggaaagactaagaatgctggctcccagtattaggccttctggaactcagggccgagaagtctgtgaggagcccactgtgcccattggagcgactctcacaggaactatgggcaggcatttcagtggctaaactcaaacgcacaagaaacctatccctttgagggcagatgaaccatgcgcacatgctataattaagtacttaaagccactcagttcatgataacattgggattctggttcttctggtataacctgtgagaatttataatggcctgaaaaatttagagtagcttatggctcccttgaaagaaccagaaggttttttaaaatttccctctgcaaagaatggctaaaaaaaaaaaaaattatctattcattcaaacatttaccaaatacctactatgtgccatttctgtgttcagactgtagcctatgttgtactttctgtatactgtactgtgctctagtacataatatacatactatatgatagaatatatgacagaatcctagcgctgtaataaaaccattagatatgccgggcgcggtggctcacgcctgtaatcccagcactttgggaggcagaggcaggcagatcatgaggtcaggagatcaagaccatccttgctaatgcagtgaaaccccatctctactaaaaatacaaaaaattagccgggcgtggtggcaggcgcctgtagtcccagcttctcgggaggctggggcaggagaatggcgtgaacccaggaggcggagtttgcagtgagccgagattgcgccactgcactccagcctgggtgacagagtgagattacgtctaaaaaaaaaaaaaaaatcttcaaatgtgaaccccatttttatgccacttgaaaggggatttttactgatatttttaatgttgttgtttgattgcaagagaaccttgtcagtattgcaagaaggctttgtcaaatttgtcaagtggtttgttatgttttggtatactttcatctactcatcttctgagatattaagtgctctcacaatcaacaaaagaaactggatgtgatatctctattctttagccagtgaatgtacaaaataacaagtaaataaataggtaagaaatagaaggtgaaacaaaggtaaaatgaacctgcgatatcagtaactgtttctctgtgttgataagactttgaacggtgaagaattaagcttagcaaatatcagtccactatgaaaccatcctgaaggtgactgaaagcaaagaaataagagccttcttctaaaatccgaggtattaaagcctgctccaaacaccaaatctattaaatatgtgaatcaaacgataatattatattcacaaaatggttcccaaaagattcaaataaaagtttcaagagttcaaccctggacaaaatacaggatctcattttcattggcttgaatttattgtaattttcagaaagtaaaatattttcaaagagaaactgaataaagaattcagttaaatacaatataaccaggaatttttaaaagatctccattagccagctttgattgtgaaaatgtgactcagaatatggtgctactgaggtaaaaggactaggagaaaattggaaacatcattttcttagtctgtagagtcaacatcagactgagaaaattggatcagccctcccaggcagaaacaacaatgttaccgaaatgacattatcatgagaatgttttatgatctaaaagaagtcattgaatcctttcttctaaggttctgtgctggcagtttagatcagctaccattttgtgtataataatattttcaaattaagatgcagaaatttctccaagtggtcataggaccaaattatatggaaagaaaataacattctttacatttcctatgtatacagaagatattagatggactccaaacataattaaatatattagcatttgtagtaggccctatttatactatttctttgtattagatgtgcagtcttaaattttgtaggagtatatctgttaatattaggtcctatttatataagaaaaaaatgatcctagcttgaacaacacagtttatctttatccacatagaaggaattcaaaggtagctagtccagagttggtatagtgccactccatattatcagtgacacaggttctatctttatattccactatgtgtattttttggctttatcctcaagtttgcttcatggtctaagatgaccagtgaagctccacccatcatgtctgtgttccaggtaagtaaacggaggaaatgggagagaacaaaatttcaagaattctggctaaacgagcttccttataagcagctattctagttcacaaaatacttcagagcactcacatcacattggactgaacattttcatggggccacttttacccacagaagagtctgaggaataaagtctttattataagaaaagttacaagtggaaaattgggtttcttttagtaacaaatcaagataaaatggcattgtttttacttttgcacatgctgagatgctactggttgcacaggtgttccttgtatgtactaaccatgcatatctttctcttcctcttgtatcaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccaggtactgcatgcgcttcctcacttcatcttctcgaactgcatgtgcttccacaaggataaatgggtagaatccgcctctgctcacttctcttgcactaaacatcttccccaaagtggagagatgttctgctgttcccttggtgcaatgggagaaattaagaacattgcctttttgttttgttttattccctggagtgatcacagagcacttagacattgatcacatgatgctccacatgttcctggttcctatacattttaataaggcattcattatatttttccagaagaattaattttggaacttaacaccatttcactcatacagaaggatgaaagagaacatttgttgaatatttttaaataatatttaataagtgcttactatgctccaggcataacatggcctaagaaatatgcactattatcatttaatattttaactaaaatattagattaatatcaccatttaactgagtctttaaggtattaagcaacttgtccaaaactacaggattagttggttccatctcaccacacggaacgtaaaattaatgtttatattatgttaccatcctatgtatgtacatatatatatattctcttatttaactgctcccagcctattttaagaaatagaagttcagagtggttaaaggtattgccctcagtatgatcttgccaataaatgtagagtccaaatttgaccttagaatgttttgagaatgttttgagtctttcaacaactttgtaaagaaattattctaagtctgaaagttggacacaattctgtgttagtattccaaagcctatatatgataaataacaaaaaagacctcctcttttcatagtagcctgagttggagagagaggaaagcaagaaaaatagaattcagcgttccacaaggtagttccaattcagtctaaacagagatcccaattgtaatgttcctacacagaatggggtgtctatatagttattttttcagacaggaatatcttcataatattgttagagctgaaaaaatacagactttagaacgattcagagtgaagatggatatatcaagagggtctgctaagaatatcatctttattttttgatactttgaaagaataagtttggaagtcaattactgttctctctaggagagttaaataacaaattttaaattacatctaacatttccagaaataaatgagaaaacacatttttgactatgtaaatcagctagggcatttttttattaatttgcaataattaaagtctaactaatatttcagaatactttataaatattcattaagtccacctatatttttaacaaatcattaaaactatttgttgatacagtgaactatgccattttaaagctgaaaggtcaaagtcaccatagccgtaaggaagtgagaagagccacatacctgtaatgacttgctagtaattatgtacctatagtcagctacataagggtagctaacatttattgagctcttctgtgccaggcattttgttaaatacttcttatgaattatttctcttaatcctcacaataattttttgaggtagatgttattattatctttgttttacaaatgagaaaatcgagacttgataagttgcctgacttgcccaagatcatccattagtaagtgacagctgggattcaaacccagatgatgactgacctggcagaccattagccatttttgctcactggaaaaaaatttccccccatttctctttttctatcctttccctatctttatcccgacttctcatattccttcccttcttctggctctgtgtcagtaaatattttttttctttttatcctgtgttccttttttatgaatgtaaaagttacattggtttccttccattccaatggggattttgaagcatccttcctgaaaaattcacgaagaagtagctgataacagttcacctctatgtgcacctgccagatatgattcttttcagcttgctttctgtcatctgtatcatgaataccatagttatttatttttcaaataaaaacattatagtacaatgttgaatttttttttcaaattacacaccctaattctgatatgcaccaggccccaacccccatccaccattcccctttttgggtattctattttcaatttattctaatttggtccccttctttctccttctttttttctttttccattatcttattctttatcttatctttgtagaaaaacagtcatagacacacaaaaacacacagacagctattttagtggccttgtcactaccagtgcattgacaccaaaaatcttaatttcaccccactttgctcctcctccatacttcctcaacttagtaaatggcacacacatctaccgcattgttcaagccaaaaacttgagagtcatccttactatgttttccctcatatctgccattcaattcatcttcaagtcctgttgattctacctccaaaatatctcagatttattcacttttctttacttctatttccaccactttaatccaagcccccatcatctcccacctataatagcttcttaattggtctcaccatttccactgttgacctccaggcttattctcagtgcaaccaaagtgatctgtaaaaaatacagatcagatctccttttgcattaggatgcaatgcgaagtcattaacatagcatccaggctctgcatgacctagccactgcctgcctcttggatacctcatttcactcttccctttgctgaccacatattcatgttggccttctttttattcacaaaatgcactaaatctcttctagtctcaagtgtttcacatatgcttttccctggaattggaaagctctttttacactttgcctgattaatttctggtcatcttagatccaagcttaaattgcacgtcttcagagaagctctctaaaacagaaaatcaggcccccattatatattttctttctatttttcataagactcaagcaatttataattgtacatttatttatgtgattttcatgactgtatcacctgctacactgtaagcgcaatgagtggaattgtgtatttttgggcactgctatattcctaacagttagtacagtatctggctagcaggagctcaggattattggatgaatacataaacatggaaataaaatctgcaaacaagcaaactgttacctgtttgaaaacaagtcgtaagctcaagctgcgctttacctagttcttagtaggtatataaaactactccatgaatgaatgaatccatgcatagaaacaaataataactagaacttactttatgtcgtactttcaccataaactatgtctatggtgattgtctacattataaatccattaggcacctgtcagttcttcgtgaggactcagtaattcatttcagatattatttatttttccaatgggaaatacctctccaagccactgtatcttgaaatgcagccaataattcaggggcaaagtaaaatattctggttccatttttgacaccatcacctgtgtgctgttctctgtgttcttgaataacatatagaccctcggaagtagatgagaacttagaattagatagaaaaacccttatccaactctagtaatgttgtggaacccaatctactatcttcacagtctacgtcttattacacctcatggttaaatataaatattctagaatcttttgccctaaaaaagatattataaaaatatatctattaatttatttagctaagccttatcaaggatcatccacaaagtgcaagatgctactataatgggacaactttttacaaaggtgcaaggtgaaaaagccaaaaatgttgaagaaatgcctgatttttaggatgcagtagataatgatgtatattttgttcagagcttttgaaaaattcctgaagtctattccagaaacttgcccatattgatatagcagttatggcttcagattagaatatgcactagctctggaaaagttagcatgtgaaaccatccttacatttacatcagtttaattcctaatccacatttagaagaataaaggttagtcagcaaaagcaacctgagtcagtcttctgtattttctgagcttcagtgggaatacccaagttctcagctctttgaattaatagcaaacattcagggatgaattaattgtacacacaatttacttctgtaagaccgtttaaaagaaaacagagaagttgttagtttttcttaggaaagcactttaaattacttggcacagtgcctatggctgcagattatgtttggaggaattgacttcttaatgcttgcagaagcaagaaatgtgcagagcctgaaatcaaactaaaatttgaaaaacaaataggatttctatgggactcctgcttatctagtacatctctttttctttgaaaaaaggtaattttgatgttttaattggtttttctactttgggagagtaagtttttcagcttttgatatttctagggcaaggagaatagtattcttggctgttttatcaatatttatggcatacatttatttgtccttttacataaaaggtcctaattattgttattttgcagttgataacagaggctgagataaaccagatgaaggctaattaaaatatattggcaggttttggatgggaaatgaactgtgaagcactatatcgtcataaaacatcttcactcactgaaggatatatatattcatgggacttcaactagttaccaggcatcatccttaatgttagggattcaaaggtgaaaaaaacatggtctctccccttaaatatctcacagacatataaatgaagaattacttaccatgtgatatatatctgctaaaaggcctcagtttctcaaatgtacctaatctctaggtagctgttaaaataacaaatttaaagaaattaaacttaacagagtttatttgagcaaagaacaattcatgaatcaggcagcactcagaaccagaagaggtttagagagctccactgagcagtttgagaagcaaccttttatagcctgtacacagaagcaaagcagagaaatcacctgatgggctacagctaggcatctgctttatttgggcacggtgtgatgagttggctgcctgcaattgactgaaacccagctgcttgtgagtatctgaaacgctactctgtgtaacacttctaagttaggtttcagattgttatgtgggaactcagagtatggagacagcgttaacctaagggcctcctgcttatttaatttagcataactacaatcagattattacaagcggtagtgttggaagcaaatatgacctcagactgttccttctgcagaggcattaacatacacaaagaaatggccccgtccacacctagccatcaatttctaatcatgtataagaagcattatctatgaaaaatgcacactcatcttctcataggtctaacttctaactgttctctgctgggctcagagaatccacatttataatttaccacctttgtagaaatcataacgttggcagcctcaagccattcttagttttgggatgcagagcaagatctttattttataagacctcaatcatatgccagagttatggtaagcccctgaatagtacctcaggctgaggtgagaatgaattttaatttgtattaaagaactgttataaaagactgtttccgttcatagcttaatagcgagtccagtgaattgtgaagggagatgaatggtagggttggcagtatgggggaagggctgtgcaagcctgcctgtatttttatagagatctaagtattttacaacatgccattttgttttcattaaggcttcaaaatttacttctcagagaagagaaagtaaaccttccattttaaccctttaattcagttctgtagactatcagcccatatgaagttataggatcccttaaatgagtttttaaagtcagcaggtatatgtgttccaaattgaatactaaaacttatctttggcaagctttctttccttgcagagtggcagaaaatttactgggcctttaatgttttaactgtttcaaagtctgtaaatacaaaatcaaatacaaattccaaaactaatctctaatagaagtgcatgtaagtctctaaaggtaaacataggaggaattacctaactctgcccttgtttttctgggcattttcatgaagacactgagcttatcagtaggattagggaagagatgtgttccaagtaaaagaaataggaataagttaagcatcgtgttatataaaggcacacaatgccttctgggactaccagactacctgtgtggctgagggctattgggtgggtgataaggttggagaaaaaggcagctgtgtatcatagaagatcttacttaccaagctgaggattttgtactttatcctataggcagtggggagctgttgaagagttttaaagctgagcaaagacacaagctgctttgcatttttaaaaagatcactctgccacctgtgtgggaaaagtttgaatgcagggaaactagttagtattatattatagagcagggttgaaataatgaagaactgaactgagactatcgagatagggaggtacaaatggattcagaactatttattaaataaaacaggtggtacttggtgactgactcaggggaagaattttctggcttgggatatttactggagggtgattctttgcccctgttggacagaatgagcactcttgtccacaataagtacacttaaacataaaactctttagaaaacaatgggagggaagggagacaaaatatatcgggtcccttgtttgaggtagtggcaaggtgaagtcacagaggagctaaggattgtgcccgaactgtctaggtctgaagcctcccatttggccatactaatcatgtgcattttagctaaacatgttaccaccctcagagcctcaattccctcattagaaagtgagaagaataattgtatctgtgctgttcccctcataggattgctgtgatgatcaagggaaattgagcaaatgaattttcatccaggcactagccacattagtcattattaattgttcccatatgtgtattctattttaaagccttgaactcatgtatattgatttttgttgctatcacaaatcaggtagaaaatgtttatcagttcaggcaaatcccctgaggtcataagaaagctgtttgggctgagaccttctatcattcttagcagccatccttcttgtcatcataatcaatgtcacatatttttccttttattattacgtttataggctccctgtaaatggcagcatgtgtctaatcccatatgtgattttatacttatatgagatacttttctatctactcatagtggtatttctgtcttacatgtttcttctcaggagtgtggacaaaataatagccgctttatggtacacagatcagtagccaggcactttacataggtagtttattgtttctaataatctcattaattttgcaaagtgtgtgttttgatctagcaattggaggaatctgggctgtacccaaggcattctcacatccaagctcatcttctcacagagccttaatcacgttcactctgtacactgtagcttctcactctgttccccacttcccacatccactctgccacgaatctgtagattctgaaaggaaatttgagccttgttcacacgattcaatctgggaaacagcaccattagaaaaagaaagaagatgcttacaaatcagtgaccttcttatgcccttaaaaggctgatataatcttaaagaattctttatttcacttttaattaaaaccaagagactgagccctctgagaatgactcacaaggcatagcccctttctaagtttatgtagtagcttatttttcaaacgctgtcactccctttttgaagtaggtgatcactaaacccaatatgaattaaggaaaataaggagagattaattgactcccagagtgacagaggccactcttgctacatttggttttatagcctatttcctctgcaatgcaatctgtgaaagggtttacatggaaagaaataccccttgattttatattaatgcattgtctcaatagataatttcttaaatttacagcattcattgttgtccctcactattttttgatactagcgggaagatattctttcattaagaattcaataattgttttaaaagcacagttaacattttgtaatgtaaaggacaacagaaaacaaggaactcaccctgttttaaaagctcttatttactctgcacaacaacccaggcaggtagagtcaggaggcttcatgagggtcaaataccttgagataacagagttgggaagtgaaaccagattggttttactccagaattcctattctgtgacgttcaaataactccgtgataaagcaatctaaatttaattgattagctttttaaaaaaaagttaaaagtgagataatatctctatctgagatgatgtgaatattttctgttagttttagtatgtctgtttgtgttttgggagcaatctttgtatttactttagtaaccatcaaattattgggtagcaataagaaaacagagaataagcacagcttcaaaagcattcctttgtgaaggaaactacctatgagaaaattctatgcaaaaatcaccatggcaacaaattgtaggactcagaatcaagatagtaacgttaaaccataacacccattgcgtagatattaattaaaaccactgatgtgtattgggtgcccttaggtgctatgcgctattccagaagttttatatgtaccaactcattttaaccttataatgacttatgcggtagctatgatcatcccaattttatggaaatattacggtacatggtttgagaaacaaatggaaacaatgagatgagatagttgcaaatgaggtcatcagaaattacacttagaatattaattttatttgagcagaagttttgttttatttatcattttattccctgtgccaaaaatcgtacctggcatatagtactaatagtaacaatgacaatacagatgatgatgatggcaactatgaggataatgattacaacaatcactgtttatcatcttgttacctacccagcagaactttatacaaattaactcattaatctccacagcaacccagggaggtatgtgttattattatcccattttgcaggtgatgaaacagttagctaacctttctaaggtagaatttgaacctaactaggctggtactagagtctgtgtttttaaatgtgcttaataaatattgactgaatattatagtagtaattcttcaagtattgaattctgcttcagagaaaagtacaccccattaaacaatagtcacatctttttagtagataggtgatatatcaacagatgactgattgatatatgaagatagatagatagacagacaatgaatatatggttaggaaactagactctagaacacaaaatattagagtttgaattttgcctccacaactttctagctttgtaaacttgagcaagggacttttctaaaaggtagcaattattgtagtatcaatctcatggggtacctataaggatttcaagaggttttatataaagtgctgagagcaatacctgataaatatgaagtgctccataaattttagctatcattatatttgtatatgtgagatgatgtattgtgacccccccaatagatacctcaggctgaggtgagaatgattttttttcaaaagactgttataaaagactgtttccattcataacttaatagtgagtccagtgaattgtgaagggagatgaatggtagggttggcagtatgggggaagggctgtgcaagcctgcctgtatttatatagagatctaaatattttagaatgtagaattttattttaattaaaagattaaaatctgcctctcagagaagagaaaataaaccttccctatcaaccctttaatttggttctgtagaccttcagctcatatgaggtttaaaggatctcttgaagagggcttttaaagtcagtaggtgtgtgtgttccaaattgaatactaaaacttaagatcactctatgccagaggaaatgaataccttagagggtaaagaggaattttatggcttgcttttaaaaggagagggtacactgggccactactaagcggccaaagcctttgtccaaattttacgaaggctccccttcttctggcacgcactgtgtcagggtctgtggcatggtgaacagcattcagactagatttcagccctaactcatccccgtgaccaagtgttctttgagcaacctgcctaacataataaattgacccaaatgaagatggatatcaggatatgaataagaatttcatttctctgtgttatttagatctccttcaaattcatctaattcatgctctgttttctttcctatgcctccggcataattgtaaagatattattccatcagccttatgggaaaaaaataactagatgctaacataggttcagagatggttgggtacaaagattggactaaacagtttagtccaacctctatattttccagatgaggaaactgtcactcagaccccaaacaggcattaaattcatattataaggttagcacttctgaggatatgcaatccagatgtggctgacccctgttctcagaagatttagggaccactggacctagagagtttcttttgtggatatagtcaacagccacctgtaatgtaaaaaaggagaaataagaaaataaaaggtctagaaatttattatggatagaatatttcaaatatgtatgaattttaatcagcttctgccttatttattttggatccagcctgatttttttccatagctatatatagatttgtatttattgaatgctgggtattcagagactctgcatgggaaacctgaaggtcagatagtagccccgttttcctttctatctgaccagttacttggtaagttcttactattctcaccatcagtgaaatagtacagggcctatggtacctgtagaccctaagctacactggacatgaggaaagcagctgtgaaatataaaacagagcctctaccagatttctaccattataattgctggagttctgtggttattctttccctccttatagggcctgttggtgaatcacaagatgtcctaggcaaccatttccacactttcacaatacaacactttccttattgttttcccatagaaatctcctcacttacaagaacttccttactcttctcacctttgtcactgtcccaattgctttgagtgatgttatgttggatatgcatctcctttcccactcttgtccacactggagctccatgttgacgctagacttctaagaactgggcagtgtctggcagaggcaagatgagaagccttcaatttattttacaaagactttttttttttgaccaagatttttccaccttgggctgtgacttcacagaggggagtctcatgttacagcactgagatccccactctgccctttgacaggcgccgtgtgggacccatggtcagctgaggcctctttcctcaggcagggactttacttcactttctatcttccacagcagctctgttcctgtgctggccaggttccctgccctgattttcatactggagccttttcctctgggattcttgtgactcataaagtcagcctctaattcaggcacttttcccagcagagaaacaaaaaagacaaacatggacgtttctgttgttgttaagtagcattaacattcaggttcaggagcaacaaaccttttcttagaagacgatataccttttaaaaccctgaagttaaagaattaccacaggaagaatggggatggcaactgtaggaaatcaggataggtgtgagtgaatgccttggccactgaggcctcaggcagctactggtatccaataggtcgagagcacctatgaacctccgatcaaagaccttctgctgtaaatcatagctccacaatgctagttgtctctcctgagttctcacctatacgtatactgttggtttcttctttccattctctgtaaaaggccccctaatgtatctcatgttcttgctttagcccacagtgagacctctttcatggaatgccatggagccctctctctttccctaggtcaacaagtagaaattcacatgtgttcaagatccaagctctttgtaatgggacatctgccttctcacattattactgttttcagaccctacctttctgcttggtaggttcaaaatcagctactaaggggacttgcaaacaatccttcattcttcttcatgcactttcatcccataatgcctaagggaataatgaacttcaagaacagccagaatcgaattgtagattttcctctagtaataactgtgtaactctagtaataactatgaaaacagaatatatttctgtcatctgtttaaaggtaggaaccatgctgtatgttatcatgtgacacatgagcacgtagtagacattcattggaatgacaagtggtgggtatttacctacgactgtgatttatagtcttatagctcaaaggaagagttcacatttaatggaagctcttcttcaggctcaaggatatgtgcggaagaactggcagacagagggaagtccttccagcagggtcagatttcatccttgttctcttgggggatggtgatgcacatagtttcccctgggattttttgatttcagagttaggacacagaaactgattttcatcaacccatctattatgtactataacagtgtctgctttttgttaaagtctttttcatctatactaaacatgtgtcaatatcagatgctctggagaagtttcaccatatgtggatgcctctaacataggttaggtcattgtaatgagcatgactagactttgaaaagtagaatcaaggtacatagcaagcaaaattctcagccactctgattgactctgtaaaaggtaataaaacaaaaactattcagcaaacttagaagattgaaaagaaacaaattaagacctgcaaaaggactttattttcaacaccagtaactctgaaagtttgtttagcatgctaagcaaatgtcagtggttggcaaggtgagggtaattgtcattgcctttctctgaagttccttctaccaatgataagtaaaaagaaatggaaagaaaaacacattgcaaataagcctaaagctaatagtgcatcctcaggacccttagtattattaaatcatataatgcttgacctgaatcagaaaactttccacccaaacacttaaaaaattgagaaaataactccagcaaaatcaagagactcacccaagatcacacagtcacaccagtagtctgtgacggatatagcagttgggtcagagacttcaggtggtagtgctttttctcattcaccagcctgtaatttcagctaaacacaatctaccataatgtttcatgttaagaaacatggcctatcatagagcaagaccggaaggaaggaaataaaacttacctcaggttaacagtgtttacctcagggaagtatgattgggatggggaaagaaattatccttcactttatacaattttaaattgttttgtctgtaagcatgtttaagttttgttattaaaaactaaatttaggctgggtgcagtggctcaggcctgtaataccagcactttgggaggccgaggtggacagatcacttgaggccaggagtctgagaccagcctggccaacatggtgaaaccccatctctactaaaaatacaaaaattagccaggcatactgtcatgatcctggaatcccagctactcaagaggttgagacaggagagtcacttgaacctgagaggcagaggctgcagtgagccaagatcacaccacagcactccagcctgggcaacagagcaagacttttgtctcaaaaaacaaaaaacaaaaaaaaaaccctaaatttaaaaatctcccattaggctcagaatttcagtcataagtatgcacccaagagaaatgaaaacatacatccttacaaagcttgtatacaaatgttcatagcagcattgttcataatatagccaaaatatggaaacaacccaaatgcccatcagctgatgaatggataaatagtatgtggtatgtctttataattcaatggaatattatttaaccagaaaaaagaatgaagtactgatacgtgttacgcatgggtaaaccatgaaaagattatgccaagtaaaagaagacaatcgcaaagagccacaccttgcatgattccatttctgtgaaatgtcaacaataggcaaataaatctgtagagtcataaaatagattagtgatttcctggggctagagggagaggctatgggaattaggagatgctgatcatgggtatgggatttctttgggagattatgaaaatgttttaaaagttgaccatcatgatggttgcacaattctgtaaatatactaaaagccactgaacaatgcactttaaataagtgattttactgtaggtaaattatatctcaataaagcttacttaaaattcttacttaaaagttaaataatttatatagccacagtgacattaatactatgtccttataatgtcaaatattcagataaaaataataaaaaataattttaaaaagttttaatttgtctatgaaaggttattcaaataaattattcagaagaaggttttcagatttttacatttttaacatggctatagttctcatttactaactactttttgtttggtgttttgcaaaaataatcactaatcctaataataaatctatacagtaggtatttttatttctatttcactgataaagatgatagctaccagagctgagatttcaacctagttttgtttgcttttgctacactacaatcatcattccattacataaaactaatccttaatactctccttcccagccagaagagttgtctacactatctcttctttcttataacccatttactcctcagagaactggagcttaagttctgcccccagccctccactgaattcatttgcactaaggttgccaagattctttgtttctaaatccagtggaaacttttcagtccctatctaatcttattttcctgtacacttgcctctgttgcctgctccttcctaaaactttttttaaacttccagaatcctgtttccaggctcactgttgtgcttgcatctcagactttttcttctctgtctcattaggcatctccttttctcctcatcctttatgtgtctgtttcacccagtgattccttccttctcttcctactctgcacacccacctgagtggaacacatccacacccacagatctgattttaaactatgtgcctatgtctctcgtctctatatctacaattagatcttggctccagacatacatacctaccggatatcgatcctcaaatgctctgaagcacatcaaaaagtatgttcattacacttaccattcagattgttgtctcctgttaaatccactgtctaatgaccatcaacagtgtggggtagcatttaagggcatgtgcttgagttcggatcctggctctactcactagccgtgtagcctctttatgccttagtttccttatccataaaatgagaattttttaaaaagtatccatctcataggataataatgagggttaatgagtttatacatgaaaagcatttggcccatggtaagctaagtacttctgtggaaaagagatcagagatcaagttaaggcaaatcagtaggaggaatctagaaaaacatcttggtgttataacttgatctctgtgtcttggtccatttgcgttgctataaaggaacacctgtagctggataatttataagaaaagaggtttatttggctttcagtcctgcaggctgtatgagaatcatgatgtcagcatctgcttctagcagaggggagccaggatcacatggtgagaggaagagagcaagagagaagggagatgccagattgttttttacagccagatcttgcaggaactaacagtgaaaactcactcagtctcccaaaaatgaccccaagccatcatgagagatctgcccccacaaccaaaacacctctcccaggccccacctccaacactggggatgaaatttcaacatgagtctcagaaaggacaaatatccaaactatatcaccaagcatcatatccatatatctttaatatctcttgaatgatttttctgcagtctttccatattatctccagtctacatccaactagaatcactgctcatctgaagtatttacccactggttttcaccacagtctgtctatatgcacctgcaattcattatccacactgtagcccatgtggagcattctgcattgcaaatctggttgtcattgacctgattaatcttccaatctccacatcacctgtccttcagtcatatcagttctttcagttcacagaaaaaacaaaagtctccctttctttgaggtccttgcttatgcttccattttgaaactcctcctccctctcttaatgggcacatgtaccattcacctggccacctcattaccagctcccacaaacaggtctgttcacatgagtaactgttaataagcccaagaaatgtgtttttggtggtgccaccagaaacccctccctgaagttctcagcatgggtgaggggacctcctccatccttccaaagttatagaaattagcctacattattattattattaattacttgatttccatgtttgccttatcaactagactgtgagcttcttgagttcaaggactctgttttaattatttcctctatccctagtgccagcaatgtgcctggaaagtattgagttgttggttttttaagcaataaaaaaaatatatttaaatcattattcatttatttactcccataagagccctgtatttggtgatcctgtgaaatgctctgtgccatcaactgagaatacaaagataaattagacttagctctttcctgaagagactcccaatctaacagagaccatagcagacaggaaaacaattagcattccatacaaagctgctataatcgagggcatattctgacagggtatcaagaatggaatatgttaatttattaacatgattaaaatgagagagaagttaagggatgtttacacacacacaaacacacagattgacactgagaagtctgtgggatattaactaatggggtcaggtgactgcattcaatttgaattaaaatagagatagaaacctttcttggacataattatagccctcactgccttattcttcccactatttaaattggctccttaagctcttccccaacctttgacaaagccgcgggcatactataaaatattctatctgtgtaattccagcactcatggatgttctctcagtgttttcccaaattcgagtccatagagttgagctgattcatggccaaatttctgctggcctggggcaaaaagaaagaaaagaagaactttgcaatgtacacatacaaatatcagtatcgggttgcccattgtccttccttgggaggaatccttcctgagattggaatctccctttaattttggtgttaaaaatattttattttatgaaattatggtgatgatagatagtagatattatgttaacgcgcttcatttaaaaaactaaaacgtggatttgtcttcaggatttttcattaaaatcgttcctgccactgtgtgttcttgatgcagtcccccagtcaccctcttgaaatcagctagcactcttttcacggtgccattttttgtacactcatgcacaacatttggtagacactgtgtttgaacatctgattagttttggctgtggacactattttcaaaagcccttggatctaggttttgcagcctgtagtccagacacattggggacccaaacaagacatcttaaagataacaacccagtcataagttggatgattactatatatacaagtcgtcatcaataatgttactttttggtttttgtgatgtccctgacatcacatatgtctccatttgacatatgtctccatttgacaaaaattttatataattttgatgacatttttatttttttctttgttttctttttttctatatagctgcattatatgacagcccttgtatgctgatagcccctcagcaagtgagagtatataagtgcaaaatatgattgccatttttgctcttgtgttttatttgttgctgtttcaataattcttttttttccattgctctaaactgcttatattataacctttggggtaggaattaacaagttatctgtacagctttcaaaacaccaaaataaggaaacacattttgtaattgcactgtcaaaaaaaagaaaacaaaaaaaaaccttttgcttttcttttagtaacaggcataaagaatgtcattttatttcctaaggtttttttcctctaaattaatccctcactattttcgctgattcattatacaacgctagccttattagagaacactttttgtagctctgatcctgctaaatagaaaaataaagtgatttaataactccatattattaaatgttatgaggctaacattgaaatggagttgagaattacagaggcaacagaagctagcagtaacacatgagatggacaattttgctgtaaaaccagcattcttaaatgtcagtcattaacactgtgtatacagaggagctgatctgaactgcaaaggaaaaatcccacacattaaaaaataatgaaagaaaaaaaaaccttagttcatagaaacactcaatctaagacaagttacatgaggagtagaaaattataagtttagcctgttagttttgctaatatgaaactgtaccctgaaggaaaaaataactacggtaaaagcaatatagaatgataattatattttgttatacccaaacctacacctttgccttagattgtcattatttgacttctcaattcaggcagttctgtctattgtcagcttcattcccctgttccttcctctctctgcctctgcccttgctattcctctacactgagctactttcccatctttctttggttttcataactgtatcagtataagaaaatctagctcaagtatttattatttacatcactttttttcttgagcacttctacctttgtgagtgcctatcttctttggagtcatatcatgttttgcctactttaggccaaactattattgctcaattaaagattactttgtgtaatcggcaaatcattcatttctgtggtcttgtctcattaactatattaatgtaaacctcttgaatatagaggcccttgatatcaatttgttggtatccccataaaagtagaatagtgccatacacatagtgggttctcaaatgttcagtgtgtcatctttaataatcatcacgacaatgatagctgtcggggcatgaagagcaactgaaatgtcttctcaaagtacctgtatgaaaaccacatttttctctaagttaaaatagctgtactttttccttgaataatcttttaagtttttaaagtattaataattgtacatattcttggagtgcagtgatgtttcgatacatgtaatgtgtggtgatcaggttagcatatccatcatctcaaacatttataatatctttgtgttgggaacatttaatattttccttctagctatttgaaactatgtattattgttaaatgcagtcattctaccatgctacaggacattaaattgaaataacaaagaaaacaagttctccacggtgcttccaggaccgttcatttgatgttcatgtttcacaggaccttgacttctttagtagaagaaaagttaaactttaatgaaaacactgactgaccattaatcgaatattttcttagttccaaaagttgtcagctttgaggtcattttatgtcaatttgatgactctaaaactcttctcccttaaaaccacacttcttgtgtcacagcatagtgtatccacacttttgcaatgcacattaacttctcaaatactctattacagagctcagcagctgcagttctcctacaggtttgacaccttttcagtccaacttttcaatgtagtctacactccacttcacttggttgatttactctgctgggtttattactgaactgttcatttaatttaatgactaacaaaagactcagataaaattctccatcctgtttttagagcctagcataattagacacatctcccacatcttcagatagcaaatttaattagaatctccagtggatcactttctagggcaggaacaggacatggagacattgaggctgcttccctggagtagaggaagagtcttcccaagctttctttgtattgacctgtatcaaatgtctcagaggaagattggaacagaagataagcctgtgatatattcaaacccttgagcaatactgtctccagggatcaaagtccttttccctcaaccagtaatcatttgatgaagcataacaattaatgacccttgggtccagcataagtctctcttttttcagatatttaatttctccccatttcgtttcatcataaatttaaaatttgaaatggacatcagtaattttgaaaagttaaacatttatttattttataacaatccgtagtttctctgccttcttactttttactgccacattatatgaccttacggcttttcccaaacttactctgctttcttgctattcaccagagtggatgtaagtgaggtctttgacagtggcttccattgtcagttgcagtgctaccagtctagcatggaatgatactcagtttactgccacgaattattatactcatttctctgattaattactatttgcaaaaaccttgcagctggatggaatcaaagagcgttagcactgaaaggagtctcagacattatttgtttcagtgctcagtgtataatgtacagatgggaaaacagtcccacaaaagggaaaatggcctgcccaaggttgtgtagcaacttagtaataaatgccctactagaacaagggtcttactgctttcacgccaattgtcattccagcacctaaactgaaatctcttgaatagcatatggcataaaaccttgtatttcctttcattccttcaagatgatactcagtgaggcaaggatgcagagtctgcagaggctaaaaagctgcatatgagggtggtcatgatagctcatgcctgtgatcccacactctgggaggctgagacaggaaaattgcttgagctaggagttcaagaatagcctgggcacatagcaagacctcatctctatgaaaaaatgttttaaataggcaggcatgctggcacaggcctatagtcctagctactggggaggccaaggtgggagaatcacttgagcctaggagttcgaggttacagtgagctgtgattgcaccactctgctacaacctcggtgacagtaagaccctgtcccttaaaaaaaaaaatgctgcatattgagtcccttcctttggccagtggcctactctaacagtcatgtgcaataatctttaattcaacaaatacttactaagcaaatagtgtttactctgctaggaatggctcagttagacaattgtgggaagataaaaaaggacactatatttgatctctaggacaaatgctaatcgtgggtgtgaggcagatgaaaaatatgctctgtttttgtaggtgtgtatgtgtatgtacatgcgtgcatatgctcgtgtgtgtgcatgcatatatgctcatgtgcgtatggagagagagagagaaaaaaagacagtcataatcaatacagggtgcttcaggaggtgctgagaagagaaagatctcaagtgttcagaggaaggttaacatagtgggaagacaaaggttggtatccgaggctgaaaaaaaaaagaaggtgaaataacttgaataaaggaatagagatgagaaggcatctatgaactcattcacttattcatacatgtagtgaccattcattaaaagcttattctttgccagatggcaataagtatacggatacttagatgaaaaaaatgttttctgatctcaggggatacatactctagaccaaacttctaacactttactgtgcataagaagcaacatttccaatgagctctcaggagatgccaatgttgcaggtacttgaattgcactttagaaaccaataaacttgcttataaaatgatgattataatataacatgacagttgccataatggaggcaagctacttgggaagctgaggagggatggtcagttgaacttaggcaagggtgccttgggaacggagagtggaggtgctggtggcagttgtctagatgagcttgaaggtgtgtgcaaagcagcagcagacaaggccaaaaccataaactagaactgtatataaaatggagggccttaaattccagggcaggaaggaactcaggcttgcttataaacttcttgccacatttcctgagtgtgatttttcttcctttaccagtagtgtcagaaagaattaataattataatattaataataataactgaccattattgagcatgttgatgggccagcactgggataaacctgttacatacatgagctcatttgatctcacaagcatcctatcaagtaagtcattatccttcccatcctattatgctgttattgtcctctttttcagaattaaaaagcaaaaatagtgaagcttagagagggtatctggatatttgaaaataactctcgttcactccagggatgctatcatcctaatttactcagtgtgaaccaaaggaaggtcacatgatcttgtattctcaattctattctctattatttttgtattttctatatacttctgctatcatactaaatagtaatttgtttacctgcccatattcctcactgtgctgttttattcctattttattccccaatgtttgggatatagtaagtgtttggtgattaactatattctaattcttctgcaatgtgatccttctagtttctttcatgccttctttctcaagatgtttctcccacattaaatgttctctcatttcttctttctcaagctgtttctcccatattaagtgttcactgtttaaaacagtcttcacattgacaacttcagtgcgagatcttcaaatgccatctcctacatggatctttttctgattcttcctctgcagaccttggaagaaactggctcttccttcttagcaatttcatagtatttttctggtacctctgttatagtacttttatcttatattaggtatatacggtaatttctgtgcttattttatgttaccgataaacttgaaagtcccttgcagaaggagtaagccctgataatgtggttattaagtggttaactttcggagccatactgacaggggatatttttaggctttttttgttaggttggttggtttttgttttcttcgttggtttccagtacctttgctcattgacccaattaccttggtgaagtttcttaacctcgatgagattcatgtgtaaagtggggaaataatgtttacctcgaaggttatctggagaattaagtggcacatataaagtgctttgcattgcctacacagtaagcacttgatacatggatgatattgttggtatcctttgtgttctacccacatcacactactctctccaaaagtagatgctaataatattttggaatagatggatgaatgaatgagtgatcaactttcttatgaggcttacctcctctaccatattgtaaatagtcctattatacttccgtgctcccctatctcccgaactatgtatgtatgtctttattaattattgaaatcttggccaggtgtggtggctggtgctggtaatcccagcactttgggaggccgaggtgtgtgtgtgtgtgtgtgtgtgtgtgtgtgtgtgtgtgtgtgtgtgtgtgtgtgtgtgtgtgagagagagagagagagagagagagacatctactatagcaatcttccagttagcaagctggaaactggaatttactcctaacaaaacagaactattcacaaaactatttataacttttattttgtgagcttttatagtgcaaaactatatatgtatatatatatatatatatatatagagagagagagagagagagagagagagacagacagacagacatctgatatagcaatcttccaattagcaagctggaaacttgaatttacttctaacaaaacacagctattcacaaaactatttccaacttttattttgtgagcttttatagtgcaaaacaatataattttactaaaattgcttctttaaaggggaaatttgcatattaaaatttatttggcccaccctatcacacagctgcataacagtatgttgataatgtacaaatggcttacgtcaaaggtgaattagaccattaagatgtaaaaagcaacaacccatcaaaagatgataatgaaagttcattggggcatttagggaatttagtgagtagaagtgcttaacaataaattaggcaaaatgtttcaacttagttgattctcaataagtggtccataaaacatatatgtaagcaagaatgaccatgttaaacatgtctgcttattcactacacttcttatcatctgttttgctaaaagctttggagaacaaagtagacctcatccctttgctgtgggtctctgtaagatggaagacataccatatataagccatcacaggattcctcagttagtcatacaattaacataaattgtgataagtgctgcaaaggaaaagaccagagttccttgaggaaataagactagagggaaggtcaaaggaaggtttttgtaaggaagttccatttaatggagccccagaggatgggtaagaatcagatcaaaagtgagagaaactgcttaacagttggactaatatgtatcatgacccttatttcttccaaaccactgagcccctgcctcagtttcctcacctactaagtggtgatatcaatcacatctacccaataggatcaatgtgaggattatatgacatgtaatatgcttagtacaatgtttgccactcattaaatattagccattattattgttgttttagggtattattattattactagcaattttatcctaaatgcatgggatgatactgaaagtagattaagctggtttaagcaagggaatgaatgtcaagaacaatgaaggacctcagattttttacttcattttcagtctaataagtaagcctcctacactgtactggatacggacagaagattcttcactcctgaatcagagactttattacttataataatagctgtagccagaataaaagcattttcagcagttccctgagctccagttcccacagtgcaacacaaagaaggccaggtgatgcctgcacatgcaagtggttgtgttataggaaaagaaccccaagtgtagggaacttgaatcttttattaggaacagtaatcctgcctggtctttactatggagaaatgcattattgttattatgatggatggttaaaaaaaaaaagtaaacaaaagaactagttccagagatactgtgtctatctttcaaggctgtatactatacaaatatctttgaaaacatagcccagaacaaagacagtcagtgcttctgctagcaacatgtgcagaaatgcaagaggctcataaatgtctcccaagaattatataatcagatctgatgttttataagatcattatttaagctgttaaatttataagtatttgtaaaattttacatcttttacttcattcttttacatcataaactttttttttcaaattgtcacattgtgcttataacactaatttttataattatacagcacagtggtcctcaatttgtccatgattttgcatatcaatcatggtctaaaaatattaaatggaaaatttcagaaataaacaatttatatgttttaaattatgtgccattttgtgaagcatgataaaatctctcactatcctgcccaggacccgaataatcccttagtccaggtatccatgctgtatacactacccaccctttagtcacataggagccatctcagtgaccagatcaactgttgcagtattgcagtgcttgtgatcaaataacccttattttacttaataatgcccccaaagcacaagagtagtgatgtgggcatattgtaatcattgttatattttattattagttattgttgttaatatcttactgtgtctaatttataaatcaagttttatcatagatatgtatgcataggaaaaaacacagtatttgtagggtccattaccacctgcagtttcaggcatccaatcttggcacatttccactgaagataagaagggactactgcatatcaataatataatccacaataatttatgtagctattcttgaatgacaggaggtttagtttgcttctaatttctggaaatcaccaatgaacacttattttaagatgtgaattggttgaaaatataaagcaactacactcattgtggaaataacagtacaaatggcctaggaagaattgcttgatgctgccaatttgcctaagcccccagtttccaataagggatggtgttaataaaggaatatttttagcctgattgcaaaggtttacaataaatttcaataaagtgctcaggataaacatacaacaattctacttctaccagaaacattttctgagactgagaatcaattaatactatttataaaaccataagaacttcattctatgaaattctacccagagagaaggtcaggagtaacagaatactctatcagatgaagctctgtacatatctaccttcaaatattcttgatataaaatgggtctgataggttttttcctacttatttcaaaaattaatttttagattagtactcatatttgttacctagtagagagtaatctttatatgtctaattattagggagtttactatatagcattagttagaatactagatcatcaaatttaaagctcatatttactgctaaggaaactcattgaaaagataaatgaattgtccatatttataaaattaaatcaatacctgttattgagcatcttctgtattaaagaggctgtggttgcccgataacacatttctcatccagaaatacctacccataaaattgggtaaaatggagatatgatttgttgtatggacggtgctatgatcatagaacaatggcaatggaaaaaaataaatgtgtgtgaattatcctgactgagaacgtaagaaaaatctcaaggaagctgagcatttgagtcaccacatctcaggaacataacaactcatcttgcccactatccatttagaggtttaagactcttcagcatcatttccagttccccataccctgcttttttatcctcaggggcaggaaactgaatctcttcatattgtccaatctgccttcctatattcctggggattaggaagggttcccttgggatgcatttctgtcttcctaatacctattagttttagtgctaccttctgggaccacacagtggaagtccactgcccatttcagatgaggaggttgcacatgtttacaatttgcttagagctttcccttttctagattaaacatttccagtgccttctgttgcttttcatttggcatgatttaaaatcacttatcattctgatcttcagattgaagagtaattgtttctgaatccaaaatagtaccccttgtgcaggctgattggtgagtaagagtgtaaatattccctcccttgttcttgatgctacttttgttaatgtagcagtttttatatccatataacaatcttgattcattcaatcttgattcaaatgaaccctctaaacttttattttccaatgaaggctagtaatctgtggtgggtactacagaatcaagtacagcaagaaataggagataggggagggatattccagaacaaggggagccatatataaatgcctagtggcatgaaagaacatgagatgtttgagaaaggctgagtagcccagagtgaatacattatagaatatgcagagggacataaggctaaatggtggatcatgaaaggctttcgaattacatttgtgaattagtgtttagcacgattactttgataaaattttaaaggatgaattcaagaaaaaaaaataccttgaatagtggaaaagtagttaataatggtgaaagtaataatagtaataatatttagtgattaattgagtacctactatatcttccataatatatactacatacattgtgtttgatgtcacacaaaaaaaaatcatgaagacttatttttctcatgttgtggatgaggaaattaaggcttagttaagtggacttaccaaggtaaccaagctattcagtggtggatcctggatcaaatccaggtcttctgactttgtctttgctacactatgacaacagcagatggaaactgtattagtaccgtcagatggaaactgtattagtcattttcacactggtgaaaaagagacatacccaagactgggcaatttacaaaagaaataggtttattggacttacagttccacatggctgggaaaacctcacaatcatggcagaaggtgaaaggcacatcttacatagtgccagacaagagaagagagagcttgtacaaggaaacttagtttttaaaaccatcggatctcgtgagacttctccactatcacaagaacagcacaggaaagacccacccccatgattcaattctcttccactgggaccctcccacaacatgtgggaattctgggagatacaaaatgagatttgtctggggacacggagtcaaaccatatcattctgcccctaccccctcccaaatctcatgtcttcacatctcaaaaccaatcatgccttcccaacaacccccaaattcttaactcatttcagtattaactcaaaagtccacagtctaaagtctcatctaagacaaggcaagtcccttccgcctatgagcctgtaaaatcaaaagcaagttaattacttcatagatacaatggggctacaggcattgggtaaatacagccattccaaatgagagacattggccaaaacaaaggggctataggctctatgcaagtctgaaatccagtgaggcagtcaaattgtagagctccaaaatgatctcctttgactccatgtctcacatccaggtcatgctgatgcaagaggtgggttcctatggtcttgagaagctctggccctatagctttgcagggtacagcctccttcccagctgtcttcatgggctggcttgagtgtctgccatttttccaggcacacagtgcaagctgtcagtggatctaccattctggggtctagaggacagtggttctcttcctgcagctccactaggtagtgccccaaggtgggagctcctaccccacacttcccttccacactaccctaacagaggttctccatgaggcccccacctctacagcaaacttctgcctgggcatccaggtatttccatatatcctctgaaatctaggtggaggttccaaatcctcaattcttgacctctgtgcactcacaggctcagtacaacatggaagctgccaaggcttggggcttgcaccctcagaagccacagcccaagctctatgttggcctcttttagccatggctagagtggctgggacacaaggcaccaagtccctaggctgcatacaccagaggtaccctgggaccagcccacaaaaccacttttttctctttggcctctggctctgtgatgggaggggctgccatcaagacctctgacatgccctagagacatttcccccattttcttagggattaacattcagctcctcattacttatgcacatttctgcagctggcttgaatttcttctgagaaaatgggattttattttctatcccattatcagctgcaaattttccaaacttttatgctctgcttcccttataaaactgagtatctttaacagcacccaagtcacctgttgaatgctttgctgcttagaaatttcctctgccagataccctaaatcatctctctcaagttcaaagttccacaaatctcttgggcagggggaaaatgcttcctgtttctttgctaaaacataccaagagtcacctttgctccatttcccaacaagtttctcatttccatctgagaccacctcagcctggactttcttgtccatatcactatcagcatttttgtcaaagccattcaaccagtctctagggagttccaaactttcccacatttccctatcttcttctgagccctccgaactgttccagcctctgcctattaccaagttccaaagttgcttccacatttttgggtatcttttcagcaatgcactctaatcttaccaatttgctgtattagttcattttcatgctgctgataaagacatacaagagactaagaaatctacaaaagaaagaggcttattggacttacatttccacgtggctggagacctcacaatcatggcagaaggtgaaaggcacgtctcacatggcagcagacaagagaagagagagcttgtgcagggaaactcccatttttgataccatcagatctcatgagacttattcactgtcatgagaaaggcatgggaaagacctgcccccatgattcatttatctcccaccaggtccctcccacaacatatgggaattatgggagccacaaggtgagaattgggtggggacacagagctaatccatatcagagaccaatgtgaaaatgttctaaaagtagaaccaacatcacttcacacctccagaaatgcaggagagggataaatcctacatgactgagctttttggcctgtgagatcaagaagacaggatggtgtttggagacagagatccaagtgcagtactgaaaagtctcttttcaagaagtgagactggtgactctacctaagactacaaagtttcggagaaaaatctcaggaattaatggatatgcccttgataggctaatttccccagaacagatttagcaacaagagtaagtcatgtattcaaagatgattacctttgacatttatttatccaaagatttaacttgaaaatatcctcattcactgtatgcaaaaagtactccacagacagtataaattcagccatctgacacctggtaatgggagctgtgctgtttaatcctcacctatcagaacagaaataatctctcatatatttatgatacttggtagggttgttaaaataaaatgtggacaatattatccatattatgctatagtcatattttttctgaattatacagggatatgaaaataagtagataagtgcagtttgatgaaatagtaaaattaataggaccttgttattagtctataaatatttgaaagatgttaacatctgagaaagacaagatttatttagctaaaatagaagaggataccttgtgttacaactatgtaggagtaattggagaaggatagaggtagttggagcaattgtatcagataaatgttaagttgattattggaaaaaatactcttgccaatgagatttattttttaaataatatctcatagaaagtaataatagaaaaatgaaaaaagaataaaaaacagtcctttaatgtatttgatcaatactagcatagactaatgaaagtatttaaaagaaaaagtctccattatcaatagccttattagtaaatgaagaaaatgtcgttatgacttttctatcttctgagtctatacaaaaacaaatttataatttacaattttagacacaaagtattaactaaagctccctagcatgagaaaatcagtcattatagttttcttgaggtaatggaaacttatatttacctgaatgtaataaagtcatttttatatttacatatccaatatataggtatacacatacatatgtgtgcatttagatgtatctctgcaaatgtttataaatatatatttatgtttagtttataatttatgattcaaaaattctcacatttacacatagatctctattatttattatagttcctaaaggatacttttatctgcaaattttgagggcagtcagtcaattccccaaagttcccaaggccctttgtataggcaacatttacagtaggtaaaagcacagcctttggactttaacagactaaggggcaatcctatctcttactagtttttgtgactagaggagacaaagtattttacctttccaagcctcagtttcttcatcgcaaaatggggatgatacaaccatcaggaggattaaataagataatgtgtataaagcaattaacaaaacacattcaacatagtaatttctaaataagtagtatgtattctcattattattttagttttcatttctatcagttcccaccatgacaaggcaagctgaatgaggacagggtttgtttgtttgtcttgtttttcattttattcactcctttatctttgggtcctagagagtacttgtacatagaacattcagtaaatatttgtggaataaatcaatgggtgattgatttaatgaataattcagcctccactttatcaagctgccctgtatagtaacaaatagtattttagtattcaagtaaattttagagggttatttagagagcagagattcaaagaaatttatgtttcaagtaatttaacatttaaaatatcagagtttttatagaatacacaatttgggtcctggtagttttctttcagtatcagtttaggttcaaattagtggttaaaggcattggaaaacaaagtatccccttaagggtagtttgtgttcttccctttgaatcaatgcttttctgttttgtttgtttcctcattgcttctttcttaatatttttatgccacaaagattcaaatccaagagttgtaattcagctatggcccaaataggagtaactaaccaaagccaattaacagtaaaatcacatccacactgttggatgtatccaccacattgaacttagctctgctggctagcagtggctctctgcttctctggtttcaaagctggagaggaaagcgtgactaaacatgaatgttattatcagtattattgaataattcatgttattgaataacatgagtgttattatcaggtgaccagcatctattaaaagtgatgctttctgctagtatggaatcagatgaaaacttttataaacaacctagaaatttagagcttaaaaaatacaacactgcttaatgacacatgatttttaaaaaatcttgtactgtagtttcaagctttatattttgccctagactgatttattatacataatttcacatcatatatttacatacaataaacttcacccatttctagtgtataattcaataatgcttagtaactttacccagtgttacatccatcaccataaatcagtgataaaccactttcatgcccccagtaaatccctcatgcccacttacaattaatctcctttcccaccccagccccagacaaccactaaactattttctctataaaattgcattttcttgattaacctctgtatttttaatattcattaattaataaaaaactcagtcgtaagagaatgtagtcagacttgtgcctgtttacggggtcaagctattttcttccttttgttttgtttcacaaaagaaaatatggctggtccatctttcacaaaattaacttaaatatgacatttgactgtaataacagtgagcatctttatgtgggcagattaagattctgtaatttcatgctcagctgcgttgatggctttcagccttgtttaagcagaccagctacggacagcagtaaaccctataatgtcctgccatggctaattgcttaaatcgtctacctctgtaacttttatggctgctatttcaactagataccttcaataagatataagtttattggagcagagcagaatctatttattgtcgttttcatattttattccaaaattaagtttcaccactgtattctcaagtggcagtaaatggattcttccattatttatattgtcctttttagtgaatttgtggtataatagagggtatatattaatttcccccaccccttgtcaagtgtactgtatacataagagagtccctggtatattcatttgacttcattaaatgcaagtacaaatggttcgtcttgataaaagtgagtatttttgcttgggaactcaatggaaatgatataactagcattacagtgttcagttcaatagatgggaactgtgctagacatggggttgggggtacaatggttaatgtgttatggttgcagccttcagggagttcacagcctagctggggaaaaagacatttttaaaatagtgctttactgctatgtgggaaatgccttgatgaggacatgcctgggtgctgtggaaacaaagctgagagcttgcaaattcttttcctgaatctgagtgtgcatgagataagtcctgaagaatgaatagcagcaggctgggtaaagaacaatagcagggactgtggctcttgaaatcatcttagtgcttcctttggagttttgcctagttgtcaagtatcatgtttaaagggccctgtgtgaagaaaatggctgaggttttcccaaaataaaagatgtttggaaatggctgtagttatgaagtttcgctcacctaatgaatgtttccactactgtgttaaaaaagacagtagtggctggacgcggtggctcacgcctgtaatcccagcactttggaaagccgaggcgggcggatcacctgaggtcaggagttcaagaccagcctgaccaacgtggagaaacccactctctactaaaaatacaaaaattagccagacgtggtgggacatgcctgtaatcccagctactcgggaggctgaggcaggagaatcacttgaaccctggaggcggaggttgcggtgagctgagatcttgccattgcactccagcctggcaacctgggcaacaagagcagaactccatctccaaaaaaaaaaaaaaaaaaaaaagacagtagttcttagtaatatgatgtttcctgatacacatgtatgtgcattatttataacttgtcttattcctaaaatgatcctattaaagtatttagaaacttcaaggcccagaagaaaatttttaaaaatgcaaatcaatttcatattgtttttcatggctgagtgataatccattgtgtcatttgcaacaacatggatggaactgtaggtaattatttaaataaaataagccaggcacagaaaggcaagtattgtatgttttcactcataagtgggagctaaaacggtggatctcatgaaggcagagagtagaatgtagttatcagaggctgggaagagaaggggctggggaaaataagttttttaaaggtaaaaaaagtatagttagatggaagaaacaagttctgtattccatagtacagtaaggaaattatagctaccaataatttgttgtacatttaaaaataggtagaagagaagatttgtcatgttctcgacacaaagaaaatataaatggttgaggcgatagatatcccagttaccctgatgtgattattgcacattgtatataggtgttaaaatagcacctgtacccaaaaatatgtacaaccattatgtatcaattttaactttatttaattcagagggaaaactttctcaaaattttagggcaaacaaaatctttaaaaaatttttgtttccttttttgtttccttggggctctgtaaacttctaggctagggtgaaatctcctctgttctaatagtgttcagtctatttttgcttctctttcttttcttctttcttcctttttgtttttggttaattgatcactatcacttacttatgtatctctctatataaactgtaagattcttagtaacaggaactgggcttgcttcctatttgtaactcttatactacctagcacagtgctgaatttcagtagatacagaaatgtcctataacagaatgtgggtggttacaagaaggcaacaaggagaataatttagcaaatatgaggtagacgactgagtaaagtgaattctggaatacattggttgtttcctggcacatatgtggtgctcagtaaacattggctaaataaggatgaatgaggatatgccttgataaagtttggaggtgggagaaaggatttggagcaattacaaaccaatggtatatttagtataaaatgtgacatgaagttgagtaacataataatttccagcagggtgtttgactggatgcttcctgttaaatgaagtcaacacattttcctcaggtatttcaaagaaccaaggcagtggggaagtggagtctaagaaagcattacttctgcaaggtacacagcatgcagtagtaatatgaaaacaatgatttttgactggaatcatggcattaaagaattctcagtaagtttacctgattccaactcatggaagcaatactctcaattggaaaataagtcaacaaatacaaaattgaaccaataaacagataatttccgtgagtaatcagtgatatggagaaatgtaggaggctatataatacctgggatgggaatggaacacctttagctagaagaccagggaaggcatctcagggatctgaatgaaaaggaggtgtccaggagaaaacctggggtaaagcaatcaatgaatgcagatgcccttagagagaactagcgaaaatatctgagaggcaggaagaaggccagcatggctaggttagggagtgatagacagagtggggagcaatgagcaacaaaagacagacagtggccacaggatttgatatccctcaaagggactgtgtattttattctaactgcaatggaaaagtctttgagaggttttctgtgagttgggcaacttatgacctgatgttatgcttgaaaacaatcttggtcagtgagaagtaactgcaggacaggagaaaaatcagttgggacgctgttttaacagtctactaagagagcgtattgtttccattaaggtggtagcactgaagaggtagggtgtatttctgtggtagaagtaaaacaacttgttaatggattgggtatggagtatgatggaaaataaatcattgaaaatgcctagatttttcaactgaactcagtgagcggtacctctatttacagaaaggaagattgtaggccaaactgacatgggagggaatgaactggaatgaccaaataaatgtcctttctcgcaagttagattatatatgcttgaagatcatggtctttattttaggctttattttttcctttgtcataccaggcataattccttgcatataccaggtggtaacaaatgggtattggccagttaggtgattgggaagccgagatatggagaatggatgtctgaatcttctattaacttaacaaactatgataaaacttttggcctctagaggtgagttttttttttttaattctttgcaaatcttaagacatgtgaagggtaagaaaactatcatagatttaaaaattgttacctttatgccctttcaaatcctctcacttgcatcctcacaaagttgtaacttgcatacaatatagttgctaataagtagtcatttttcattaatgggaaattcattaaaagcttcatttggaagattttcattgagatccaaagacaaaacattttagtgtttagatactttccttatattgatattttacatttaatatttgccttatattggtaatctaatggctatgaatactaaatattatcaagctgtttacagccacaaatgtttgcaaaaattgctttgtgtcagaaaattaatcccagaggaaagcgctaacttatttaaatggaaggagtttgttcccagtgactagtttcactttactggatcaaatttaaaatcttagaaagcattgcatttatcatgttgggctcttaatttccaacttactttttcttcttttcaatactagagctctggtaataagtagaagattaggtgaacaaatgactacttggaacatattcaaccgaaaagaataccagagaaagaggcgattcttacctttggagtataaatagtagggcagagggaactgaacaattggccttttattctgttacctattggtacaatgagggtgataactctacagtgaccactgtaaggaattactctgccatgaccattgtaaggaagattcagattgcagatgtcaagtgaaacatctcctctttcattatacagctggggcttttccatgaggctaatacaaacagactaacagatcccatgaagtcaaacatcctacatttatttggatgtctgcatgaaaaatcaataaggaaagtagattgtagaattagaacccagcaaaataataggaggtgttctgcatttcttagccttggaacccacactcggttgccatgggaaatgtggcattcccctgtcagggtaaagggttctatttgctctacagaatggctctgtaaggactggtccctgaaaatgctagaacagaaaggcttggaattcatgccagtcttcttcagaactgctttctctccacatatccttgactgtctctaacccttttccagctgttttataaacctgaggatcatgaaaggcttattctaaactacaaaagtggctatgttttaattttgcttaaaagcgctcatgacctcttctttgcctacagaatatattccaaactccaaagagcagtactccctgtttcatgtttagggctttaaggtctttagcaactgttgactaaagtcttcccactaaaactatctccttgctcccgtttttggctgacatgccttcttattctcttctttaccctcatgcatcctctcaattctctccttcttagtctttttttctgtgttaccttctgctactcatcctataatgtttcctatcactaagtcttcatttcagttttcacttctttccatcacaacctttctaggaatatccatggcttcatatgaacctatacaatattgactccaaaatgtacctttttagaccattactgacttctgagattaaactgtaatatctatttaatgagatatctctaccttgatggcatgcatattccctcaaactaatcagatacaatattggaataattgtatttccctcaaatctattattattcttatattcctttctcagtataaagcaccactgctgaccagtcaccccagctagaagcatggaagttgtcctggattcctcactcacacaccacatgcaattgccatatcctgcagattccattcttagctctagccgtattttccttccttcgacccattggttatttcaggttcaggtcagcatttagagacacctatacccacgtcactctgccttcctgggaagtaatttcaatttactattttccatgcttcatactttgcaactttttttacatacactgctttattttccccatcagagcaaactgtgaaaaggtactattatttacattatatgatgacaggactacagatgaaaatgttcagttttgagattgtcaagaacctcattaagaaaggtgagaaattcttaacccaagtccattggttcccaagcccatgctccttccccatcacagtggtgtctcccatctacactcaataaagtaggagaggacagtaacaactgaaaaggaatggaaggaaaaatcaaaacaaggaaaatgaagtgacttatctagggccactgagttcattatgagcatgggggaaagaccacatttctgacatccagatctctgcccttttttccaaaaaaaaaactctaccttttcaatgttgtcgaagaataaaaatcagagtgtgttattctgaaaaatttctttcctatgtgaaatgaaaagatatccagggcaatttgaattagatgcctaaaatcctagctggcatacgaaaatcttcccatttctaattttccaattggtgctttttgtagtacctctctatttttatataaaatttctttttttattattattattgtactttaagttttagggtacatgtgcacaatgtgcaggttagttacatatgtatacatgtgccatgctggtatgctgcacacattaactcgtcagttagcattaggtatatctccgaaagctatccctcccccctccccccaccccacaacagtccccagagtgtgatgttccccttcctgtgtccatgtgttctcattgttcaattcccatctatgagtgagaatatgcggtatttggttttttgttcttgcgatagtttactgagaatgatgatttccaatttcatccatgtccctacaaaggacatgaactcactgtttttttatggctgcatagtattccatggtgtatatgtgccacattttcttaatccagtctatcattgttggacatttgggttggttccaagtctttgctattgtgaatagtgccgaaataaacatacatgtgcatgtgtctttatagcagcatgatttatagtcctttgggtatatacccagtaatgggatggctgggtcaaatggcatgcttctagttctagatccctgaggaatcaccacactgacttccacaatggttgaactagtttacagtcccaccaacagtgtaaaagtgttcctatttctccacatcctctccagcacctgttgtttcctgactttttgatgattggcattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatgggattgtttgtttttttcttgtaaatttgtttgagttcattgtagattctggatattagccctttgtcagatgagtaggttgcgaaaattttctcccattttgtaggtttcctgttcactctgatggtagtttcttttgctgtgcagaagctctttagtttaattagatcccatttgtcaattttggctgttgttgccattgcttttggtgttttagacatgaagtccttgcccatgcctatgtcctgaatggtaatgcctaggttttcttctagggtttttatggttttaggtctaacatttaagtctttaatccatcttgaattaacttttgtgtaaggtgtaaggaagagatccagtttcagctttctacatatggctagccagttttcccagcaccatgtattaaatacggaatcctttccccattgcttgtttttctcaggtttgtcaaagatcagatagttgtagatatgcggctttatttctgagggctctgttctgttccattgatctatatctctgttttggtaccagtaccatgctgttttggttactgtagccttgtagtatactacaagtttgaagtcaggtaacgtgatgcctccagctttgttcttttggcttaggattgacttggtgatgagggctcttttttggttccatatgaactttaaagtagtttttccaattctgtgaagaaagtcattggtagcttgatggggatggcattgaatctataaattaccttgggcagtatggcaattttcacaatattgattcttcctacccatgagcatggaatgttcttccatttgtttgtatcctcttttatttcattgagcagtggtttgtagttctccttgaagaggtccttcacatcccttgtaagtgggattcctaggtattttattctctttgaagcaattgtgaatgggagttcactcatgatttggctctctgtttgtctgttatttgtgtataagaatgcttgtgatttttgtacattgataatgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctaattgccctggccagaacttccaacactgtgttgaacaggagtggtgagagagggcatccctgtcttgtgccagttttcaaagggaatgcttccagtttttgcccattcagtatgatattggctgtgggtttgtcatagatagctcttattattttgagatacgtcctatcaatacctaatttattgagagtttttagcatgaagcgttgttgaattttgtcaaaggccttttctgcatctattgagataatcctgtggtttttgtctttggttccgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttgtttgtgtctctgcctggctttggtatcaggatgatgctggcctcataaaatgagttagggaggattccctctttttctattgattggaatagtttcacaaggaatggtacgagttcctccttatacctctggtagaattcggctgtgaatccgtctggtcctggactctttttggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgagatcggtggtgatatcccctttatcattttttattgcgtctgtttgattcttctctcttttcttctttattagtcttgctagtggtctatcaattttgttgatcctttcaaaaaaccaactcctggattcattaattttttgaagggttttttgtgtctctatttccttcagttctgctctgatcttagttatttctcgccttatgctagctttcaaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttgtcgttggtttcaaagaacatctttatttctgccttcatttcgttatgtacccagtagtcattcaggagcaggttgttcagtttccatgtagttgagtggttttgagtgagtttcttaatcctgagttttagtttgattgcgctgtggtctgagagacagtttgttataatttctgatcttttacatttgctgaggagagctttatttccaagtatgtggtcaattttggaataggtgtggtgtggtgctgaaaaaaatgtatattctgttgatttggggtggagagttctgtagatgtctattaggtctgcttggtgcagagctgagttcaattcctgggtatcctttttaactttctgtctcattcatctgtctattgttgacagtggggtgttaaagtctcccattattattgtgtgggagtctaagtctttttgtaggtcactcaggacttgctttatgaatctgggtgctcatgtattgggtgcatgtacattttggatagttagttcttcttgttgaattgatccctttaccattatgtaatggccttctttgtctcttttgatctttgttggtttaaagtctgttttatcagagactaggattgcaacccctgccttttttgtttcccatttgcttggtagatcttcctccatccttttattttgagcctatatgtgtctctgcacatgagatgggtttcctgaatacagcacactgatgggtcttgactctttatccaatttgccagtctgtgtcttttaattggagcatttagtccacttacagttaaggttaatattgttatgtgtgaatttgatcctgtcattatgatgttagctggttattttggtcgttagttgatgcagtttcttcctagcctcgatgatctttacaatttggcatgatttttcagtggctggtagcagttgttcctttccatgtttagtgcttccttcaggagctcttttagggcaggcctggtggtgacaaaatatctcagcatttgcttgtctgtaaagtattttatttctccttcacttatgaagcttagtttggctggatatgaaattctgggttgaaaattcttttctttaagaaagttgaatattggcccccactctattctggcttgtagagtttctgccaagagatccgctgttagtctgatgggcttccctttgtgggtaacccgacctttctctctggctgcccttaacattttttccttcatttcaactttggtgaatctgacaattatgtgtcttggagttgctcttctcaaggagtatctttgtggcgttctctgtatttcctgaatctgaatgttggcctgccttgctagattggggaagttctcctggataatatcctgtagagtgttttccagcttgattccattctcctcgtcactttcaggtacaccaatcagatgtagatttggtcttttcacatagtcccatatttcttggaggctttgttcgtttctttttattctttttttctctaaacttcctttgtcacttcatttcattcatttcatcttccatcactgataccctttcttccagttgatcacattggctcctgaggtttctgcattcttcacgtagttctcgagccttggctttcagctccatcagctcctttaagcacttctctgtattggttattctagttatacattcgtctaaatttttttcaaagtttttaccttctttgtctttggtttgaatttcctcctgtagcttggagtagtttgatgctctgaagccttcttctctcaacttgtcaaagtcattctctgtccagctttgttccgttgctggtgagaaactgcgttcctttggaggaggagaggcgctctgctttttagagtttccagtttttctgttctgttttttccccatctttgtggttttatctacttttggtctttgatgatggtgttgtacagatgggtttttggtgtggatatcctttctgtttgttagttttccttctaacagacaggaccctcagctgcaggtctgttggagtttgctagaggtccactccagaccctgtttgcctgggtaccagcagcggtggctgcagaacagtggatttttgtgaaccgcgaatgctgatgtctgatcgttcctctggaagttttgtctcagaggagtatctggctgtgtgaggtgtcagtctgcccctactggggggtgccttccagttaggctgcttggtagtcaggggtcagggacccacttgaggaggcagtctgcccgtcctcagatctccagctgcatcctgggagaaccactgctctcttcaaagctgtccgacagggacatttaagtctgcaaaggttactgctgtctttttgtttgtctgtgccctgcccccagaggtggatcctacagaggcaagcaggcctccttgagctgtggtgggctctacccagttccagtttcccagctgctttgtttacctaagcaagcctgggcaatggcgggcgcccctccccctagcctcgctgccgccttacagtttaatctcagactgctgtgctagcaatcagtgagactctgtgggcgtaggaccctccgagccagatgcgggatataatctcctggtgcgccgttttttaagcccgtcggaaaagcgcagtattagggtgggagtgacccgattttccaggtgccatctgtcacccctttctttgactaggaaaggaaactccctgaccccttgtgcttcccaagtgaggcaatgcctcgccctgcttcggctcgcgcatggtgccctgcacccactgtcctgtacccactgtctggcactccctagtgagatgaacccggtacttcagttggaaatgcagaaatcacccgtcttctgcgtcactcacgctgggagctgtagaccggagctgttcctattcggccatcttggctccaccagctctataaaatttctaactaaaatttgctttcctttttgaagtagctacatttatggaactatctaatacctgatttaagctataataaattcagtttttcattttctttgtgaagaatggtctgtggggaaagggtttttttttttttgtatacatgttcatacattactaagtgccttattgctttctgagatgcagcttttatactacaaaagcctagaagaatgatgtatagctagccacccaaaacaaaatgagtaaaggcaggaatatgcccgctgtgttaaaacactatattttgctcctggtgtttcaggctttgaggccagtcataatccatttgagtcagtccactgggcaaaatgctgagatttctcattattgctttaaagcaaagagtttttcatggagattagttcagcatttgaagtgtactctcagagtctctcagctacctaacagtgatgagtgggatttttagatttttcacttagttcacttttaattcttacctaaatttaaagaaatccagcatggaaagtatggatgatggattaaggtataatttatataagaaaaatgaaatagaacttcagaaaaaaaatgggtcccaggtttctggccttacaagtcaattcggtatgccaaatattttaaagcaattaaagaacaatttagacattggaaataacaccatcaaaactgtggccagacgttgaaaattccagaaaaaatcttgaccctcacatataaaaaaaagatgaaggaacacgatatgttaactgttctcaaattaaaagtgtggatgacttatagaaatgcaaagtgtaagattgtactaatgataatttgtttaaagttaaaattgtgggcaattaagaaatcaagcatgctgggacaaacatgcttgattggccagtgtttgggctgccatgttcgtcatttaactgttgtcacagagaagaatatgggtcgcagtggcacaggatggagaaaaccaagggctgagaattgcatctgtcttcgatctcaccttaaccacattctggctgtgcaacttaacctaattctcctttataagaagactccaaattctcccatgctattctttaaagataaggaaagaactaatacctggttgataatcctattagacattcatataagagaacttttcctaccctgcacatccagaaccagttattgacttgttagtctaaagtttggatttaaacatttcatttatttaaaaaactgcctgcatgtcttaattacttcactttaagttttaaaaatatgattgtatagtggcataataaaatgagtgttttattggtatttaaaagaaaaaaatggtatttctcccaataaagcatatccaatttattttttgagtcaccacgtcattgctgactgttgagtgaagccatttaatataaagtaaaagcacattttgagtatctttggctatggaatgaaaaattgggggctctaaatttgatttaatgtttttcttcatacttatatccatctgtttgtcccaacatgcttgatttcttaattgtccacaattttaactttaagcaaattatcattagtacaatcttacactttgcatttctataagtcatccacacttttaatttgagaacagttaacatattgtgttccttcatcttttttttatatgtgagggtcaagattttttctggaattttcaacgtctggccacagttttgatggtgttatttccaatgtctaaattgttctttaattgctttaaaatatttggcataccaaattgacttgtaaggccagaaacctgggacccattttttttctgaagttctatttcatttttcttacgtaaattataacttaatccatcatccatactttccatgctggatttctttaaatgtaggtaagaattaaaagtgaactaagtgaaaaattctttattttataatattttttgatcttatctctctcagacctaatttgacagcaatatttttaactattaatacatacttttttttagattttcaagatcagaaaacttactcttgatagagacaaggcttttttgtacacatttcatttttgcaacatttaattatgtaattataaaaacaaatgcaataagaataaacagatttaagaataattacaattgattctttgttagtatgcaaatcacctgaaaggaatggaaatttatgggacataaacattctgcttgctgtggacattggtctgcctgtcactgacagagtggagaagattggttagtctattaaaaggatgctgcttaagagagctcaacagcgcaacttgtggactaactattacactggagggagatctgtgatgatttgccacaatgcacagtccttatgccttattataatcaatgacttaaataaaaatgtaaaatttgatgatataaagctagatgaaatagtgaaattctataatggccaacacatcttaaatgctcaataaatacttattgaattaaattgataactgaatgttagcttaacaaacttaaaatctagatcaaaatcggtaccattaaatttaacatgtggtaactatattgggtcccaaaatccaatgtgtaagtacatgatagatttgatttttaatcatttgaggtcacaaatatataagaggttcagtggactctaagcttagcaataaaattcagcaaattgtaaaagtccatgttatcttgggctgctatgacaggagtatgggatccaaatggagaaaagtcagcatctcatggcactcttccctgatctgaacacatctggaactatgagttcatttctacattctgcagtttaaatattagattggtgcaaaagtaatcacggtttttatcattttttttaaaaaaatggaaaaaaccactattacttttgcaccaacttaatagatatcagaagaaaaatgtaagcacatacaagcaaagataactaagaaccttgaaactatctcataaagaaagaatcaaaagtgttatgaatgtttatttgtaagggttgaagatgcaaggaatatctcagtcatccagtggctactgtggacagatgggtatcacgccaagagaaggaagaactttttaataattatagatgtccactatagatcatatttcccacatgtgtaacaggttcatcaagctaatcttgtacaaaatcaaattcaattatatttttctatccacacttgcactttcctttacacacatgcacttctgttaatagagccgtggtcctttcagtcaatggtggaattctccattcattcttcctcacctcccccaatcctaacaccagagtctgtctatttttgaaggcttgcttaaaagtcacagaagagagcacaactcttcctataccctgggaaaaacagggccctttatatgtaggataatttcactttcaggaggagaaatgcctacccagccagatcactggaatcaaagtgtcttctccttagctccttcttattaattcctgaatattctacctctaaatgtattaaatacattctcttttcttaatttttactgcattattcaagtttaggcatttattaatattcttcaccctgatggtttactattagtctccctgactatagatttcctccacttcctttcattattcagaatagtttcaggtttacttttctgaatcactgttatctccatcttgacccctttattccccccacttaataaccttggagagcccaccattgccaacaggtgtaagaccagaccttggcagggtattcattgtccctcattgcccatccacagtcagcttcctgaccttacccctggccactctgctctggccaagccaagacactcaagtttccagagcacaccacatatttttgacccttcatgatcttggtcatgctcttcatgagtctcaaaatgtcttgttttccttcaccatcctttaaaatacttatatattcttccaaacatagcttaggtagtttgccaattaaatatgcctggggatttattgaaaaatgctatccatgttatttggacatgggccaaatgatttatttgctttcatcattctctttattaccagatatttattgagtactacaatattgaggaatgaaagagtcatcccaagcacctaacacaatccctggtgtataataagtgcccaattaacatttattgggtataactacaacatataagtaattgtacaagacacttcatgttaagtgtcaatgaaacaactggaggactatccagtttcatgtgggaaggtgatgacgttttaattatgttaaatttgaggtactgattggatatccaagacatactcttctttttaagaatagtgacaatttaatgcatgcgctatattaagagagaaggaaagtagacagaaaaagagaagaaagaaatattaaggtagattaaataaatgatggatacaaatatgcaagagagagatgaagagttaaatatgacaaggataaatgcaagttcattagaagtggaaaaataggcaatattgaatatccataagaagatatgttaatgatgaatgtgactttacaagtcacattaagtaactttattgttatcagttaattaataaagtacacaaaaaactttttgtgctgtccattagaataacatagttttaatattacaacatattggaaaaaccacttatcctgcctctcattgcctcagagaaggagaaaatttaaaagccatttgttaccaccagctaggacctttgtgttccatgtgtaatagaacaatttcaattcagatgctcaaaaatttcttaattaagcacagcaatgggaatacatctttcagcaccattcaaatttcattttttaggcaacagtttggagtcttttacttggaaaaaatcagagagttcttggaaaggaaactctattgtgcacttcctcaattttatttaatgacagcatcatttggacaggcaatagggcttatacctctctttgaatcttaaaaaggcttagtaatatttatctccacagttgcccaatttagtacctcagccaagctacctaactagggaattggtgccacaggttttctaccaggcgacaggggacttcttctccagcatccatgttgtagcatgatgctgagcctccctcatgctcattctacccacccactattcattgtcacttaaatcttcatgaatgttcatgacttactaatgaggtggtgtgggtgggacagagaagttcctttattaagtgatcttcataaaaatcatcttcaaaagtcactgacgtggaagttgagcatatgtggtaaaaataatgggtggtatttataccaaagaaaaaaagaatttgtcagtgttactcagtgggagttcagtattttctaacaatgtgtttcaggtgctctatatagaccagtcacagagctttgatttcaactttttataaaacaatatggtttgtctcagaggagcaagcacttttttcccttgaaaatggggatgaaacctagttcttgatgctattgcagaatttaaaagcaagaagtcatgggggccttacagatagatggaattcaatccatggtattcatcattcaaaaagacattgatgaagggtcttttgtgtgccaaccctgagctgcgaatgtatagatgaagaaacccaatactttgctctgaaagcacacatgactttgtaggagaaatgggcatgtgaataaatcttagtgattcatagccctgggtgctattatggatatgtaggaaaatgagatggcagaacagagcagcatgttttagctgtgatttcctcccttggttctttctacaacagttctcagaattccatctgactggcctctcttcctgaggaggtgaaagagacaggaaaaggttacctgtaatttcttagcgatggtaactctacaccacattgtttatgtagccaataatgtggaaacgatagaacctacttggtccgaagggaaaaatgtttggtgttctttaaaataccagttgtagtcaccatcaggtagctccaaacatccactacaagcatccctcctgcaagtatagcttggacattactattatatttgggaataacaaaaattcatttgtgtccacaggtcttgactctatttatcttagttcactgtatttgtcttagaagagagtgaaaggataattacattttggaaaaggctctgtttgttccaaatctacatgctaggagaaactggctaaccttgcatgtgtaatataaaaggagtcaaattctctgtgcacctcagggtaccatttgcatttactttgtcgctaaaactttaaagaggatattattggaatagagtagaataacaaaataattagttataaggtaatgataagtgaagtgagattactgaattttttttgttttaattttgggctgagctaatgatgagaaagctatcagaaattacagttacttattaatcttggttagtgaccataattgagctgcctaagaactgttggtactttctagatcagtggaaaataaatggtaaaggaaaggattagacattttgcacaaaagatatacaattagccaataagtatacggaaaaaaatggtcattctcactaataaacaaagaaatgctcattacaaatctgatgcatcattcttcatctattaaattgttagggtgttttaaaagttataatgtcagtgcttttaagactgtggggaaactagtacagatacacatttttagaggcaataaaatgatacaaagcttttgaaaagtaattaataacataaatcaagaaactaataagcatttccattttgggaaacgcatctgaagaaaattgtaaaataagaaaaaagtaattgatatcaacatgttcattgcagcactgtttataatattaaagccgtaaacatcacccaaatatccaactatcaacggtggttaattaattatatcttcataggaagtaacgttatgtaactccaaaataataattatagagaccatattagaaatgcttaaatgttaggaaaagcagaggatatgaagttacatatgtttctgtatatatatacaactatgtgaaatacatatggacacgtagagagtcagtaagatagaatggaaagtacacccacttggtgataaggtaggctttagtttggactctggctccacatttgcaagctgttgatttctgaaaatcattttaaattctatatgttttgttttcttgtgtatgggaatacttatatctaccttagaggactcctataagaactacattagataactcggtaaaatgtgaaagaaggtaataggagtataggtgaatatttttaatttctcatttttatttccagtaattttgtaatattttttaatagaaaatgttttattttatatgcttgtaaatttatgatatttttgtaatagaaaatatattttaatttgatatttatcactaaagttatacacagaaatatacaccttgtggcactgactgtatgactaactgaagtggtctaaatacagtaattattcttatttggtactaaacatctcaaagtacacgctctgctaaatcataatggtttatttatttaacaaatgcttatatagctttaccatgtgagagccattgttctaaatactgtattcatttaattcttataataaccctgtgaggaaagtcctgttactatcccagtcttataagatgagaagctgacatacagagcgatttaagtaatatatacaaggttacattggtatatgtggttgagccaggcagtctggctacatagtccaagtcctgaatactacgatgcttttcaactagtcaattgaaaacatgatcaatgaatatcttggcactgtgagggataccaggaaacacagtctttaacttgaagaggcacagtctttaacttgaatatgattctgtaggtttcagctatggtctcaaaattctgtaccctcaaccttagacaaatattatctacgtgtcacaggaaaacacctcttcccacctgtggtgaccaaggttctgaatgaaagactctgcagcctgtagtttgattctctgtggcaatgtcagcatttgccatgtttgtgctgagaaatcctagactcaggtttcttttatacatatatgtatatatacacttgttcatatattatgtgtatatgtaaatagtgtttcaaccaaaatatttaactaatactataaactaaaattacacattcagtaaagttggctgttgaattattattattgtgcctatctcagatgaaagattctcttgccatctctttctaaagaatattctaagattccaagatgaattcttaaaaatgtgaaaaattgttgtaagaatttaaaatgactctagaatcaaacagtctcaatgccatttcaggcacaggaagttaccatgtgactctgagcaactttctaatcctctctgtatctcaatttcttcatctgttgaatgggacatacctcatacatttatgagaaataagagacataaaaatttaaaaacacttagaaaagtgtttcagatctcaataaatgttagatattatcattttatttatattacttatctacaaaatcagtcttttcttgttacaggtaatcaaaatctagaactacattaaatttgaagattgatatgcagctggaagtctcatttttcaagttttgtgttcatcaaatagctcaattattattaactaattttacaataagtgttgcaaatttgaactaataaatacatctatactaactaaatataatttacctgatttacagattaggttctgtgtaaaattttgttagaaaaaattattctgcagcttaaaaaatacattgcatcataaagaaatgtatgtttttatgctctgtgttatctcattccaagggcaaaaaattaccttttccaaatatgtttgttcattttaatgttcacctatcgttaaaagcttacttttgaataatacatattaaaatcaaattataaaaaaattaactcttatctggtagagtactatattttggtggagggttctacctatcaccaaatatttaatctctactgtatttctttcaagactggttattgacaataggaccgattaaaatgttcaaaaacattttaaataaatgatctgtgtttcttggagggttagcattaggagatatatctaatgttaaatgacgagttaatgggtgcagcacaccaacatggcacatgtatacatatgtaactaacctgcacgttgtgcacatgtaccctaaaacttaaagtataataaaaaaataaaaaaataaaaaataaataaatgatgtgtgtttcttctgtcttttcttgcagtcattcccaacatagcaccgcaactcgtcagccttcaatgactctccaacgggccgtctccctggaagggtaagataataatacagaacctcttaaactgtgcagccttggaatatgaagtcttcctttctctccctgtctctgtctctctttctccttccctccctccctcccttccttctttccttccttcctcccttccttccttctccccttccttccttctttccttccttccttcccttctttctttgtctttctttctttctttttttctgtctttctttctctttcttttgtccttttttctctctttctctttctatctttctttctttccttccctacctccccactcttctttctctgtctctctcacacgcacacactctctctctttttttctttcaatcagcaaatatctaggaaactcaccttatgtgccaagcactgtgctaggtactagatttaataagtcaaacaagatttcttcttgccctccagagggcttcattgtctagtacaaatgatagaaatacaaacacacacttgtgatacagtgtaagcattacactctataggagatatgcataagggattaatggagaatccaggagggatacctaactgtaaatggtcatccaaagggtactagggagcaggtcatgttggttcctgaaaagatgtaactcttgagctgaggactgaagcatacatggatatttgcccaacagcacaagttcataaatattcctccaagggaagaaaaaaaactaacatttactgagtgcttattggtgccaggctctatctatttatctaccaatcacctgttgtattagtccattttcacgatgctgataaagacatacctgagcctgagcaattaacaaaagaaagaggtttagtggagttgcatttccatgtagctagggaggcctcacaatcatggcagatggcaaaaggcacttcttacatggcagcaagaaagagaatgagagccaaggttttataaggtttccccttataaaaccatcagatctcatgagacttattcactgtcatgaaaacagtatgggagaagctgccccatgattcagttatctcccaccaggtccctcccacaacacgtgggaattgtaggagtacagtttaagatgagatttgggtggggacacacagccaaaccacatcacctgtcttacctgattttatttctaaagtagtcctacaagataggtatttttttttctgaacactgattctcagagagtttaagtaattttcccaagtgtacttgtatagaaagtagcatagcttggacttgaaatcaagcttgactccactgtgtggctctgtcctctataatgtggtacgaaaagactttattgaggtggagagcactggttgtacaattcataaaccacattcaggctaagttagacatcgtgcagaatttcctaagtgtgaaaaaaataatgaagaactagaatgactctaaccttaaaaatctttaaatagaatcaataacctgctgtttgggatggtactagaggtccatgtgcatactatgtagctgaggtgttgtttgcagtagaggtaagggtgtggggactaattttaccactgtctctacctcactttattattccttttgaagacctctcttggcagggctcagggtggctatcatttcacattttggccatcagcacaaagtagacttccttcaactatgatgaataatggcatttccttctaaggctatctccaaacttttgttttctttctttttattagcaaaagcttattagcaatttgccctaagaatatttttcaatttccactgttttccacttgagttagaggaactctgtagttgacataatcaccatttcttcttctctgatgaggccaaaaatgtaaaggtgttaccctaacttcaaaacaccagagtgactccttttacaaaaaaatagcaaactgtataaacttcatagtgatctattgtcccaactagcataaagcaatttgccttatatctagtgaataacacaatatattctattccctataagaatggaagaaaacttactctagagtcaaagaatttggtttgagtcctggcctctaccatttgttgttgatcagcgaccttcacctctctaagcatgggtttcctcaacagctaaaagggaaaatagtatacaactcgccaatttgtttgagatggagtctcgctctgtcacccagattgaagtgaagtggcgtgatctcggctcactgcaacctccaccttctgggttcaggcgattctccggcctcagcctcccgaatagctgggactacagacacacaccaccacgccagctactttttgtatttttagtagagacggggtttcaccatatttgccaggctggtctcaaacgcctgaccttgtgatctgcccgccccagcctcccaaagtgctgggattacaggtgtgagccactatgcccagcccaaactcaccaatttttaaaaataaaagtatcaggtacatattggaccgtcaataagtactagttaaatatacacttagtctaagtgttctgaaaaaaaacaaaatttatttttataggctagattagtttgaagacttattttgaacacttgcttttaaatatgtttatatgtatttgtttatgtaaaacacttctggatataaaatgaaatatttcaggtagaaataacttagcattactgaaatatttagaaggcgaagtctcagtaatcctctacaaagtccagaacacaaaaatttgtgctatacatgcccagctggttgtcagatgaagagataacgtgcacatagtgggaaagttatttttcatcttacataggccaatgggtctttaacaggtttcccattaaagtgttatactgctcagtgtaggcaatcaactgaaattgcaaatcccattatttgaaaactctccttcctaatgcttttgtgaaaagcaactacataggatattttttaaatgaatgtagtttaaaaggccatatgtttatataattttcacccaagttgctatttacttgacataaaataagtggagatatttcagatttccagttaatttgatccattgagacaacaaaactatctaattgagtcctctaccatagagtcactgctgtttttaaattgatatctgaatcatctataattatgccagacaaaatgaggaagaataatatccctattagcagaataagttctggtttcagtttcaagttgacagacacagcccacaccctaatctcctctttctcctgagaccctattaaaaggaagctaatgggataataatatttgtttaaaaggacagtctcctagtgatcaaggaaatagaagggggcatcaaaggccaaatggtttcattatatttctttgcaacagaaagctgattgaagggtattgatcggtgaaaaacaaagtaatctcagcctttgatcacctatggaaacagggttgtacaactccagggggtaccttttacattgcattctattagaatgacatttcctcggattatgtctcccgagttgccacccacaagaagccctaccacagtgcagtagcactatgtgaaggggcctacagctcagcaaagagcagatctgcctagccaaacccggaaaactcagagacgttagggtagtgacaacagatgggattgaaagcagagtctgagaataggaatgaagagtcccccaattagcatgcacaccgctgaataccaaaaaaaagaagcttcttctcagaaaaaattgaatcactcttctgtagcacctagatgagctagtttgagagttggcccccacagctgagcccttcacagtgtgctagtttggggcacagtttcatgttttctggcttaacctcaaacctttccgttaaaaagcctaatcaacctaagtgcctatcaacgaatgactggatgaataaaatgtggtatatatacacaatggaatactattcagccataaaaagaatgaaatcatgtcattttcagcaacatgtgtggaactggaggccattatcttaagtgaaacaatcagaaacagaaagacgaatgccacatattctcacttataaatgggagctaaataatatatacacatggacattggagactcaatagagtgaaatacttcgaggaggttggacagtgcgaaattacttggtgggtaaaatgtacattattctgttgatggatacactaaaagcacaggcttcaccactgtggaatatggccatgtgacaaaattgcacttgtacctcttaaatgtatacaaattttttaaaagctgaaatggttaaaagcatttgcctctggaaaggaagggaggattctcaggggaggtggcacaaattgaattttaagggatgtgtctgcagcaaggcagaggttaaaaaaatagaaaataaaatcacgtgcaaaaacctagaagcattttgttaacactgctaagagtaagaagtatcttcagctactcagaaagctttctttcatctaggagaaggcactttatgttaccttacaaggtcatttagtgacacacttaatggcagaattttctagtacaaattctagtagcattttcacattggtaaaacagctgccctgaaaggggttggccagcctttacaagtagcacttaaaaggaaactaaatgaccaccttcagggaaattcttcaaggaatcctttatggaataaatagtttgtctaactaaccccaccaaaaatgtctcccaaatccagaagtatatgagtatcaaaaagaaaaacaaaaagtagttttacttataaacagatctaagggaacccatcctttcaagttaactggtttgtgatgatactgctattgtactttctcaccagggcaggcctaactccatagggacagccatgtaccactgtttggcacaaaagacacccttcccatactttaaggccacctaggctcatgaaaccatggctccattggggctggggagactctggtgttctgagcctgagctcaggtatcctttccaaggaacatctggaaacaagacctctaatggaattattctctctcttgttctctcctttactccttttgcctgggtgggaaaagctttttttttaaagctaatgtgcttcagatttcccaggatgatgctgacctaaaagactcgtctttttttcctctaagtactcagatgtttggttccaaaatatatgatcatggcagaatgtgatccgaaaatcaccaggtcatctttgaatcagtacatagaacccagatctaacatttcttactgtgtgattttggcaagatgtctgttatctcatatacgaagtgatcaggttgagttaaataaacaaggtattagatgccttccaaatctaacattttggagacaaaattttggcttatggacttctaggaatattcctagttatggagcgtaaacttttaagggaccgttggactttaggtagctggccctttgggctagttggcttgagtcatctctatccacacattcagagatccatctgtacctcaggatttgtaatcagtgtgaatgctcaacttccttcagcacaccctgaccttcaaaagtagtgctaagtagtgttggggacagggaggagttgacatgctgataaatatactgaattatggaagtgctctttgaaacttggaagagattttttttttaagctgttagttgctagggtcgctggtcgaaaatctgagcctttgcttatcacagatatttaagtgactctatcaaaacagagaagcaagttgggtaaagggcaaaggatttttgtctatttttagaatgtattaaaataatattcattttattttatgtgtatgtttatatgtgtatttatgtatatgtatatatacacacacatatgtatatatgtatttatatgtatgtgtcattctctttattttgctttcctgtcagctgaagagtttatttataaagaatatgggaaaagtaaggagatgagcacccatttgatttttagaaatgatcggaagaaatcaaactgctccccccaaaaagatttatgtttgtgacttatagtccaataaagacagacctgtctcctgaataagaaagttctgggtaagaaagctttggttgagagtcccaaccttattaatgctgccaggtcacctgctaaaaacatcttaactgtttggaaggactcaaaaagtttgcaggccttccttccatccctgggtgggggagatagatcttcagagtttaaaaacgaggggattcattaggaatctgtcagagcagcaaattcctctgaccatcgctgtccccccagttcagcatcacgtgcttccttttcatttttccttgtgtccctggaatttccacctctcctcctacttgagctgtcagctccttttccttagcctcatttcaaagggtgaacagatttttttttccatttccttactccgtaagacatccttttctaggccttataatctttttccttacatgtgtagcgcttaaaatataaaaggtgtcatcacagcaatctttaaggagtctcccaaatttatcagtgttgaaaaaatgctgagactatggagagctaggaaatatttaagggctatgaagacatgggttctaattctctcacagggactggatttctgttgccatctgcttttcaaataacaactgtgtaaaaataaataaatacataaacaaaccattgattcttgtttagaacagacagaagtttccaaacgtggaatttcaaggactaacaaaatagcaaaaatattttgcaagatgacatagaaaatctagattttctaggtaaatacttgtatagacgttatccactatcatcattattgttccataaaagaaagccttccttaaaatgaagaaaaataaacataaatcgaagaatacagagtactgtatcattaaagcaggtattgaaaacacacagactctaaagttcaaaaagaatattttttctatatttaagggctaaaaatataacattaaatattgtatattttaatttaatagtaactgatatgtgttgtaagtgttttatgtggctctcattttgctctaataacaatttaggtacctttaacccactttatggattaagacactaaagcttggagaagttaagtagcagaactgagatttgagcccacatttttaagtcactaccctttcctacctccccaaacttgtatgtgttttgttattatgagttggccaacctggaggcctgagtaagacattaaaatacaaagtagagctcaatatgatttctgaggttttggagttttttgttaactagaatcattgtcaaaaatctactttcaaataaaaatgttattaaatggggaacaaacttgtataatgattccactcaccttgaaatgtaccgaattagaaaaaatggaggaataatatctccaaactgtaggcttctggtttgcccagcaggactaggaagaagccgggaagtcacaggtcaggagtctcgttatgagaattattgagctgccctgtttagtggactcacatactgcgggctgctcaatgccagtagtattgaccttgtagggctgccacagaatccactgggcaattgaagttagagatgtttattttttaaatactccctattttctggacatagttgagtttcagcatgattacttatcataccgtgtatatcttccttgaaaaccttttaaagttttaataaatgggtttaaaaatggtctcaatgtaattgtgaataaactttctcctcgttgttatataattaaatatatccaaaacagcgtgctgcagaatatccaactagaaaattgcccctcttaatcagtactcacagttattaatgctaataataatatgctcacccatgacattgactgagatgtcactaaagagctagttaatatgctgaattaaccaacgaggagcaaaaaagcacccagtcataagtctgttatgaaaatgaaaaccagaaccattattccatgacaagatttagttgcttaaactatcaaaaagattttatctgtcccaaactttctaactgtagccccagcaccaacctcttcttgacatttgcaccattacctctctttgaatactgtccttttttaacttgattctgtttatgatgatgccaaccaataaattcaattaggaatataatgatgagcaaagcagacattgactctgtcctcagtctgggggagaaaatgagacattaattgaataatcacacaaataaatataaatctgttactgtgtcaagctctgtgaaaaaaaaaggggggactgtgatgctctgagtacctataatagggcatctgactttgtcggggtggtcagggaggtcatggaaggctcttatctgaatgaccaatagaccttgactaggcaaagaaaaggtcattatcaatggctgcacaatgattacaaatctgtctgagtgtatgactgagcagagcacagatgagaacaacatgaactcagtagtgctttccatttagaaatttataataaggaggctgactcatggttgactcactgtctcctcctaagaggctgcctgatggggtcttccacttgcttatcagagctctgtggtcttgacatagacatgattttctaaatcccatggctgaccagttctgctgttccttcggttttatgtttatgtgtttgtttgcctatttatctacctgtgtgccagaattatgagatcgttcattgccactgctgcatctttccttctcctctaccggttcctcccttggccccttttattttctgtattttctccctttcccctcccttctctacagaaactttctcctcctcctttctcttagtcttaatttgccattcattttcttttttttctcttttattcttgtcttttttttttcgctgttcaccatgaagataccaggcttatgtttgcatagtgcaatataatttacaaaggcatctcagggacattattccatttgatcctaatagcagctttgtaaggtggttgggtaagagtcatttatcctgtctacagatatgacagaggaccagtgacttccccaaggtcatgtgtctgggaagggaaggattcttgactgcaacctagatggctgtctcctgcactactagaccatcctgccttaacagaaatgtcacatacattccaatcacgtcttttagtctgactgacaaaagtccttttccgtcttgtctttatctttcatgaaaataagtctagacaaaagtcgtggtcagaggggttttctggtggctcatccatcacatgagtagaaacagccttagtcttatctgatgaatatttgcgggacaataaatttgaccttggattgaactgcttataaataatgattttcattctgttggtaccttgcctggctgtgacctggaaggtggcatggctaacaagaaccaaaaacaaagaggattgcctcaggtatcatttgtcagccttcattatattactcatcttgagacatctatctttatatatccaaatgaaatctggtttttttttctgcatatatttcaatccctcagagactcttaaattccatcaggatttctgtttacttccttcttctgaccaattataagagagtttaaagaaagagcacgtctgtatcctatgccacagaccagatgcccctttattgccagggaaacagccagcgatgtttatcctttatttaatctctctgctgactttcagtgctggtaaatgtttattccaccgaagtatgcttttaagatgtcagtcagcaacctttattgaccaatggatcacatttggtaaaggctcctgcttattacatagagaattagactgctcaaagaggattttgcaggggacaagcaccatttattcattcagtcattgatttgattgattaacttcttatgcatttgttcaactaagcatttactgaatgtctagtatgtgccaagcactctggtgagatatttgagaaaatcaagaagaaaaaggcccaagccttgcccctgaagaactcagactaatagggtgacagaatgttgaaaattatagtaattcagtgtgattatatctttgtaattacagaacaaaagaacaagcagctgatttgagggaagctactagcactgttcgggtggaatttcagtaatttttatcaggtgattaccaaacctgaagggtaaatgaacaccctctttaaactaaagaagttgcatgcttacatgggctgatatcaagagttgggaatttttttctcctaagcacaggtctgtaagagctacatggaagtatagaacagagccatgttcttcacagcctattcagttttgcaaaggagaattctcctgtggtcaagcattaattatgaacattgatgggaaattgcatttcaatatcaatgttgcctgataataaaatgtgtgagcatcccttctcttacagtgctttcactgcatccctgaagtccttgcttgtcctcaagtctctctccttggtatagcagcctggtataatttaaagaagatggccttttggcatatctgtaacttcatttaaattctggctccgcaattactagtcttatcaccttgagctgttactaaacctttctgagtctctgtttctttaatctaaaagtggagattaatatctgctacataggatttttttgacagtttatttttttaagtctataaatggcctaccatactacttaacaaacagtagatacaagtagggatttgttccctctctgatctctcttcctatatcccatctgccctttttctttctcatgtgctagaacccatttcttcctcctccacgccaggactcaattgacaaagtctccattcattgtccatttaacaaaacatttcctgtgcacctctcacacaccctgaggagatacaatcagtaatgtggaagacagaacacagcacatggtaaagaaacagatagtggagtgagtaagcctcatttagaaagagacatcaagagttcaaacgttttctacaccccccaaaactgatttcttcagagcagagtttcaggaatagtagtagatgtaaaaagaatatttaggggtagaatgtcaccacaccttacctccttatttacacacaaaagagtaagtctagagcccatgcacattatgtgctagctcaaatatgtgaacacacataggttccttccagatatctggggtctccactgatctctgtttcattcaaaatatttattggacactgttacatacacaatgccagtatctcttcttgattgcctatataacagatcatatctctgccacacaatttaatgcctgtagttttctcctttttccatgttgaaaagtttctctcgactgagtgcaaaagtccttcagggtagctgctaggtcctaccctatcatgtaattactgggcagtctcccaagcacagaccatattcaacaagtgatggcttgttaaagttcctgcttctactatgacctaaggaataaggggaattatattccctaagtgaccaattttctccacttctagccaatttcttcactaagggagataagccaactagtcatcactttctctctctctgtagttgtacagagttttaaagtttgtagacagtaatattatgaatgctgctgccaccactctttttttttggagtgggggagtatctatcacctcaaacatttatcctttatttatgttacaaacaatccaattatgcactttaattatttttaagtgtacattaaaatattgtttaccataatcaacctgttctgccatcaaatactagattttattcattctttataaatttataaatatatttttgtacccattaaccatctcaatatttcccccaccactgcccttcacagcctctggtaaccatcattctattatatccataagttcagttgttttactatttttagctcccacaaataagtgggaacatccaaagtttgtctttctgtgcctgtcttatttcacttaacataatgacctccagttccattcgtgttgttgccaatgacaggatctcattcttttttatggctggatagtagtgcattgtgtatttgtaccacattttctttatccattctcgtttgttggtagacacttacatttcttccaaatcttggctattgcgaatagtgctgcaatcaccatgggagcacagatatctttgatatactgatttcctttcttttggatatatacctagtagtgggattgctgaatcatgtagtagttccatttttagtttttaaaaatgttttcaatttttaatttctgtgggaacaaaataagtgtatatatttatggggtacatgagatgttttgatacaaggatgcaatgtgaaataagcacatgatggataacggggtgtctgtcccctcaagcatttatcctttgagttacaaacaatgcaattatactctttgagttattttaaaatgtacaattattattgactttactcaccctgttgtgctatgaaacagtaggtcctattcattctttctatttattttagtacccattaaccatcccaccttccccccacctacctcccaccactacctttccagcctcgggtaactatccttctactctcaatctccatgagttcaattgtttcgaattttagattccacgaataagtgagaaaatatgacgtttatctttctgtgcctggcttatttcacttaatataatgatctccagttttatccatgttgttgaaaatgactggattctcattctttttgtggctccattgtgtatacataccacattttctttatcattcatctgttgatgaacactgaggttgcttccaaatcttggctattataaacagtggtgcaacaaacatagcagtgcagatatctctttgatatgctgatttcttttcttttgggtatatacctagcagtgggagtgctggatcatatgatagctcaatttttagttttttgaggaacatccaaactgttctccatagtgattgtactaatttacattcccaccaacaatgtaaaaggattcccttttctctatatcctcaccagtatttgaaactgcctgtcatttggatatagccattttgactggggtgaaatgatatctcattgtagttttgatttgcacttctctgatgctcagtgatgttaagcaccttttcatatacctgataccgatttcattgttaattcatggcatatattagtgaatttttattagtccattttcacactgctgataaagacatacctgagactgggcagaaaaagaggtttaacgggtgggaaggcctcacaatcatggtggaaggcaaggagtagcaagtcacatcttacatggatggcaccaggcaaagagagagcttgtgcagggaaactctagtttttaaaaccatcagatctcatgagacttattcactatcacaataacagcacaggaaagacccacccacatgattcaattatctcccacagggtccctcccagaatgtgtgggaattcaagatgagatttaggtggggacacagtgaagccatattattccacgcctggccccttccaaatgtcatgtcctaacatttcaaaatcaatcatgcctcccaacagtcccccaaagtcttaactcatttcagcattaactcaaaagtccaaagtcccaagtctcatctgagataaggcaagttgcttccatctataagcctgtaaaatcaaaagcactttagttacttcctagatacagtgggggtactggctttgggtaaatacagccattctcaatgggagaaattggccaaaacaaaggggctacaggcctcatgcaagtctaaaatccagcgtggcagtcaaatcttaaagctccaaaatgggctcctttgactccatgtctcatatccaggtcatgctgatgtaagaggtgggttcccatggtcttgggcagctccactcctgtggctttgcagggtacagcctccctcccagctgctttcatgggctggtattgagtgtctgcggtttcttcaggcgcataatgcaaactgtcagtggatctatcattctggggtctggaggatagcaatctcttctcacagctccactaggtggtgccccagtatggactctgtatgggggcttcaaccccacatttcccttctacactgccctagcagaggttttccgtgaggactgtacccctgcagcaaacttctcctgggcttccaggcatttccatacatcttctaaaatctatgcagaggttcccaaacctcaattcttgacttctgtgccatcacaggctcaacaccacatggaagctgccaagacttgaggcttacaccatctgaagctgtggcccaagctctaccttggccccttttagtcatggttggagtggctgggatgcagggcaagaagtccctagactgcacacggaagagggaccctgggcctggccgacaaaaccattttttccccctaaacctccagtgctgtgaagggaggggctgccataaagatctaggtctctgagatgccctggagacattttccacattttctaggtgactaacattcagctcctcattacttatgcaaatttctgcagctggcttaaatttctcctcagaaaatgagattttcttttctatcccattgtcaaactgcaaattttccaaacttttatgctctgccttttaaaactgaatgcctttaacagcacccaagtcacctcttgaatgctttgctgcttagaaatttcttctgccagataccctaaatcatctctctcaagtacaaagtttcacaaatctctagggcaggggcaaaatgcctccagtctctttgctaaaacataacaaggagttacctttgctccagttcccaacaagttccccgtttccatctgagaccacctcagcctggatttcattgtccatatcattatcagcattttggtcaaaaccattcaacaagtctctagggagtcccaaactttcccacattttcctgtcttcttctgagccctccaaactggtccagcctctacttgttacccagttccaaagtcacttccacattttcgggtatcttttcagcagtgtcccactccccaaaccaatttactgtattagttcattttcatgcagcttataaagacatacccaagactgggaagaaaaagagttttaatggatttacagttccacatagctagtgaggcctcacaatcatggcagaaggcaaggaggagcaagtcacatcttagatgaattgcagcaggcaaagagacagcctgtgcagggaaattcccattttgatgagatttgagtggggacacggccaaaccatatcagagttgaaatcattacaaagttataggagtgctagatcatcatttttatgcatttgtgtttgtgtattccaatatgtcaatgctagcaaataatttgggcttacaaaaaaactataagccacatcagtacctgtcacccttgacatctaagagaaccatggctatcaaagatcaagccttgtgtttgagagtgcatggggtttttgcagaagaaaatatcattatcattacctggccttgtgtgtcagtaaaacacacatcactatggagagctgctttataataatgtccttctttcaatttactcaagggccatagccattgtggggcaaaaaaggatattataatgtccacctccttgtgagaaaatgatctaagggtaagagacaggcagaagattttccaaggccacaacaaattcaagaccagaagtcaggcctcctaattttctgaccaggagctccattttatctggaggataatgagagtgaactagagtcttcattcctctgattttttctttttcaattcctcatgccttttgacttattttgccagaagaagggatcattatggggaaactggaatgatttcagtggagaaataatgggaagaggtatgaaatgcaagaaagcaccttttgcagtgtggttttgaccccctgacatacccaagaagccatttttcttgtctgacagcaagaattccttccatgtaattttcagcagcaagcagggcttgggaagagtcctgagttggccttacatagatcagaactcgtactcagcaaaacagacacgttgcatatttggggtgccccagcttcattgtgctagatcgaatgtcttcatctcttaaccaccctcctttgtttttggtccccagtgctgcaatcttccttttatcaaaatcagttcttaggatcaacttgttcgcactgagatttagatgtcttttaggttttcattccataatgattcattgatcatattctttgtgcctactattttaccaggtatttaggacataggagcaaagagaacttgtattcattaaccactttttaatagattttatttttcagagcagctgtaggttcatagtaaaaaaaaaaaaaagagcagaaaatgtagaaaattctcatgtgtgtcctgccccaacacatgcatagcctcacctgttattaacatcctccaccagagaagtacatttgttagaattgattatgctacattgatacatcattatcatccagggtccatagcttacattagcgttcacttttagtgttgcacattctaagggtttggacaatcgtataatgacatgtatctggaattatggtgtcatacaaaatagtttccctgccctaaaaattatctgaacttggagattctgatgattatgtgtcttggggatgatcttcttgttaagtatcttaccagggttctcagagatgacacaaacaaatgaaaaaacattccatgttcatggataggaagaatcaatatcattaaaacagcaatacttcccaacacaatttatagattcagtgctattcctgttaaactaccatgagattcttcacagaactagaaaaaaactattttaaaatcatatggaaccaaaaaggatccttaataaccaaaacaatcataagcaaaaggaacaaagctggagacatcacactagctgacttcaaactatattacagggctacatgaaccaaaactgcatggcacaaaaacagacacatagaccaatggaacagaatagagaacccagaaataagaccacagatctgcaactatatgattttgacaaacctgacaaaaataagcaatggggaaaagattccctattccataaatggtgctgggagaactggctagccatatacagaagattaaaactgtactcctttcttataccagatacaaaaataaatcaagatggattaaacacttaaatgtaaaacccaaaactataaaatccctggaagacaacctaggcaataccattcagaatataggcacaggcaaagatttcatgatgaaggtgccaaaagcaattacaccaaagcaaaaactggcaaatgatatttaattaaactaaagagcttctgtacagcaaaagaaactatcaacagagtaaactgaccacctacagaattggagaaaatatttccaaattacgcatctgagaaaggtcaaatatcctttaagaaacttaaaggaatgtacagaaaaagacaaacaaccccattaaaaagtgggcaaaggacatgaaaagtttacagaagatgacatagatgtggccagctatcatatgaaaataaaggtcaacatcactgatcattagagaaatgcaaatcaaaaaaccacaatgagataccatctcatgccagtcagaatggctattatcaaaaagtcaaaaaacaacagatgttggcaaggttgtggagaaaaaggactgcttttacactgttggtggaagtgaaaattagtccaaccattgtggaaagcagtgtggcaattcctcagagacctagagtcagaaataccatttgacccagcaatcccattactgggtatataaccaaggaatataaattgttctattataaagaaaattcaagcatatgttcattgcagcactattcacaatagcaaagacatggaatcaacctaaatgcccatcaatgatagactggataaagaaaatgtggtacatacacaccatgaattatatgcagacataaaaaaaaggagattatgtcctttgcaagaatatggatggagctggaagtcattatccttagcaaaataatgcaagaacagaaaaccaaataccacatgttctcattataagtggaagctaaattatgagaacacataaacacatagtggggaacaacacacactggggcctgacagagggtggagggtgggaggagggagaggatcaggaaaaataactaatagatactaggcttaacacctgggcaatgacataacctgtacaacaaaccttcaagtacaacaaacaagtttacctatgtagcaaacctgcatatgtatccctgaaaattttttttttttgagacagagtctctgtcacccaggtggagtgtagtggcacggtcttggctcactgcaacctccacctcccaggttcaagcgattctcctgcctcagcctcctgatgtatccctgaacttaaaagttttttaaaaattgtatcttcttttaccaattcatcccttcctccccctataccccatcaactactgattttattagtgtctccatagttttactttttccagagtatcagatagttggaataatacagtatgtagccttttcagattggcttcttttgcttatatgcatttaagtttcctccatgtacttctgtggctcggtagttcatttctttttggtgatgaataatgttccattttctagatgtaccacagtgtatttatccattcacctactgaaggacatcttgattgcttccaacttttggcaattattaataaagctgctagaactattcacatgcaggtgcaggtttttttgtggacatgtgttttcagcttctttggagaaataccaaggagcacaattgctggatcatatagtaagagtatgtttagttttgtaagaaaccaccaaactatcttccaaagtgactataccatttgcattcccaccagcaatgaataagtgcaggtacacatccttgccagcatttgtttttgtcagtattctggatttcgaccatttcaatgggcgtgtagtggtatctcattattgttataatttgcatttctctgatgatatatgatgtgaggcgtcttttcatgtgcttatttgtcatctgtttatcttctttgatgaggtgtctgaggttctgtggcccatttttagttgagttgtttgtcagttttagattttgtttgtttgttgagttttaggagttctttgtatatttttaataatagttctttatctgacatgtcttttgtaatcattttctctcagtatttagcttgtcatttcattctcttgacgttgtctttcacagagcagactgtttttattttaataaaataaaaactgtccatatgtttacatatgttaaaaacatatgttctattttaataaaataaaaaagtccagcttatcagttctttctttcatgaatcatgcctttggtgttgtatccaaacagtcatctcaaaacccaaggtcatctagattttctcctacagtatctccaaggagtttatagttttgtgttttgcattttggtttgtgatgaattttgagtttatttttgttcagggtataatgtctgtgtctacctatttttttctgttttgcatgtggatgtccagttgttctagcaccatgtttgtctcctctttcaccaataccatactgtcttgattactatagctttatagaaaattttgaagctaggtagtgttatcctccaaatttgttttttctttcaatatttgcttgctatttggggtcttttgcctctccatataaagttcacaaaataacttgctaggattttgattgggattgcactaaatctacaaattaagttggaaagaactaacatgttgacaatattgagtatttctaggtctccatttacatggactatctctccatttatttagttctttgatttcttgcatcagagttttgtagtttttttcatataggtcttgtacatattttgttagctttataactaagtatgtcattttcaggggtgctaatataaatggcattatatttgtaatttcagttttcgctttttcatcattagcatataggaaattaattggcttttttgtactaatcctttattctacaaccttgctctaattgcttattagttccaggagattttggcagttatcttggattttatacaaagagtattatgttatctgtgaacaaagacagttttatttcttccttcctaatatgtatgcttttaatttccttttcttgtctgattgtattaactagaacttgcagtatgatgacgaaaggcggtggtgaaagggaacattcttgccttgtttctgatcttagtgggaaagcttcaagttttttttaccattaggcatgatattagctgtagggattttgtagatattatttaataagttgaggagttcccctattcctagtttactgaaagttttcattttcaatgggtgttattaggtactttttagatatcagacactaactcacaaagtaaataaaatactcaagaatctcagagtcaagtgagaaaagcaagtatgcaaataaatttttattgtacaagattataactttagtgttctggcttataatttctagtttactcttctaataagcctctatgttgtgaacttcttgggagcagaaaccatctgctttatggtaataatcctagccacagtggagccctccaggagtatagtagaccctcaacagatacttgttaaatggataaaaagatagagtgtgataattaggataatcacaatatgaatttggtgcaatagaatcctagaggaactagtgttagggagagctgaggagaccaaatgttgttcaactattcatgaggaatgagggaaagtttcctaggtatataaaagagaggaagccaactgctggcagaaaggactatacatggaaagaccaaggtgagggaaagagtccacttaaagaaaagctaggaattcggagaaaatcaaggggattttatgtgattggaatttagagtatttttgagggtttgtcagaagatgaggctacacatatttgtttagaggaaaaattttgatgattcttctaaaaatcacttcccattcttatcagtgtccaaagttggctttcagattttgctgtgactaaaggaaatagttaatgaataactttaagaatgccatgttcaagaagagtttggctaacctctgctctaagggcaggagtctgggtagaaagggaaagtaggtcagtaagatcaatgaaatttctcaattgagaaagcaaggatgggaagcaatgctcttcctcttttttcctgataaagaaaagaaggaattagaaaactcatcagggctgaactaattgttatgtaaagcctcccctagaattagcaaaaaaacagaacttgtagctggtaaaacatttatacaggacatttatacaggacaacacctgtgatacccccagagaagagaacagttgaatgtttcttttaaaggaaagaatttttagagttcaactacagctaaaggttagtaagatgtttgtatttccttacatattatctttgaaaatgaatttcagtaatagtaattaatgatgcattcatggtagtcctttgtcttttttttccacagtaattcttacatacatatcttaactacatgaaaacttctgaaattctattaatgaggtttatggaaagctttgccatttgaatataaggctttctgcccaggcacctggtaacagctcccaaaactgcactggtatgattatacttttatttcaaatccattttctgaagtgacaggtcatagggattgagtcagcctcagtgactccttttgcccctctaggcaggtgatgttcatgtcagtttgtgcattggctcacgtagcccctaccagaacgtattagcttcctaggtctcagataacaagctactcaaactgagtgtttaaaacaacagaaatgtattgtctctcagttctggaggctagagtccaaaatcaaagtgttagcaggccctggtccctctgaaacctgtaggggactctccttgcctcttcctagcttctggagttttaccagcaacctcgagtgttccttggtttgcagctgcaccactccaacactggcctccatcttcttatggcattctcctggtgtatctctgtcttcacatggctgtcttttttttttttttttttaagagacggagtctcgctctgtcacccaggctggagttcagtggcacgatcttggctgactgcaatctccgcctcctgggttcaagcaattctctgcctcagcctcctgagtagctgggattacaggtgcccgccaccatgcccggctaatttttgtttttttagcagagatagggttttaccaatttggccaggctggtcttgaactcccgacctcgtgatccacccaccttgacctcccaaagtgctgggattacaggcaagagccaccacgccccgccttttttttttttgagaccgagtttcactcttattgctcaggctggagtgcaatggctccatctccgctcactgcaacctctgcctcccgagttcaagcaattctcctgcctcagcctcccgagtagctgggattacaggtgcctgccaccacacccagctaatttttttgtatttttagtagagaagaggtttcaccatgttggccaagctagtctcgaactcccgacctcaggtgattcacctgccttggactcccaaagtgctgggattataggcatgagccaccccgcccagccctggctgtctccttataaggagacccgtcagattggataagggactcattctactccactgtgacctcttcttaacatctaacatctgccacaatcctttcctaacatgtcacattctggggtattgggacagttaggacttcaaaaattctttttttttttttttgagacggagtctcactctgtcacccaggctggagtacagtgccgcggtctcagctcactgcaagctccacctcccaggttcacaccattctcctgcctcagcctcccaagtagctgggactacaggcgcccgccaccacgccaggctaattttttgtatttttcagtagagacggggtttcaccgtgttagccaggatgatctcgatctcctgacctcgtgatctgcccgcctcggcctcccaaagtagtgggattacaggtgtgagccaccgcgcccggcctcaaaatttctttagggttggagacacaaaattcaacacataatgcagagtgtaaacttttcagggacagagagctcttgtatagctttgtatgtgcaaggctcagccagggtcgagcccagtagctgctggccaaaccttggttaaatgaatgaagaaagtatatgcaaatattctgctctgttcttctgagtattaagaattgaatctctgtttgccctgtctaagaacctcttcctgatctggcctctgccttcatgtctccaccacacccctgctagaatggtacattgtagtccagtgaaaatatttgctttccttcaaacaccacatattccctgacttccttaatttatgcttttccttattcattaattattatcccactccccatctctctatatcaaatcagtgctctcctatctattagaaaacttaccccgggctgccgcggtggctcatgactgtaatcccagcactttgggaggcagagaggggtggatcacaaggtcaagaaatcaagaccatcctggctaacacggtgaaaccccatctctactaaaaatacaaaaaattagccgggagtggtggcacatgcctgtaatcccagctacttgggaggctgaggcaggagaatctcttgaacccgggaagcggaggttgcagtgagccgggatcacgccactgcactccagcctgggagacagagtgagactccgtctcaagtaaaaaaacacacacacacacacacacacacacacacacacacacttaccccaaatgttacggatgaatgaatgttattataattagttatttttacttacctccctgtccccctaggatgagagcccattaagtcaggacctaaattgtatttatagttatatttccagcgccaagcacagcaccagaagtgtatttaccttgaaaccctaggcccttcaattacatggacctcttcaagctcttgtaccttgtttgctagacattttgctgggtactggagacacgaaggccgggggaaagggagttcatttacagtaagcacattttagatgtcaggcactagcattctgggtaaataagaaattcgcgttataaatgtaatattttatgctttttttttaaaaaaaaaaaaaaaaggagctccagattgtaaaacttccagaccacataaaacctgcatctgcccttgcaaagcacatgctatgctgagagaagtaattcacaaagcaaataattctggccatgttttcctgtgtaattaaagtgtgatctccttcagcaaaccttccatagacccccatctagaaattatttctttctatcccaggccctcataacaatttttatgtatctcttttattattctacatttcgtttcaaatatctatgtctctatatttatgtcttatttcttcctctagattagaaattctatgaggaccaagtcggtcataataatcttcatctataacacaatacttgacaaatgtttatgctcgataaacatttgaatggctattaagagcttgcaattttttatttgtttattatttattaatttattatatatattatttatttatatttatttatctcccttatttattaatatggtccaggaatttgcatttattatcccatttaatcctcacaaaaaccacaatgtaagtactaccattatacccattttgggatataaaaactgaggttcaacaagatgaagtaaattgaccaaagtcttgtagctaataaatggcaaatctcagttttaaacttagatgtgtgtctgaaaccaaagctgggtaattaactactgcagaggaataagtcattcttcaaaaaattgaatagatatattttttgtgcataaagaattcccagttggtagaggacagatacgtatatctgtatctatttttaagtgatagtgctataatgcccccaaataaaatgctctgggaacactgcccaggagatggctaaatgtgcctgtggaattgttgaaggataaactggttcatctggagatgggcattccaaacagaggaagaacacacaaatggcacaggagagtctgaccatgagggccacacaggaatttatgcataattgataggtatagtgccagaaggaatgtattggaagttgagattgaagaagtccatggagcccaaattaatagttacttcatattgttaggagaatcctagttagggatccctggcagagatgtcatgggcctgaactaaggcaacaatactaagatgacgtgagaggcatttctgaattaaagatgactgcatttgttggatgattggaagtactagatgagcagtagagaagaaaatgcagaagtttctgatttgaaaattgggcagacacaattaacccagataaggaacaaaagggagaaaaaaaattctgggagaaaataatgatttcattctggagcaactgaatagaaatttggagtagagaagactgatctgagctagagatatgaattagtggattatcaatatagcaaaggataagaccacctatttattaatttattcaaaaaatatctgtaccaggcactaatctgtacctaatctgtaccaggcactagactagatgctagaggcccaagggggttgtagttctcatagagattgcattctagtgagagatgggcaacaagcaaacaaacaaacacaattaatttactgtaagataagtgtccttacaagatgccgtgattaaaaaaaaaaaaaaaaaaggtgtgggggactagtttagatggagtggtcacagagcacaatttaaactgagacctagagagacaaaggacccctccaagaaagagctagaggaaaggaaaaagaggagaattaagtttctccatcacaccaaccacacttcaagtgcttactaacacatatgactggtagctacgatattgggcaaacagatacatagaacatttcccaaaatttcaattacggaaatacagagaggaacgtttataatgtcaaaagctgaagagaggccaagttggagaggacctaacaatagagccatttctgttctctccactttcttgaaggtgagtactaaatatttattaaatcatcaagtggaattgtggttttagaaatgggaacgccccacttctgattttcattaagcaagcatgtgaaatgctagaactggaagggatcgtggcgattctggtttgcctttttcacccctcccctagttatacaatatggaaacttgttcagaggctgttttcaaggacactcaggcattaatattggagtcaggactagaaaacaggcctcagcctaaagttttttctacaataatatggatatatccaaatcagagttaagataaaacatgaaatacttgaacccaattatttcactttaattcaagccattttccccatatcacactaattgtagagggtttgaacatttgataattaattggagtttcataataccataatgcttcaactcgaaagacattttaaaaaatctttcataaagtgtactttgccttcaagaagaatatgcagagtttttttctctaatcctatttttgaatattagttttgctaatgccccagcttcataatagtttcagacattatttcaccagtcatgagagcttgagaacaaatgacacaactatgaaaaataactctgtacaatagatatttacttttttacttttatttagtttaacaagattgctaaaattattcctgttataattatcaaaaaacattccttttataattaacttatctttaaaacttcaaaatgcaacagggagcaaaagcaaattgttgttattatggatagtatatataacttaaaaaataagttggcaaccaaaacattatgaaataaaagaaaaagaggggtaatcctttttttttttttttttttggcttgggagataatgattagaaggtatggttatgaaaagtgagaacgtatgtggagcaacataaaattggttctttgtttattttcttgagaaatttagacaaaaacaaattgaggtggaacttggttattagattatcatgtttgatatgtggataagaaagtactccaaatatttttaaatcaaactaattgatctatagttgatttatgttgcgagaagaaaattttttaatttgtctgattgattccatttaccaaggttgttatatgtagtctcagatgtgtgcctaattctaagatttactccagagaagagaaggaaaagagttttacaaagaactcagacagatcttagcagttaaatccaagaccttatgttacagcctcaatcaaagcccctcactttgcagcagaagtgtctttagagacctttagaattattaattaacctcattgcaggcaaacttggggggctgtagaaacagaacaatgtaacataaacacttaaggcttacaaatagaagttattgcattcacaaagtctcccctgagtacacaaacattcaatgtcttcacattatccaagtataaagtgtgaattccttaggttggcatccatgttccttcccagtctgcctcagtcttctagttttccttgaagccaatcctgcacattattcaaactgggatactcactattctccaaatacatcttgcatatctccgctctggccctaggctcatgccatgtacggaaataccctctactttcctttccactttcctaatttctacccatctgtcaagatctagttcagattgtacattctatatgacttaatatttgttctttaacacagagatctttcatccacaatactcatttggtacttaacatatgtggctttgcaatgttgatttattactttatgtgtgactatttgcctttcaaaggtcataactttctagagggaaaggaaatgagttagcatttaccaagcacttgctgtgtgattctagtatttttatgttatttcaattcatcttcacaatgccagaaaatagatattactgttcacaatttatagccaaaaaagcaagacctcaagaaactacaccaaggttactcaagtatttattggtaggattatgattcaagcctagatctatgtagctccaatgcccatactctttcccaatatcacagtatcccataccatccccctctagtagggttgttttatcccacacagtaccaaccacagtatgtttagtataaactctgtatcagtgtggttattattttgctgaagtcagcctgctctatattgtatatttaatgcatagatccccccttatgatgacagatttctttctattattttaataacatgtcctcaaatagcagttcaacaaaaccctctatctttgtgtatctgtatgatgcccaataatctgtttgactgattatttggctaactgaccaaattaactatttaaatatgaggcacacattatactgcatccttctgaggagctagctcatttagatataagaaggttgtaatcaaccagcagctttgaagccttctgttgttgtcttccatgtgaccacctttggtatgcccctctcttcacaagtttcctaatacatgtcttctcattctactaaaaagatctttttgatctcctacaagtatctcctctttttaataacattgttcacgtgaacgtagttgcatttaatagagaaatgaaggaaaaaggattcaggaagactagctgtagacttcccatatgacttccacgggtaatagaccctttttgggttgtcgttatactagatctgggccttccatctacagtctctggaactcagtttttgtcagtgtatccaggagtaatcaagcttatatgctgtaataccatgtttttaatatatgatgcaaaatgtaactactcaagataccagaatgtgctataactagcacattgctctcaataggaaaaacactaggataaattatatttttaatgagctggaggcttggtgagcctggactctgagagggaaattagccacccaagtgaccctaatgactactgtcattgagctaggatggccagatgagcccatctcatacgttacccctaccaccaggacagcacatttatgttagccacctgcagctggagctggagatcacctcgacctcacagctctggagatctattgcgaagatctttcttctacgactcaggtggactctccctcctttattctcccaatttattcagttttatcaattctgtttgcaagtgtaacttatttgacattcaaacatgccttgattagttccccaggccctttttttttttttttttttttttgatacagactctcactctgttgcctaagctaaagtgcagtgatgcgatcttggcttactgcaacttccgcctcccaggttcaagcaattctcgtgcctcagccacccaagtagctgggattacagacatgcaccaccatgcccagctaatttttttttttttttcaatagagatggagtttcaccatgttagccaggctggtctggaacttctggcctctagtgatccacccgcctcggcctcccaaagtactgagattactacaggcgtgagccaccgcgcctggcccccaggcccttttttttaccctatgagccaaaatcaggatagatatgtatcctggatattgttgaagtgctaatatttttgtactttatccttttgtttggggtgtagcctcacagggtcctaattttgctcaggtgtctctgatctaatcccaccactgggctcacacagtcctattcatgcagccatcaaatctagacactaacacactagctcatcactcttcagtctgctgctattctcagtacttgctttcttctgagtttgcatttctgcttcattttcatcctctgaagatttctcttacttgcaagcttagccaagcatttaaaagtattttataactattttattcagaatttttagctgctttgtaatgaaaggggttttcagaatatctaatatgccaaattactggaaatagcatctcaatatttaattttctttaaaacttctcagttttctagatgcctttagttcattgtcttatcggaatttcaacacttccccatgagacaaacattattccctccattacccaagcaaggaacccgacctgtagaggacaatcctggcttcccacatatcccaagagagccagaactagaactcagtatcatttttcccaaccactcacttttttttccgttcatgaaacaatatttttgtttgtatgtctcttatatgctcagcctgtacccgcttccaaaattacacaaaacaaggacctaaaagtcctttatctttgtctttcaggaccatacagattgacagcatagatggatgggtaaataaatttatttcagaacagtaaaggcagtgatagtggtgtgatcaatgaaaggacaatgtggtttcaaaaaagtcagttcttctggaggtgagggtagaggggacagcagagaggagattgtacctggcctcagtcttaaaggccaagtaggacctcgttagatagatgagaatagcaggaaaaggcaggcatccttctagccaaagcaaacagcaaacagcctgggcaaagacaaggaggaacaacctgggatgagaagctgtggttggcaactttgtaaggctgaaatatgaaatacaaaggggcacaatgaagttaagtggtggagaggtaggtgaggtcaaataataggaagctttgaatgcctatgtagaagtttagaccttatcctaaaaggtacacagatccttagaaggcttttgagcaagagagaaacatggtaagatatgttctttagaaagatcaatgaaaacatatttatatcttaattcccactacccaatacagcctctcaccatggaggttgtaggatttgactggagtaacttcccaagcccccagacgctcagagttcaaggaatagcccacgaatggccatgagaaagacttcagtgtaagtagtaattttccttctttttttttttttttttggagacagagtcttgctctgtcgcccaggctggagtgcagtggcgtgatctcagctcactgcaagctctgcctcccaggttcacgccattctcctgcctcagcctcccgagtacctggggctacaggcacccgccaccatgcccggctaattttttgtatttttagtagagacgggttttcaccgtggtctcgatatcctgacctcgtgatccacccgcctcggcctcccaaagtgctgggactacaagcatgagccaccgtgcccggcctttttttttttttttttttttttgagacaggttcaagcgattctcctgcctcagcctcctgagcagctgggactacaggtgcacgctaccacacccagctaatttttgtatttttagtagagatggggtttcaccatgttggccagaatggtctcaatctcttgacctcatgatccgcccgccttggcctcccagagtgctgggattacaggcgtgagccaccaagcctggcggtaattttcctttttgagtcatgaacactcttaaaccatctgccgtaaagagagaaagcctacagcacctcctttctcctcaaaacatcctgactagtttagaggatcctctgagactccagctgagtaagattatgctgctgatgatctgtcacagcttgcagcaggtcaggctggcatttctccattcgctcagcatccaaaggttttataattttaaagactttttacataatattaagagaaaaataaaaactgcataaatgaatatagcacatttcatctaagtgatgatggtaaaagaataataccttttaagaagaaggctggccgctccttactcttggctactttagcttattgctcacaagtttctgtcatagcacttgtccacttcctaggcttctataagcgtttgtttacatgtggctcctcctaccccaggctctttaatctttgtattcacagtgcctaacacaacataggtactccatagatgcttgtctattggaagttggatggatgggtaagatacatatttttaagtagctatctaactttgtttttaaaactgctgatattgtgagtgaccaaattatgtcttctatacattccatacttaaaacataatatgaaattagctgacagtgagcacctcttatgtaccaggtattggagacaaaaagcaaatgccaacgtatgtcgttttgtatgggtctctgccctgaagttgctcactctagctagaaagggagtcaaataaaccaatccagtggaataagcattatgatagatacatgaaaagattgctaggtgaagcacccaacccagcctagagtagagagactaaggagagtatcagggaaaatttctagaagattacaatccctgagctaatttcagaatgagaaatgagagatagaattttgttccactgtcaatgtataatgatgtataataatgattagtaacagagccttcagcaatatgaattctggatgatgaataaaataggaaatcagagtccccaaatcattctagtataaaaagtatttgagttatttataaattgtgtttatttattcaatcatcagatgttgactgaacactgttctatgagtattaggtatacctagaaagtaaaccatgatacctcacctccaggatattatgatctcactgggggccacaatgccctcacacacaaaacagttcttagaaatgtgggctattatattaatcagacccagagtcattagcctcagcagtatgcatgcaaaagcagctaggctcaaaatgtttgagaatggtttatcatgaagatcatgggtcttgagcagctgtaatataaaaggaaaaaaaagacaaacgggaaacagtaagataaaagggtattacagaatgggagaaactgaaaagtgaagaaaaggatgggctaaatgtggaatattaaatgaccatcagtcaagtaccattctgagcaccatggaagcgaaaaacatgaagcagatgtcaaatgcaccatcaaacttctaacaaggcagagtctcacactggcagttcatagctggatgcataacagacatctttagtttgacctgcaccatgcttttaccttttttaaccattgtcatatttgaattctgggaaatttatataaatatctagattcttggcttatctttaaaaattagagaatctgtcaagattgcttgacattcctgcttggagcgattgtccagagttgagcagcagcagcccccttttagatgaaatgtgtcttccagtttgctatatttccttctcatcctgctttgcccatttgtgttttgtgatctatatctctggaatttagattttgacatacctggttaaaatctaggaagagggaaagacattcgtgtaattaattataatatgaaatggagaccttaatcactgtgggagtttatccattcatttaatacctatttcctgagtttctgctacctgccaggcatcttactattactggggaaatgctggtgcctgggttctaggagttcacattttcttgagaagaaggtatgagcaattatgacacactgtaaaacatgctgcaatagatgcatgtgtggaagacacagtgtggacccaaggaacaagttatcatatgtacctggggattcagagaagtgatggttgaactgagttttaaggtggcctgagccaaaacgtagaggtatgaagcaacatgtcaaactcagggaagcacagggactttgatgtggctggaacatagggtgcctggagacgtttaagcagggtagtaaggtgatctgatttgtattttagggaggagaatgtatttggaagattgaaactaggatcaaggagacttcaagttgggagtttatcctaaaagtcaaaacctgaattagaggggatgaaggggttggagtagataccatgacattcagagagagaagagtgcaaggcagcatggaatgcggtattgaaccatgtggttcaaatgataagagctaagggcagttaaagtgaatctttgagtgtcaatggttttggaaactatattctgtaatatatcgtaatcccttttttaaattaagaatcctcctctggcttatatatacttcaatgtatactactatactttaaatatacttgaattttagcttagtttttaaaaattttcattgtttaagttccctctccatcaaatggatgaaacacttaacttacagcaaagagactagctctgatgcttctggctatgtgaatgtagacaagccgatttacctaagcatcggtaaaataggacttgtaatactttaaagggctttgatcctctaacaggaaaatatatgtgaaatgctttaaaatctacagattgctgtaataggttattaggataagaaatttaaattagaaaaaataaatcatttgaagtgtgcttaggacattttatttgcattccattttacaaatttattttttgtcatttatcttcactattaaagtaagtatcataattaactataatataaaattctgtttttaaaaaaggcatttaaatcttctgagtttcaaaaattccaaataatatattttaaaagatttgttttgatagtttgaaatcaatggggtccaggtaaaataaataaaatctactgtcatgcaaacattatatgttttctgtttttaaagacaggaagcagtatgtcaaagtgcaaaggtcactaacaaaatgcccccagatgggtaacataaatgggtaatgggcaatgatgtttcataatgacctttgaaagctgtattcttcctgcataaagtcacattgcatattaaacatgtaagaataatctttacttccataggaatcttactctctcccatttttattaaaatatgattccctccataaagctttcattttcccatttttgataggagtatgagtacaagaaatactttcctcttaattttataagaagtgcaaatgtggtacaatgacagcttttttttttttgtctgggaacaggagaaagaggtcaggactatggcaaactagagcatgaatgacccttctaaagaagcccattctctaaaccaagtgttgcctcacagcaaaactgggagctagtgttgatggaatgccagacttttttcatgtgaagccacaaatccatatttcatgcaaattttcctaattttaaacttgggcagctaattcaaacatttgtaaatattatgagtcaaattcagcctttgacttgctggtttgcaatctctggtatataccgtattctagacttttggattgtgagacagaaaatctatgtccttaatcctgcctttgctgcttactaaactcagttaaaagcttagacaagtagtctcatttcactaatctaaacatttgccctaatgatttcttcatcaggttatttattttactcataatttcattataaacatttttcaaacataaggaaaagtttaaaaatgttacaatgaacatccgtgtacttgtcacctagattccactattaacattttcctatactttctctatcacatacctacccatctatccaatcatcaatctattttgctttctgttcctgttttaaagtagttgcaaaatcagtatacctttcatttttttgaggaataaatcaaatgattcatataaagcatcaagcacaatatctagcacagggacaaatgtcagagtcctaatcactctcttccctccatctatatgtactatatagagcttcagtgttgttggacccactaagaatgtctatacgtgtgtttattctggggaaagggggagatttcgacaataaccttttcatgaaaattctgttggcctctacgtttaaaatgtatccccatttctctctaatccaccctcttatttaaaaagcaaaacaaaacaaataaccttgagtagaaaaacacaaatgtaggaagactttagagttggaaaggaggcaacaaactggctaggaaaggaaggatactgtagtgagttcccaggactttttctttcttttcttttttttttttttttttttttttgcttgctatgtatttggacagagcactggagaacctgcagcctggaaccgccaataagtacagacaaaaacagccccaagtaaaacctgctccctttagataaatgactgggaaaaacaggtagactaatagaaccggaaaacttttgataatactgacctactctagccaaacaccaaagaaaaaactgtcccctcaaccctgcagtgtcagtagtgctatgccgagagctaggtttctggctctaccagcggcagccaggagaggcaactctaagatggccttacacttcttccactaggctgttgttggtagacagaacaagaactgaatttccatccccacctggcagcaaataggcagaacaagggggtacgaggtgatgctagtcgatactccactttctagtggggagctgaactcgtacccttacccagcagcaacaggctgaaatgaggtggcgttagttggcattccattcccctactcctaatattgatgggaaccagcaagaagcttaacttccacccctgcacagtggcaatgaagtaggagaaagaggaaatcagtactagttggaaaaccactctgcctgccaggatagtatcagcagggccctgtgaggagctgaactcctacccccatgcaaaggtaaggagaataaggtggttcaaggcagtgctagtcagcaccccatcttctctccccgattggtgttagtggatccaagcgcggagctgaacttctactcccacctagtggcaatgaggtagaatgaggtgaatgctctgtgtctccctccctgctgttctgtgatcaagggggagctgaactgccatgcccacccagctgcaagaggactctattttacatcaaaggaatcatttacaaatgtaagtcaggtcaattcatttcctcacaggctccccatttctatcagagtaaaagtcaaagcttttaaaatgatctacaaggccctgcaggattaatgcaccgttgtctctctgatagtggtaggcagagttctaagagggacccatgatatctacctcctggtgttactcccacagttaagttcttacataagaaaagggattttgcaagtaattaaggttactaatcagttaagataggaaaattatctgggtgggcctggcctaatcacataaacccctaagaagcaaagagttattcagctagttggagaagaggaagtcagagcttccaaatgtgaagaggattcaatgtgccattagttgcttgaagatagagagagccatggggtgaggaatgtggatggcctataggagctgagagaggccccagttgatggccagcaaggaaatgggtaccttattccttatgatggttaatttcatgtatcagcttgactgagtcattgagtgtccagctatttggttaaacattttcctcagtatgtctgtgagggtgtttctggatgagatgaacatgcaaatcaataggctgggtaaagcagattgttttccccaaggggtgtgatcctcatctaatccactgaaggcctgaatagaataaaaaagcattgagagggtgaatttgctgcttcttcctgactgtcttcaagctgggacatcagcagtcttcatctgccttcaggcttagcctcagcctacaactatttaatatatatcactggctctcctcggtctccaatttgccagccacaaatcctgggccttatcagcctccacaactacataagccaattccttatgatgtatgtgtatatactataggggtgtgtgtgtatgtgtatataccataggggtgtgtgtgtgtgcaatctcatgttggctttctctgaagaaccctgactaatacaatcctacaaccacaagaaactgaattctgccaggaacctaaatacatttggaagcagatttttccacagaaatttgcaataaagctgagcctggctgacaccttgacttcagcataggtaggcaacacagtcaagtccacccagactcctgacctacagaactgaaagagaataatggctgtggttttaacctgctagatttgtggtaacttgttattcagcaatagaaaactaaaacagtgacttcattgtttaccattctcctttcctcattcactcagttcagccacagtggcctcctagttcttctttgacaacaccaggcacccttccatattaggatctctgtttggctgttcctttcctctggccagaatgttcttcctttttatagcgacatgactagtttcctcacctcttcaattttttctaaaatgtcaccttctcaatccatcctacccaggccctcctcaccacaacctatccctcctacactgctctgcctttttttctctccaaaatactttttgccttctaacgtgctatataatgaacttatttattgcatctattgtttattagtggtctaccttcattagattgtaagcccacaaggacagggatatttgttttgtttgcaaacattctgagcacctgaaacaccttcctggcacagtaggtgtttacaaagtatttgtagaatgaaatgagttaactctatgtcactttacctctgacttaatgcattgttacataatttattacttacagttcaagttgtgaggtgcactttacacctttcctcataataaggcatatatacataatgcatcattttatgcatggaaatgtgatagcaagtaacaaattctttgtgtagccattagtataaaatacatgggatggctctttctcattcttacatcattaagagctggaaaatagaagatgaactgagatgtttgggagaggagggtgggtgatgcaaatgacaacttggtcaaacctaaggcttgcaaaaacactttttaaaactactgatacagaaaattgaactaaatgcattttaagactttttacattctataattccatattattctgagctgtacacaaactcagtgaactattggctcaagatttgatctctgacctttttattgatgatcctcaaatatgtatttatagtcctctctgaaggcccatattcctattctttgtctccagctgcttcagaacatctccacctggatatctcactatttcctggaactgagtgtgtcaaaatcatactcattctcatgaccctggattccactcatctctccttttgctagttacttagatgctctctctcctctttttccaatgtctgagtcatctctggacctactgcttctcccttcaaatttcctctctcatgttgccctttttaaaattctcactgctgtcacccttcttcaggctgtgacttcctcacagctggattcctagacaacatcctaaatggttttcccacctccgatcatatctgtgctttcctctccgtcagccctccataggaccatctgttaattttcctaaaatgaatttaagtattcttaatgtctcagaatcttctaatgagccccatggcctacacagtaaattttaattaacagtcaagcaaacaacaaacccacaacctggcttgtaagatctttcatgatctgggcattcaaccttagtctcttcttcccaaaaatccctccctgcttttgtgtgcatccgtcatactgagtactactgtggtgcttgatacaaaaagagatgttttaaacaaaagaaaagtagaagtaaaggtagtttaagaaatttttttagaatgaaggaatgattttttgcatggtattttggtagttgttgcagtggggaactcaaacatctgtcctgatattagcctctttcttgatgtgcaaatgttatcttagtttgagaaacaattttacaagtagtgagttgctgatatcatatatcccattgaaagtaaaagcaacgtaaatcttaaatggatcaccctctgagctgtgttctctatttctttctgcagagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgagtatgtttctttaatctttattccctccatatctgacgccatcaatgaaaaagtcataactttcaattatgataccaaaagcaccttaattacaaaggaaagtggatgagagcatcacgacttctggtgcatgtcacaattttgtttgtttttgtttttgtttcctttgagacagaatctcgctctgtctgttgcccaggctggagtgcagtggcaggatctcagctcactgcaacctctgcctcccgggttgaggtgattctcctgcctcagcctcctgagtagctgagattatagctgcccaccgccacatccgactaatttttgtattttaagtaaagacagggtttcgccatgttgtccagactggtctcaaactcctgacctcaggtgatccacccgcctcagcctcccaaagtgctgggattacaggcatgagccatcaagcatggtctacatgtcacagtttaaatggtgttcaggtccttgatgcttgtggcacttacttccctcaaataaaggcgaaggtgctaatgttttcttctagatgttctgagacacatttgcatccaacagaacgttgagaagcatgcctttttaaaaatgatatattacttattttatttaaaaaaacagacttttctcccaaactcataaccatactctaaacactgtacctttataatgtgtatagtttggtgcaaatgtaaaaacaaaaaaatgcataagataatgctatatagagtttgctgatggtactaagttgtagcagtggcaccattcaactaaattcaagaattatcagcaacaatgtattaagcacctttttttttacctttttaataatttcaacttttattttagatttggcggtacacacgatgtttcttatatgggtatatcacgtgatgctgaggttgagcatacaattgatcccattacccagatagtgagagtagtacccagtagtttttcaatcatttcccttttccttccctccccactctaggagtccccagtgcctattgttgctatttttatgtccatgagtatccagtatttcgctcccacttataagtaagaacatgtggtatttggctttctgttcctgtgttaatttgcttaggataatagcctccagtggcatctgcattggtgcaaagggcattattttgtaagtaattttcaagggtactttactgagatgagattgacgtagaaaaagttgtacatacttatgacgaatttggagatatgtatgcacacatgaaaccatcaccacaatctatgccataacacaaccatcactccaaaagttttctcctgttctcttctttttttattattattttccttttgttataagaacaattaacataagatctaccatcttagcaaatgtttaagcaagcagtattggtgactataggcacacattgttcaatggacctctgacttatcttgcataactattatttattcttctcacaatcactctgaaaggtactgcctcatgttcaaatgaagataaacttccagcttgtcaaagtttacctaactatagagagtcagagctgggatttaagtattccattttaatgcccattacacctaccatatcccttccctccctcttttcattcttccatctcattgccactttcccccttccttctaatttccctttcctcttcctttcttttcctgtttcctttaacttattcaaatatttattggctgtctccttctactatgtcaagcttcctccttagtatgatagggtaaatccattgtgagtgttcctgcctatattttaattttactaatcatgaaaataataacggagggttacataaggagccagtacttatggctgatattatggttcatagttcataactaaacaaagcacttagtttgtggttttcattgtgcatttagaaaaatttgttttcattttatggctgtgatttataaatagaatcttataatttaccttatatttgttagccaccattccaacccttcaaaaaatgggaaaatctctctctctttctctctctctctctctctctctgacatacacacacacacacacacagtttacctgaataacatcatacagtcagttgactttagtaaggtgtccggaaatttgcatgaatagccttgtcgtatgtgtcactgtggtcctctcacatatgaaggcctctgcctactcatcaggtgcagttctctggaaggatgttgagtatgggagatacagcgtatagtcccacaccaggaccttgttctgccatccaagagctgagcatcattccttaaactacttcccttacctacttcttcaatactttcatgatatgtaagatataactggcagctatcaaaccttattgtgcatatacgtttacatgtctgtctttctgtactaggtggtacggtctctgaaagcaaattctctatcttatatgattttatatcctcaatatttagcacaatgcctggcacatagcagtctcccaaaaaagaagtgtttatcgaatgaaaaagtgttgaataaatatggtggtacattaagaagtcactatagcctgaagattgattctaaaattctacctaaagcatactaacgtatcttcatcatcctggcttacattctgtatacttgcggaccactttgtcatttcattacaatcagcattcatatcgtcattaaatgttcccagacacaaagcactgtcacatgcattaattctagagattctctaaggcattctaagtggcaggataggttattattattactcccattttccagatcagaagaaaagagatttggagaggctaaatgatctgtctatgtctccacagctactgactataaagctgaactcaagtcagtgttctttctcctctcagcacactttcttttcaaaatattgtcaacagtctctatggcacatcttcttggtgcacaccgcactgtgtgcacatcacattcgggaacacataaagcaataaagaactaatacttacatggtacttttgagtcagtcactatcataaataatttagtcttccaacaacactatgccttgttatgttcatattaaggataaagaaattgagctacagagatggcattagactctctaactctgtttaaataaaaaatccaccaagccataggctttatttattttaacctccatacatgtgagaggaaaaaggtgatctagtgatactctatggcttgacaaagaaaactcgcaagtatttctgcttcaaaaatagatttatccatttaaatattattaccaggaccacacagtaaataaggcaaccaatcagaattatagtcgtcttagatattataattcacagaatataacaacaatctttgaagttcacacagcatatccgtttttatgtataacatttgcaaatacagatgatgaggaaaatattatctgcttttttcagttgagaaagaagagggaacatttttccttagtatatcaaaatgtatttcacctgtagctagctagaaaatggctagcttctggaaaccatcattctcagcaaactatcgcaaggacagaaaacgaaacaccgcatgttctcactcataggtgggaattgaacaatgagaacacttggacacaggatggcgaacatcacacaccggggcctgtcgtatggtggggcaagtggggagggatagcattaggggatatacctaatgtaaatgacgagttaaagggtgcagcacaccaacatggcacatgtgtacatatgtaacaaacctgcatgttgtgcacatgtaccctagaacttaaagtataataataaaaataaataaataaataaataagaaaatggctagcttcaaggttcactattggaatttaattgcttaacattgagagaaaagaacagtcttgagaagctcaaacattacaatgtggaaagcaaaatggcacagaagaattactaataatggaatatggaagataaaatattttcatctataacttgcactggacatacaggggcaagcaaccttcctggaaaatgcaaagcaaaaactctaaataacaatcaagagctagctgggcacagtggctcatgcctataatcccagcactttgggaggctgaggcgggcagatcacctgaggtcaggagtttgagaccagccaggccaacatggtgaaaccctgtctttactaaaaatacaaaaattagccaggcatcgtggtgtgcacctgtagtcccagctacttgggaggctgagtcaggagaatcggttgaacccaggaggcagaggctgcagtgagccaagatcacaccactgcaccccagcctgggcaacagagtgagactctgtcaaaaaaaaaaaaaaaaaaagctaaataaaattcaatacatattaataggtcatgtaagattaatttgcaaataagtcatgttaacaataatgtagtagtttcagagaaaggaagtagaatccccagggaagggatctggaggatatgtctttggtctcaattgttcttcataggtaagagacttgcataatagacaataacctttctaatgaggggcagaatgtccattcctactctcacacacagactatagaatattcctaggtaatttagttattaatggcttactatgtgccaggtattgtatatgtatgtatatgtatataaacacatatacatacacatatatatatatacacacacactgaagaaagagaagagacagtaacacttaaaatacagcatgtcatagtatacatattcaataagtgttgctattactatcaactctgctttaagactgtatctgttgttttttaaaaaggttcagatacccatgtataaggagggcctcttttggatagtttgggctgttccttctttgggacagggattggactagattggcatttcccaaagtgtgtttcgtagaacactgaaacagcaggattgtaataggttgctactgtaataggttcatttgtacaggcttcttcaatgaagaacttctaaaaaacatgtttacctgtgtccattggaaatctcctagagcagatgaagtctatggctttcaaaaacattttgaccaccaaacccttacataaggagtaacttacaggacaccagtagtgggaaatgctcgagtagatttgttattattatttgtgacggagtctggctgtgttgcacaggctggagcacagtggcgtgatctcggctcactgcaacctctgccttctgggttcaagtgattctcctgcttcagcctcccaagtagctgagattactggtgcctgccactctgcccagctaatttttataatccccataattgactgattcctacattcttgcctatacagaaaagggaagtaacgttttactatgttttaaggttatgggtgccatctagtgttcatgcattgtcaaaacacattacttagcaacctgaagatggagggtcctgaagctccattatagggatttttttccaggcctaccccttatccccaccagaattccaaaattaaatatttaagatgctcaaagacaaagaaattgtcaccttgggctacatcctatacatgtattataagtgatcttttctagtttctcttttatgtattctatttctcagggatttgttgcagaacggaattcagtaattgaaccatattcttgatgtattcatggaggagaatttagggcattcagcatgcagtcacattaactagtgcagtcgcctcctcaggcattctttctgcagaaggaaagctagaaatgcttctcttattatttgtttcagtgatttgttaggaaaaaatgtgaaacagagcacagagaagcaatacccctagaaagagattatttcctgtctctccaagcaattttagtttattcattcctcaggcatccaaaaatgatcaccccagctgacttgctaactccaaagctcattcttgatatggactttaagtatttaacaaagtgtgtttcaagatacgtgattgggaatatgtattgccagaagtgaaatgctgcagctgtcgaagtgaaggtataataggtaactggatttccaaattagaatttaaattgcattgttgatttaaaaagagtaaaaatgagtcacagctgacatgggtatttcaaaaattttcaggttatcttcatgtttagaaacgtgcagaggggaaggacttgatttgccaggactctattttcaagttaattaaacagaatatgagcactatacagactattctccatcttggggtactgataaggtcaccttatattgttacctcaaataacatttctaaatctctgctggtgttgttgcttccacctctccactgccatccccagtaaagatgtccaaaattatttcttcgatttcctgaagtggtcctcatatgagccgccagacctcatcccttccagtcaccatgccatacctgccgtgccgttcctctctggctctggttcccggtcccatgaaggaaccttgctttcctagttttcagtactgatgttctctgcctaagaaactctctctccctctgtgtgttcctgaaacaagcacgctctgaaatactaaagaggatctggggcctatgcagtgttagggacaagtctcatctccacatctcagtgctattatttcaccttgtccccaaaagtgaaacagcttaaatcagaaatcttatgaaacctttcacctaagccacaccttcagcttctcttctctcatcttcaaaacttggagtcacccaaactccagcaaaaccactactctcccttcaggaaaaagtatcagtaaggtttcagaaatttcaaggtactgtatcagccaggacatactcttaaactttgaagtgaaatccaactaagtggagttgatgctgtttttgaggaggtaaaagcttattgccttaaatctgaccagttaaatttagagttctggtccagaaaccatgtggaagttgcctctccaaaccagcatgcttgttccaggcatttgctctctctctctaacccactgcatctagacacattgactcttcagtcatttctggcttttgcctctcttaattgtagagcccatttagacttctccctaccttactggatctttcttcctgcacagctcagaactcactgctcacctgatcacaagaccacctcaaatgaaaacagatatggcttgtgaagaggctccaggggagtcactcttgctcagccttggcttcagagccccactagccaggctgtacctcctggcccagccaccagagtgtgggtattcagcagggcctgactatgggcagagttctttattcctgatgattgcctagtgcatataaacatcacccatcacatacagacttccagcctttggaaagaggaaactgtacaaaaagcctatctaatcatatccttttcctgctctctttaaagcctttcaatggtgtcctgctgttcttaaagcctaaaattgttaacacagcccacagaattttgcagagtctggcccctgcctgcctggacagcctgccccatccacaatacttcccctactctcactgatgcttcagccactctggatttttctttacctatggtcagggatgctattcaaaattttcacaccttggcataaccctggcacccatccacacaatgaatggccgtagtgccacagatgccagacagcagggcagtggggacttctagggagccagagttgtgggtcactcaggagggctcaggacagcagttatttactaacaaaccacacacaagtgtgtttcactgttgtacaaaaaggaagagccatatcactgagtggggacggagcagcagccctgtcccctctgtgctgagctccctcctacctccatcttgttcactgaatttcctcgaaaaggaacttggagtagacaaggaaaaaccctccattatctaaaagggaccagagaactcatgaattgccccaagcgtcacttaaacagcatccccattgtctgacatagaatccggctgtataatatatgttaaagaaaagcagtaattaggccgggcacagtggctcacacctgtaatctcagcactctgggaggctgagttgggcagttcacctgaggtggggagtttgagatcagcctgaccaacatggagaaaccccatctctactaaaaatacaaaattagccggacgtggtggtgcatgcctataatcccagctactcaggatgctgaggcaggagaatcgcttgaacctgggaggcggaggttgcggtgagccaagatcatgccattgcattccagcctgggcaacaagagtgaaattccatctcaaaaaaaaaaaaaaaaaaaaaaaaaaatatatatatatatatatatgtgtgtgtgtgtgtgtgtgtatatatatatgtgtatatatatgtctatatatatgtgtatatatatgtgtgtatatatatgtgtatatataaaaaacaaaaacaacaacaacaaaaagaaaaacaataaaatctgtgggcactcagcaaactgtgtagggaaacaaaattaacattgctcctttccagttatattccttaagtcttgcttattcaatgtgtcataaacatactatatgtcacaacttagcaaggtgcagtgaaaatagtacattgggaaccatgtacttaacatcagacttgtaacacctgactcacaatatcactactcaaaggatttaactgtaagcagctttcaaaagtctgaaacttaactcagtgcaccagtaaaacaccagcttttctcgcagtggtacttccaaaactgtgtataatagcggatgtgtgaaatgcttcataaaaaaggttcataattcaatgaaagatctgagaagtcctgcagcaaattttttaaatgctgataaagtgttttttaacattatttaacaaaataacttttttagtctttggatataaattactatcaagtgaaacatattttttgaaaattctgtcataatctccagaaaacctcttgcaagtattttatttgacggaagtaaattttcaccttaaaatcttgtttgcagagctcagagacattcacaaagtaccaaaagctactagacactaaggatgcaacgtgaaaaaaatcattgtgtcctcagtgaacatgtagcctcatgaagggagacagacaaataaatagattatttccaatataacatggaaatgctaacggtaagttccagggaccacatgggcgtaaagaagagaccatccttagctcagcctggggaagtaagaaggattctggaggggaaacttcccaacaaagagggcccctagaaagcaaaaccagtagagaattggagataaaatgcctaacctttattgaatatatgctcagcacaaagcattttgctggatactgcgctgtgatttcactgaattgtcctaacaaccttgttggattgaaggctcagagaaattaaataatttgtccaagatcacacagataatcagtaatgatggtggtatttggaatactgttgcttctgatttcaaagctatgctctttctgcgatgcaggccttcaccaaagaattgaatttggcagtttacttatgtctgaggcagtccatactcaaagtctagttaatgaaaaaagcataaatgcctaaaaaaagagcatttaaaaggagacatatgagtcaccacaggaagccattgtatacgaaggctgtaagattgaggcacttagaagcaacgttcagatcctttgaagcttcccttgaggatgaaactgtgttttattcatctctgctcccttgttgattaacttagaacggagctactgagcaaatgtttaatgaacgaatgaatgaatgaatgaatgaatgaatgactcatctttgcccacttctctgaaggcagttggaaatcctaggacccctctcagttttattcatctcgcgctctggccaattaatcccttctgtcctgaagattcagaatacattaaagcttttagatttctggccaatggaatatatttccaattcagacagatcatttcctaattgactaagaggaattcctatagatcagaaaaatgttaattaactattctattacatattaaatgctaaatacttgatgatcatttaaaatatgtttatgacatattctcttcttccaaaaaatttgggtagcaaggacttcctatacaagtttcaaagtgtcttctctatgtaaacatctaaactgtggtataacagctgatcacagataaaggggaaatcgtgcaaagagttctcaagttttaaagaaggagtgatcatcgacttgatcatccctcctgaaatctcttttgagtcaaaaagtggactgatttttagtccaatttgtttgggcctcagaataacctattttattagctaatctctaataacccttagatttgcattaccatatatatgtataaagtatctcactgtgattatctcatttgatcctcatagggtaccttcaggataggtaggaaagtgatcatgctgctgttttattcaagaagaaactgaagggttcaacagttttctaactcaaagcctgtttgactctaggtataggcctccttctttcatgacaagctcccttacctctaacgctaactactctaggaatatacctgatgggagcttgattggtgaatttacctcctggagttcttgactccagacaacagacgtcagttccaggtaacttatatgaaaaaaaagaatttattggagaaataacagatagtctacaagctcttcaggaagcctgaggaaccaggctcagaggccaaggaggaaatcctcctactaagggtgctgggctgtcaccactggccacttatagccaaaccacactgccatgaaaaatctctgtttctccatgcaccttacacgttagtgtggggatgctaaattcccaactggaacatctgcttgacttgccctgttgtagctgctgaggggtgggaaaagggaatagctgccccctccagcttctctaatgggggtaaggctgtgcctccttcctgtcttgaattgtccccaaataagaagcatatctgaacactgggtagataaatgataaatgaccatcggggattatttggctcactgagctctatttgaggaatgttttaggtctagtatcttaaggatcataagtgcttcttaaacaatagaaattatttcagagagaagcctctagtgggaggagcctaggcctgagagaataaaaggagaagaattgaagacaaaggatgagagacatattgtgtgcttcctacctagtaagaacttcaaatggtttgattactattatcttgcaggtcaaagttctgagattctgagaggttaaataatttggttaagaccagactgtagtaaaaggactggactctaggtctgcccagcttcaaagtcagtatttttttcatctttcacaccaactccatagattctatcaactttgatcatgttactcctccacttaatatctttcgacaagttcctcctgcctttccatccaaattccctcttttaatgacaaggagaagagttatctcctttgagtttgctctagagaggaatgcaatagaatgggaacttgagggtagagtttgttttttgtaacagtgtttatatgttgatggaaatgattcagtagagagaaggaaattggtgatttatttagcaattcatatacatgtatattaagtggaagaagtggaaaacactttggctgtatggctgtgactcttatttgttaattatttgatttattgaatatctcttattgatttattttgtttattgctgtattcgaagagttttgaaaagtatctggcactttataagtgttcaataatgaaaacatgactgtcaaatattattctagtgtttataggaaatagagaggtatatcagacattgttctcaccttcaggggctgatagcttagtggagacataagatatgaacatggtcgtaatgcatggcagattgataaaaagaaacaactactatgacttattcttctcacgctgacattatttaaaatccattcatctaaaaaaaatccataataagtttcttaattccaagtatcatcttatcttcttcatcatcaccatcaccacttctgacaccattcactccaccacatgcaatgaccgctctcaacagctgacataagtggagagtcgatgagcgtcctctaacagcaaattgctcatacatgagctgcttctctctttcaaattcccaagggcagcattggccctttctctgctcaggttctgaacaactgcagagcttgaagcagcagatatcatgagttatgagatgtgaactttccagctagtatggaggtcagtaagcataagcgttatgtctgcatcatcattgcatcccagaacctaacccagtgctaggcacacacaggtgttcataggtgatgaataaattagatgaaagaacttgaagtcttcgctaatgggaaaggaaagcttttggagattttgttctaagttttttccctgaaattctcagaagattcttttttaagttgtctgtgacatctatgagccaacctattgcctggttttccagtttaagtgtcggttggttggaagagagaaatcctggatgaataacttaccagagaataactaaatatggatcagtagataggatcccaggggtagcatttttcactggaaaaagctgttcctatactacatatttgctgtgcttttcaaatgtcggggctcacttgctcatcagtgaatcagtaaaaaaggaaatattcccttcctcagttgtcaggcccacagtattttctgccccaggaacaactatctccagggaatattttcatttgaaacatccattttcttgccctgaaagccataaaagatgagacaaatcactctgaaagcaggtaccaaggtctggacttttcagcctgaaccatagtttaccttgttacatatgaaatgcttaggtatcgtcattctaataatgtggctgatagcattgataataattggttgtttctgaatagtacttttgatttatggagcaatttaaaatttttattcttatggcaaccttgagacaggcaggggatggtattattataataacaactttttatgaagaaaccaagcctcagagatgcttagtagagaatacaaagtgataatgttagatggaaacctgactatttagctgctcttttcttatactttttttcagttattttcataaactggcctatgaacctattgttcccgtaagacaataaataatatgtagtgactgggattatttcctaaaaatccacaagatggcagtaaaagattttgcattgaactggagacactagtggaatgtggccttttgcccagttttcatactagtgattgtatttgatcacagtattaaaactggttatcataatgatagctttttaaaatataactcaatgaattcaagtggaattcaaacctgaaagtaacatttgtgactttgtttattattattattattattgtgagggtcctgtatttaaacataagaaaccactaggaatcagctgggagctctgatagccaagatttcttgagaaagctcaaaatgagaaatgttactccttcttcaacgttggactgacctataattctcctgcttgaaggggagaaatagaggggtcaggaaaaggtcaatagttaatcttccttataatttgatttcttgttatttctctatgttcagaatctttcctggagggaaactttcctgatggaccaatgttgctgtaaaacatattccaggaacatttattgcctatatctctcaggttttgtgtgtaacataaactatactaagctatgggtagtttttcatgtacttttattattctactctcagatttatgatagaattaagaagaatgaagactatatttttcttttctttttcttttctttttcttttcttctttttttttttttttttttttttgagatagagtcttgctctgtctcccaggctggagtatagtggcatgatcttggatcactgcaacctcagcctcccaggtccaagcaattctcctgcctcagcctcccagttagctggggttacaggcatgtaccacaatgcccagctagtttttgtattttcagtagagatggggtttcaccatgttggccaggctggtctcgaactcctgacctcaggtgatccacctgcctcagcctcccaaagtgctgggattacaggtgtgagccactacacctggcctacatttttctttcatttggcggagggtctgcctccatgctgagcgggaactccctttgttgatggggctcgtgatcatcatcaggcacatatagacctgagtcagtagactctgtaattgagaacatcagaaaaaatcacactgtttctgtttctaacataaaggcaagcaagtgttccttagcatctcctttgtgtgtagcagacaggacttatgcctcaaaaagatggcagtggatttgcataaacatgtaaaaacttaaaaatgaacgtcaggtatctctggttttaaagtcctttgggcagtctcttatgctacccaaatttatctttccccttttcctgacttttcttctctaatgtctttttacgttcatattcatagtcatttcttatgacaaagagtacaaccttaatttttgcttgcttgtcagagattctcttttcaccttgggtggctcaccatctttccctgaaggaaaaaatatatatagctttcatacccttactaacatagatttaaacctcctgtcaggaaataagatattccactccattcctctgtttattcatgtatcctctcatccctgtctacaacgaacttgataggggcttctgtgtttatgtcaccttgctatgtggaatgtaatgatgactaagccatgtgtcatgtccttgggatgcttatagtctaacagaagtaataagcaggtccaccccgaattatactataagaaaagtacagtgaggcaagggagttccatagaaaaggcaaaacctcaccaggtattctgaggaggattcatgttttccttggtaatggaaagaccttcccagatcctcactgcaagtctaagataaacgattttttcatcaggccacaaaggaagaacatgaagtccaatgcagaagttttgaaaagcaggagtgctcaagaattatcaacagcccagaccaacaagacaccagatgcaggagactatttggcctctgaataaacgggatgaggagtttaagcactgggctaggctaggaaaagcaaatagctcccaggagcaacaattcagttactcaggacaacctgaacaaactcctgatcttctcactcctctgtaaagtgaaaagacggagactcaggatctttaaaggcccttccagctccaatatgctaggaatgtatgtgtttgagagaactttgtgtgataaaaaggatgcactgaagggtttttgaacaattaattttttattagttatgactaaacgtatgttagttatgaataaagacttccctttattttatttatttattttttaattagagacagggtctcactgctgctagattgtgcagtagcacaatcatagctcactaaacctttgagctcctgggctcacgcaatcctctcacctcaacttctcaaatagctaggactatgaacatgcatcaccatacacagctaatttttaaaatatttctaagatactgggtctcaccatgttgcccaggctgtttttcaactcttggcctcaagcagtcctcccacctcagcctctcaaagcactgggatcacaggtgtgaaccacctcacccagcctaagacttccctttaaataataaaagttttaaaatcagaaattaaaattaaaggcatacattcatacttttttcagagtccattggttataacttaaccatccaaataaagtctcaattcctcgatatagcttctcttaacttgtccagccatatctctaaaagtcagtcttttctctgtcatgtaactatatctgacattgtatcctctcctgaaaactttccccaccccaccttcttctgaataactcttctattctattcatccttcaaatcttagattgttatattctctaaatgccttctcttgccattcccacttcaccttccaaaaacacacagaagcacctccaagttaggtacccctcttaatgtgctttgtatatcccatactcttcctatgacagcacttaccatgttaatttttaaagacatgtttagtactccattttccttactctattgtaagccaggacaatgcttgtcttgtttacctgacatataatatatcttataaatatataatgaatgaatgaagctagattactattttaagtcagtagattctgagtaaagatctagtaaaataaatgcatggccaacaatgcatgggcagtatacacctgtattgcgcaggacacaatgttaggtactgtccctataggctgattatttaaaggtttccagctgacaggaatgtgtgtaacctaaccaaacttgaagaatatttataagatattgtgtctgacatctcaaaaatcaaaatgagaaacaaacaaaatgtagttatatcttttgtatagcaaccactagagggcaatgaaagcaaacgttgaacatcctttgggggaaaggaattgtaaaatgttttctgattgaaatctgggcatataatcttatgtttgggatagttataggacctgtaggctgtggtttctgtgattatgggtttagtagttataattacctttctagtgtggaattcaaacctagattctctgtgataataacatcaccttacactgcatgtattatctcatatgaacctcctgtagcactaccagggaatatactattttcccattttccagtgaaaaaaaactgaggttcagaggcattaagctagtaagtagccataaggtagcaaaatattgacacaaatcctataaatacttattaactacttacatttaccaggcatacaaaattctctgctaagacagacagtctgggaaaatacaggttccaaaattaattgtaccagtttagaatggagacatatggcaacagctccttaaaagaagatcttgtggttttaggtagccatctgatgatgctgccaataggctaataggctggagcctatttacggaaatgtagtcctggaatgtgggaaggagacatccttctgtctccacactggttagactctatctaagctatatgttccactctagttgctgcatttttataaagatatcaagaagccacagaataggattaaggttcctggacatgatatattagagggtgaagggcaaagtgaaatgtcccaaagaaggagagagaaagagagggaattagacacagtgatgcttaagctataggctcaggagccagagtgggtccgacttggcatacctactaaaaacaggaaatgagtaattccagagatctgggttggcctcttatccatgtcagatattgaagagaatacttgtttgtattctccaggattcacacagagctaaagaagaagcctttttactgctttaatctgagcagacatcagaagcactttccagaggcccccatgaggcctgtgtgcagggagctaagcatggccttgcttggtaactgcaatagctgaagtaaagtgaaaggcactgaacattcaaacaggttctttcggcttgccccagcaagctcaacctgcagcttgcccaccactttcttccattctctgctccatccacctcttgtgtgtgtatccccaaggtgggctgcaggagttctgtggtccagctggagcgtaggcactatgggagtaaattttcttggccccaggataaatctgtgtcaccaacagagaacgcacatcacagggtcagctggcccttaaccaaccttcccacctctggttacgtgatggtaactatccagaatgaatttattgagaattttgcttcagaggaggttattcaccacagtaaggtctccattataagaactggatcagttagcatggcccgtgcaatcaccatgttattaaaagacttgagggatgaagttgcctttgtagctgttgataatggtgaattgaagggtgtgagacaatggatcttaaacatggcagtcttttcctaaaactgccagatagtgcttccagcaaagattatctcatctctgcaaactccaacctagtgattatcacatcaggtgcatgccaggaaaaaggtgaaacactttaatttagtcagtctaaatgtggccatcgttaaattaatgatgtctaatattactcaatatagtcctgctgcaaattgatagtttccagtccagtggatatcttaatttatgtagcttagaaattgagtacatttttcaaaacccatattattggaaatggctgtaatctggacactgcccatttccatttcttgactgtgcaagtgcttggaatccactctggaagctgccatgggtggatctttggagagcatggggactcaagtgttcctgtgtggagtggagtgaacattgctggtgtccctctgaaggatctaaactcagataaaggaattgatcaagatctagagcaagggggaaaatgtccacaaagaagtgattgccagtgcttatgaaattatgaaaatgaaaggttatacttcttgggccattggcccatctgtaacagattgaacagaaagcattttagagaatcctaggagagcgcattcagtttccacataattaagggcctctatggaatgaatgatgtattcttcagtgttcctcgtatctgagagagaatggtcttgcagaccttacacaggtaaagctgacccttgaagatgtggcccatttgtaaaggagcacagaaacactttgggaattcagaagaagctcaagctttaaagttgtgtaaagctatcattctgaaattatagaagaagagaaatagcagttttgggattatatataaaccttttgaataaacttgaattcctaaaaataggaaataggaaagggagtagagtaacggccctgtttatttagcctctatcgcttttattattagcatccagatgctgaatgatacttattttttacaattcctaagcgattgcatcaaagaaggtgtttttgatacgtctgatgtgccagtacttgccttgtatgtatatgcacttgccatttggtccaaaagaatgtatgatctaggtgtttattgttttatagaaatcctgattcttttaaatacgttctaatatttttttggtctgatgggcttatattatactcatttacatactctttttagaagtcattactttctctacaatgtaaaaataaaagtgcacataaagaaaaaaaagtgagtctgcatcctgactctgttgtttgtaattgtgaatttcggcaatttatttaacttctctgtgcctcagttttcttatcaataaaatgatgactgtgtctacgtatagggctgttatgaggagaaattgataatacatgtggtgtttagtgtaacatttcgcacctggaaggatttgataaatgttggctgttatttttgttgttgttgctgctgctgctgttgtttttgttgataaagcacttgcaagaccattctgcagaaatgaaggtagacttatttgtgttgccctagaaaatgccattagaaccaaaagaggcatcatctaaaagcaagagttcgtaacaggtttagttttaaatactaaaccatgtatcgcctaactgatcttgaacaagtcactcaaccttactcagtctccattttctgatgttactgaggacttaatgtgtctgttcactgtgctaagcactgtgggtggagtgaaaaggccttgtgtcactgcattgtagttactcaagcaggagccagctgaccatctgcaggcatttagagggcttgggagaaagcattcctgcaaaggatggaatttttttatcaaatctcagaggatcctataaacaatctttgtttctgctcttgaaaatgttggaaatgaaatttgttctcactttgaaattgtcttcctctgatacggcacgaggctggtcctcaaatggacttgcattcaaaagtatttcccttgaagtagtacctgccttttgagggtaactggattcctttatttctcaaaggttaagaagatgaaaaagtatggctttggaaccagcaagaggcttgaaccctgctttactatcaactagatgtgcaaactttggacaagtacttagcttccccaaactgagtcttcttatttataaaatggagccaatgactcctgcttcaaaggattgttatgggggttaaatgtgccaaggggtatagagcacccatcatggtgcctgacacaaagcaagtggtcctgccttctttgacagtgccaccaacagtcccagtgctcaaggctctaagaatgagcttcaactctaagaggaatgggcattggccttctggtcatcatcccatctcctcaactctgtaacattgtgcaactcctgccagataaaagctgacctcaagtacatttcccacaattctggtccctcctcacactctatggtacctaggggtctagtgtcctcatgctctttcttgtctgtccttcagtgaaagaaatcagatgaaggagttcacactgaggttgaatgttaggaaacaggcaaagcattattttaactaactatatcgagattttcacagtatatctactaagtttaagaccaaaacagtgaatctcaaatggtgggattataggattcccagtaaaccttatgaggaaagaatttcagaaacatcataagtgcttcataggattattcatttatacatctcaaaaatggctacataaggctgtgatcttcttcataccaaacccaagtcttatttttattgatttcagtacatgacatgacacagcccctggcacattgtagatgttcaataaatgtggactagatagtcttgaggccatatcagatggacaaatatatttcttagcccatctattactgttaaacacaaccacaaaccatctataaaacacttgggatgggagagttggaagacatagaagtattttgctttagtgttaaggatagaggaaataacagttcttctagaaaatgccctgtaactggggagaatttcataggagaagtaggatttgaattgagcttcccaaggcaagggtggcagcatgacatgtggctacgaagaagagtgtttccagctcagtagacagatggaagttcaaaagctactagtaaagggtgttgatgacaagttctaggtagaagctagcttgttttgaaaacctgaaccccagcatacatattcttgtcttcattttagtttccttggaacactttaaacacttctcccacatttttctctcacacttctacacactcccagtcctcagtctctgccacatatacagcaggggaaaaaatagggctctctttctctttctctctgttatactagtttcctctaatcttttgctcagtaatatatcacagaacaactttcagctcattagctgacaactccaatgttgttcttttagaatggtcaaagatttactcttttccctgatagccaacaatacataagactttaatgtcccttttcacatttcctgaggctaaaattttcacaacatttaactcaaatttaaacttcctaaaactattttgggaaaaagaaccaggaagatttattttaacattatttttcttaatcaaaacagcaaatgtcgtgaattttacacactaaacatactttttagtgaggaaatactcttctagaaaaaaattgaaattgtacatgctatttacattaaaaagtagaaattaaaattttcttttagtgatattaataatgttattaggctgaaccatatgaagttgccatttctgtaggtcaagttgaatattgtcaattttgtgtggttcaacctaatacagactcttgcatagaggttacagccatagattatactaagaaaagagtcttcaaagaatttagtccagaaaaaatgaatttattggtttactgatttgaaaagggtgcttaaacaaagcagaagtattcttcaatttcccatagtaaaagcaaaagctaccattcattgagtgggttttcatctgcatcaccttattcagttctcaatataactctgcaaccattttgaagtagatattcctatcatcacttaatagatgtacagagtcaaaattccaatcctgagtctgctggacaaaacccacactctttcccttctattacactacctcagagatttaacacagaagataaaccacttctccaaaatacaataccagttagcgtcaggacttggagttatgggtacatattgagttatttgcatagaaagcttgactttctacagttaggtctttgagaaaaaattctataaagtaggagatcatcttatatatactgagctcctcaagaacagaggctatctaaataatctttgaatccatgggacatggcacagaacctattgtaaatcataaataaacatagtaaatcacaaataaatgtttctagaataaatgagtaaacaaaagaatgacttttgcatgggaaaaggcagaataggttcatagctctttgcagaatcaaacatcttacagtatgtaggtattttaaaaccacaagatagaatcacagaatcataactccgaatggaataccagagttcctcttgtacaatatttgtttgtttgttgtttatttaataaacaaaggaactaaagtacaaaattccaaagctaaatgatgacacaagccagagccaaatctaccaagccttcttgaaaatatacctatccctggatttttcttcctttaggaacataaatgtgctaaggtattatctactcatcaataattaccaaaattatttatatttttatacacagcatatatacatgtatacatacacacacacacataaacaattgcagcacaatttactttctttagggaaatacttgtttttattgcacacagcatttgataaatatcaacattagccaggaacttataggtgtgagaaagaaggcagctaaatacaagtttttttggttgaaaatcacacccattcactaatcctcaggtggacttgttctcaggaagaataatttacattgtcaaacactcacaagcctgaaaaagaaagaaaagaagggtgaatttgtattcatacaacagataccttcacacactttatcctggaaaacacattgtagtttatacaatttgttggtgagtgatttatgctttttatgcatagttatttgcttagtctcctattcatccaaaaatccatactttttcctggtttacctgactttctcattatgcataactttgaagagaagcaatatttagcaatgatgcattctctgcaaatggatggcatgcatgcatctgtcttctaatataatattcatggttttcacatctccaaatgtgaattttccccttagtgcttcttcaacccgtattttgtatcttagggccatacaaaaattgaaacatttcagtacttatttcatacttttaagagggaagaaaatattggcaaaggatgggtaagaaatggaggttacaatgcagatgatataaaccttgagctacatacatacccaaaagcccaaagttgagctattgttgactgactggttctaggcaaggactaagggtcagttcaggagcaaatatagaatttagaacattcagtttataatgatggtgttaagaagggggttgaacattcacttggttctttgatatgtagcaggtctctatagtagacaggaacaagtggattttgaagaagctccagagacctataaatcctaaggagtttctccagaagccctacatggaaaaaccctaacttgaggcttgtccttgacttagagtcacagagcattatgtataagcaacacagcctaagatagcatttccaaatgctagcacagataattttgctattttagttttcaggagcaagctcctctggcttgcctgtatttgacagctaacccagtgttttagttgtattgatggtggaatgagaaagatttatttttataagtctaattatgagactttcacagcacatcagtttggacttcaaaaggataacacaattccagaaattaggtggtaaacagccagtcataggctgtcttcccaataaagcacgataaatcaaccagagaagagaagagaggatgcagcaggaaagtagaggcagatcactcagagggaggtggtaagaaaaagcaagtgagaccagctgcaggaggaggaaatagacacagcccagccgcagaggaaaggtaaggaaggaagaagtgaagggaatctagtcacagatgcagagagacagatcaggagaggatcacagaggtgagaccctgcaggggagaatgggaggaaagggtgagggtataatagagaggaaaaaaaatgagaatcaagggaccacacctttacagtgcagtgtgcagtgtatggtgtacggtgtacagtgcagtgtacatggcaacttttccaggtggtaggagtttgacaaaagagaaaacaatgcaacaggaaactgcatgcaatgcaaacttggaaagggaaaagatagaggatgatgatttaaagaatgcagaattatatgtctgggtttcatggaactcctcgtgccaagaacagcaagggctagtcacatatattttattctgttgctggcaactgttagtgcagtgaatggagtttgagagttccaggtcctctgtttcaggcagcctccagtgcttcttccccttctggatgactgctgcccttgtgcttactgacttaatgcctcttggtctcacaagatgtggcagagcccaccgctgatcagaacctgcagccagcctctcacagaactggccccaatataggctgaagcataattcaaggaaggagctgggtgagaaggcactgaacttggccacaggaatattaaaagggtttgacgttaaaatgctctgggagattgttgtgctctctaatacccaaagtggcagagctgttgaggaaagctggtccctgcactgaccaagcttgccctaaagaaacagggaaacagcctgtagacaccaagactacagtatgcctggagggggctgtttactgagatggaaaagcaaagtggcccattgtgatgaccggcacgaggctgctgttagaaggcatgtgatattatggggaagggaatgtgtatgcgtggggagcagaagtagatttggaagcacatagcaacattgatgactgtcaaagataggagtgttacctgcagacctaaggctggagacagcaggtattataagagaagagggaagattaagtaggggagaaaggacacagtgtgtgcaccacacagaccgtatctcttatgttagctctgctactttcgaagcatctaatctttctgtgcctcagttttcccatcttaaagttgacctcagcaaagttcttgggaggattaacaataacaagcctaacacaataccctcttgttcagtattcagtaactagtattatctttattagtgatctccttccacagttaaattcttggtcacaaacagtttgaaagtcaattgccttgatttcttctccctttattccctctctccttttcttttctgttctcctgattcgcttttcccctccttcctattatttactgagcattcactttgtgctaggaactgaacgaatgcagtggaactttatttcttgatgtttttatctactgaatggattgtggctttgcagctccgttcacatctgaagctctggcaactaaccatggaaactcacaccttgctggagagttgttttctgcagggagcagcaattctatgtgctaaattgggaggctggaaagagagaattggttagtaattagaaaagatataaattactgaaaatacctccctgcctgtgtaaatggaaaatttttctgatgcttataatatccacttgggactgatagtgaaagattcagcacagccttgactgcttttatgaagtcttgatatatgcttcagagaacaaaggaaagtgatgaaggagagatgattccagacgatggtcactctttctcactccttattgtatggagtttgtcttttcaggagagttttgaaatgattctgttgctgcttctagttttcccaaatgtctagaagcattttttgaaatcagtaatgcttggagttaaggctgtatttatgtggtctgcctaatacttcccacaaaagtccacattcaagatggcagctccagtatagagaattatgcctttcaaggtggcaaagttggttgccaccttctagggtcctgcttgtctgctatattattctcctcgcttatactttcttttctagtttacatcgttttcactattagacactgaaattggccatgaaatccttggtgagctgattaataattcctctttagaggaacaggagtctttgtgaaccttaaggcttcttcagagttgaggaagagattcatcaagcacgtaaagctgtagtcaccctcagtaataatgtatgaggacatcgatttgtgccacatcctgggaaaacaagaagcctgaaacagtggctgggactgccctcgtggggcttacagtctagttattgatatttattcattaaaaaggtaaatagaaaaagaaagcaaatcacagaacatcgtgtgttattatgggatcattctttaaaacaatgactatatatggaggtaaacatgaatgtttttccactcacatatattcactcactgacaggaaccaggcactatcctagacattgggaatgtagctggggatatgtaaatatgtgtagagaaagtgtatagagttaatttgtctagtttattatcagtggttacctgaaggttaagatagaaagatgttcacagtttacttgctgtttttttgtattgttttagttgtttaaaatgagcttgcattactgctcacctgaaaaataataataaaagagtaaagaaggaccaaaattcatgtaatgctgccaggttgtggggctgatggccaagtaagtgtcacggaccatcatgattacaggaggtctgggaagatagaacctgacctggacaagggagaaggccaagacttcaaagaatccaggaaaacaggaagtaaaacaaggaggaggaagttaggcccaagggaataacattaggctagggatggacatgaagcttctagcagcagcagagggtttgcttaggagaggaggcgtgtaatgtaggacattgaactctagcattctcatctggactctactacaaatacactgagtgaccttggaaaataacttcattctctgtgcctcactttttccaccaatgatatgggaggactagacagaatccactctaacgttccctcatatcagagaagtatctggtcttaaaaagactagagagggttgtggtaaaagctgcattgtgaaagggcttaaatatagggctaagaaatttgcacataatttacaagcagttaggaacacagatgaatatgagcatctgtggcatgtataaaatgtgaaaggcagtatttaaagaaaagtagagtggttgtgatatacaagatgactatcaaggtattgagagtagacaaaagggagagggaggatgggagagagacagagattagaggaaaagctaacatcaattagaagtctaccacatggtaatgagatataatatcatgctatatcaaaaaaccaaatatatgatatatcaaaaagaacaatattatatatcaaaaacattctaatatgatatataaaaaattatgtcatgatatatcaaaaataaatccagaatgatagagaaaaattatatatatatatgggagaagctctcctgcacaaaataataccagctaataattctagaataaataaagaatttataaaataaccattttttaacccgctacaaaataactatttcaagaaagcataatccatagatgctaaaacaattaggggttaaagttgactggaaaaaggatatttacatggtctcaaataaaccaccttatagattgttatttgcaaaatagaaaggtgccttttaaatgaagagatctggtggtccatgtattttgagcttcctgctatgacgcagtaagaaatacacagcattcattacacactggattttgctaaaaatgtttcacctgattctgaagaaacaatcagacaaattcaaaatgcagaacactctataagcatctgactgaaattatttttaaaaaaagagtaaattttatttaaagaaaaatgtaggtaatgttcaagactaataatgactaaagacatagtaacaaccaaatgcaatgcataaaacttaaatcctggatttaagaaaaaaatctgtaaaagacatttggaggataacggaggaaatttgaataggtgcaatatattaaatgttatagaaatattagttttgtttgctttctctggagtaataatggcattgtggttatacagaaaatgtctttacactgggaagatgccttgctgatatgttagattgaaagtggaatgacgtctgcaacataattcaaatggttcagaaaaagtgtgtgtctgtgtgtgtgtgtgtgtgtgtgtgtgtgtcttctgctaggcagataggtaggtaagtggagagagtgagaaggaggaagagagggagaacaaatgtaccaaaatgttaagaactgttgaatctttatgagtttttattataatgttcttcaagttttctataatttgaaatttttcaaaataaacaggaaacagggcctgtttcaatagttcagatcaatgcttagaactagcatagtaaattagaaaggaaaaaacaaaagcaacagatattttgaagagaaatagtttaataaatattatttctcattcatagtggtgaatacaagttgattttcatgcatctctgtttattcagatctcctcctcttgatttgactgattgcagttgggaagattttgacttcccaaaaagatttgactgattgcaattgggaagatttgatgaaagtaattgggaagaggggacttaagagttcttgacacagtttgcctaaactcacaaaacctgtttcttgggagcttttaggcaatgagatgattaccttatttttagatgaggaataagtcaaagaaatactaagatgtaattatgggcaacagccagatgccaagatacacataagcccaaacacaaaagaatgtcatcaacttgaggaactacgatgaaaaaaacatcagatgagtcccacatgcagcagccagagtttgagttttgcattaacagattttgaccaagattaattccattaatatattattcctgctcaagcctttcagatgttttaggagtggactgtttgacagatatgtctctggaggcagcattattccttcctttaaaattgattccaaagcttatgaacaagattaattgtgtatgaggaaaaaaggaaacaagaacccttttcacttacattacaatctcactcagattagtttatgtaaactaaaccaaattagtgaatattataggatatgtagaaatgaacatccttattgctttcaaatctgtatactatttagacaaattcctagttaataactttgacccagaacttagccaactgaacttgtttgaacaaaataataaggttcactgggaattagggcatttatgtgaaaaatggtattgattcagtatttccttttgcaggtgttattgcacctttggaaggacattttttcactatgcctgattgtgccacggtttgcaaaacatttaacacacatgagccttctacaattaatgccaatgctgactcctgacttggacattttaacaacagaaaataccatcccccctcacaaatagacaccttttcatacccagttgagaactactgttagattctaagtcacttagggctgaaccattgctttcttcaccaatccatcccccaaaaatagcacaatgactggcacaaagaaggcattcagtaaatatgtattgaatggattaatgcaatgtttgaaaatttgattaccctaggactcatgttttctataaatattatcatattttaaatttgcctacataaccccttttgccttttattgctaaggtaacacaaacctcaaattcagtagttaaaacttttttgtatgacttttaaaattgttatgatacaacatatttacttaaaaatattcacatactgttaagggctataaaatgaaatgtaacccattctctcctcttcagcatttctcccctccccaccacaataccatagccccttaaagcctctgttatcaattcactgtgtaaccttgcaggcattctctataagatcattcatccttttctttttttgaaacaaacaaactagatacacatatagttctacagcttgcttttctttaatttagcaatagataatgacttttttttagtttcaaaatattagacatgtatgctgttgcttttaatgactgcatagtattccattatatgaatagttcattatctatttaatcaatttattattgatagtgttttaacagtagattaaatagtgatattttaatacctgaaacccagaaatcacaaaaaaactaagtttaaataaagaataatagagcactttcagttagtccactgatttcaaaagggagaacatgttgagcaaattcagaaggcttttttcttaccaccatccaccagagaaaggatctcagcttcaaatttaaccctaaccaaagggaatctgtcagcctagcagcacacacacatctcatctcaggatagaacatttggtgggtgagttgagaagccacaaagcagatcttgaagggtaggaatttagccttcagcccagagtctgacactgcctgaacaatttagaggcttggatgaagtggaggtggttgtttaacaatgtttgcaaggacatttaagacatattggtgcttcaaggaacatattggttgctctacaattttttttttaattagcgaggcataatggtgcatgtcatgtcactgctatctagcctgagcaacagagtaagaccctgtctcaaaaaaagaaaaaaaaaaagtcttgggcctcaccctcaaagatgctgattcagtgagttcagtttcatcaaccattctccccctagaggacaaatgccttctgaaaaggactctaattagtacctggcttataacaagtgcacagtaactggttgtcaaataaattttaatgatttaaataaagttatgtgatttaatagttataaccattcattagtttaaggaatattgttgaatatctacatagtgtagtcagcactaaaagtatggagttaaaagagacactcaaggtctctacttatgggaagcttttctcggggtgggtgagataataaacagaataacatgtgggcctaaattctgtaagaaagtaaaaccagatgaattagagataggctgggaggctactttcaatgtgattgtcagcaaagagctctttgaggaattggcatttgagcttatgaaaataagttgtcaaagatgagaaaagctaggtaagagcactccagtcaaagggaccactggcataaatgctgtaagactggaggaaacttggactgatgcaaaacagaatgaaggcccttgtggccagcaaacagtaaagaagacagagtggaataagatggaataagagggataggcagagcccgaggaaaggagtttgaatttcattcaaagtctaacaaggagccaaaagaaagattttagcagaggagaggcatgatctgatacagagtttgagatcattctggctgccgagtcaaaaggggatagaggagggtgggaggagtgggccacagagacaatggagggacccatcgaggctactgtagtattcccagggaaaatgatagcttggcctagagggatggggtggagttagagaaaatgcatggaattagaatatggctatgaactaagggattgcatggggaggtgggagggtaagaaatgaatggaggttcttgattcagtggtttgagaggagaatggtggtagtactgtttgctgaaaatgagaaaactctcgagaaacatgtttgggagaaattttgagtttgattttgagcacgatgagtttgaaaagtcttacacatctatctgcagatgtcaagtaagcagatagatttcaagtctggagttaatgtaaaaatcagagcttggagatactagtatcagcttgtgtttgtataatatttgtataaggtttcaactattttttgcttatatattcttataaagatagttaactttttacttgaaatgcatgaattctagatcttactgtctttcagcctttaataagctgggtttggacagccaagttatactttattattttcatttaaagattccaaaataatcatccctctagaaatgacctggtaatccaaaacatttttaaaggtctaattttttttaactataagcctgtttttgcatcaggaatccaaatttaaagggaagttaatgtttaactgctaagatacataaatattcaatatcaatttttcactttgcctctgctccagaaggattctagtcttgagctgtaatgcatatactgtcagaaatattaccactctccacaaagtataacagcctccaggaggggaagggaacttaattagaaatttccacttcaaatacaatttatagttcactcactctgaaacatgctggagggtatttgaaaaatttaatgcataatgatctgtttgtctcaagttgtcaacaaaatacattttgagcatagaatatatttgtttattaagcattagacggtacctctgtgatttagtatgaggctctctttctagataaagaaactgaggcccagagagatgaaggggcttctcaaagtcaaataagctaacagcatgactggaactcagcactcctgactcctaggattgtgcttttctgtttcagtgccttcaaccctagcacttttccctggtcaaatgagcctgcattgagataattttatactctcccaagtcatcctctttgtgtacgtcaggagagggttcaacaatagctaataattatatgcccttactagatgccaggcactgttctaaatgctttacatgtattaactaatctaaccttacagcaactctgtgatgtggtactcttattatccccatcttgtatatcaagcttcttctacatctgtgtctaatttgaccagggtactgaccacaggaatatgaaatctaaaatgattttgaacattggccacttctctaagcttcaggtagatattttctaactgtctgcaaaactgtagatatccaacagacatagcaaagtcaacatgtctaaaacaaaatacattatcctcccacccaaacccactctccatcctgtgttcctgtcttgattaatggtatcatcacacctccaatcatcctaaagctttttgacaccttccccatttcccattttcaatctgctcaacacagtaaatattatttaaactctgtttggcttccagaagtatttgaggagaatagctgcatagaatcttcctctgttttcctctctcaaatttgtgccacatctcccaccctcaaatccaccctcatttgcctaatttgggccttaattatttgtatcattggtaacacttcaatagtatcacatccgattatctactgggatacttcctaccctgtcctcacttaattcattaaccccagtttctcactgttgccagagttgttctcccataaacacaggtccaattgtgttaaatgcttctgtaaaacccttccatagccacttattgacaaaacttcttgccctggcattcaaggtctacttctgctggcagcattttttctttctccctatctatgttctatgccagccatcagactgctcacaattcaacattgaatgtgatatctgtagtttccctgttacccacataagtatgtggtaagatcatttaatacatgtgaatttgtttattctatttgttagtttatgtatcaccttgttcagtaacaaatgtgaggtggggaagcagtttactaactgtgaaatacttttgagatgttatttttaagccatagaaataattaaatttacaacacaggggaccctagagatggtgtggcccagcaccttcatttttcagagcagctccttagctggcttgaataagttgatggcagagttggcaacagaacttacattttcacttcgttgcatctcatcacttcaggaaaaatgaaaatagatttttttccctcttgaaaaagaacgggagccttctacatgtatttaatacactgtaatacatctgttcatcttcctatccatggtctctctgaataaagtagagatagtttggatcctacaccaatttcttccctgctgccccctgccaccttgcacccagacccccaactgtgaaattattggcttgaaacagtcccctgtgttctgtacctgtctcattttaattgaaatgtggtgccaattatctagccttttcccatttggttactcctttgtatttttttcacagttaataattctgttaaatttgtagttcttacctacttttatcctaagatagtcttctaccaaacatattctttggttttattattgctaataaaagccagttaaaagtcctggtcacatagataatggatatgctataatacacatagcaactatttagtaagtacctaccatgtaccaaatattattttaagcattttatttgcttaaactctaataatcctgataacagcctaacaaaagaagggttcacatcttttgatgcatatgaggaaacaagttcaaagagattaaggaacttacccaaagtcatagagctggtaagggaagggaccaagatttgaatcctggccttcccgggtctaaacccagtattcttcccaggacactgctttcagagcaggcagatgacatgagctgtggtggaaaaccttggcagccatgagcatttgctctgccttctaagcagcatctccaagggggtccatccaacctcagagtcctgtagccaggctggccataagcacatgcttcctgcatattcccttcctgtgcattctctctacctgtaagcactcctggggcacaagaatgacgttaaaataatatttctcaattttaagctgaggaatgactcctcattatggtcaaatatactaaaatggcttatcatgccctggatcaccagatccttgagaggctatgtcatggttaagaatgcaaacgcggccgggtgcagtggctcacgcctgtattcccagcactttgggaggccgaggcgggcggatcacaaggtcaggagatcgagaccatcctggctaatacagtgaaaccccatctctactaaaaatacataaaattagctgggcatggtggcgagtgcctgtagtcccagctactcgggaggctgaggcaggagaatggcatgaacccagaaggcgaagcttgcagtgagcgagatagcaccactgcactccagtctgggagaaaagagagagattttgtctcaaaaaacaaaaacaaaaacaaaacaaaaaaaaaaagaatgcagacacttaaaccacactgcctgggtttcattcctgactttgtcatatgttagcaatgtaccctcggacaagttacttaatctgtgcctcagttaccacctctgtaaaatggggattgttgtgtgttcttacttcacacagttgttatgagggctaagggaatttctgtatatcaaatgcttataacagtgcctggcacatattaagtgttatgtacatgtcagctaccatcatcaccatcatcatcatcttcttcttcttcttcttcttcttcttttccttcatcacttctttctcacatttgttcctcccgtatctacccttcagtaacaactgcttcctgttcttcagatgtgcaggccctctctcacctccagccctccatatgtgcctccctttctgccttgaatactcttgccactggtctcctcaccccaatctccccctctgtgagaacctccacccatcctcaccttgctaacattcatgacctcatctcaatgtcactttctccaggaaagctcattcctcctcatcccttggtaggaatgcctcctctgtacgccacagaattctgactttttttgtgctagcacttaccgcccagcatttaatcatgtgtttagctgtcactgtcctgcaatgaacagcacattgcttgacaatggctatgtgtcactctagttcattcttcccttaaactggaaagtgaaataactaagtggatactttttaaaaaacaaatatatttcaatactgtgtttatctctaggcactacggtaggcacacattaaaagatagtacagtgaaccatagggtaagcatccatattgccatatttgatctcacaatcacttatctgagtctctaatgagatattacattatatcaagatgctggaaataacacccataagagataacaaaaaatagaatttagaaactagggaaggagaattccctgacacaggaggtatgcaagcacaagcaaatggtcacttggtgagaatgatatgaagggatgcggaagggagtgggatcactccctggaaaagtgaaaaatgtgttcaaatattaggatcatatagaagaagaaatgatattgttttgtgagccatcagagggcagaactgaagccaagaggtggaaagaaagattcaacacaaagaactgttttggtttttttcatttgtttgttttaatcactggagctgacccaaacagaatggattttcctgaaaggcagtgagttcttcattagtgttgatccagtgtcacatggaggttagatgatcatttgcctaggataatgcagtgagaaaatattattcactcatccactcacttattcactcacaatcctcttttattcttttgcacctattatttgcctgaccctatgccaggaacacaagttccaataagcagagatctgacttttaaggagcttataaatagatacattacacaactcagtttgaattgagtctttaagaactagaagaagttttccagatgaggaaagagtgagaagctatgttctagatatggaaaatagcatgtgcataaatgcagaaatggctgaatcagagaaattttaaaaggtcaacatggtgagggacaagggtataagaatgtgtttgaatcagcctaatgatataaattggggttgaagaagatcacaagacttcctccatttttgaaatcctctgattctgatatcattcattctatagcactaagaaatagacaaatatttccagagaatcatcatttattcaaggaataaatgcccctagtgggagaagtagcaaatataatgatcatctcttaaaaacaaaaagaaaaaaaatttgaccttgggaatggtaaaccactcatcttcacattaagatgtgaaaaacagcagcagcaacacaactagaagtcaactaaaagtgctcaaatttctattcattaccaatattattgtgaaaaggatgccaaaacatatggaatatatatgtgtatgattaaggaacttacccaaatagatagatatagatatagatatatagatatagatatagatatagatattttttttcttataaagagtctcactctgtcccccaggctggagtgcagtggcacgatctcagctcactgcaagctctgcctcccatgttcacgccattctcctgcctcagcctcccaagtagctgggactacaggtgactgccaccacacctggctaatttttttttgtatttttagtagagacggggtttcgccatgttagccaggatggtctcaatctcctgaccttatgatctgcccacctcggcctcccaaagtgctgggattacaggcgtgagcaccgcgcctggccggaatataaatattttaatgatccaataaaagtcatatacataaagaggtagcaataaatgaaattgttctagcttgacaatgccttttgctttagccctacatgatctaatcattataagttgggccataatttctagatcaggttgcttttggaccaccacagagcagagtggcaaaacacacccaatcatctgctgccagtctcagggagcttgacttatgcccttgaaagacaggtttcagaactagaatcttgtaggcgtagaccctcggaattagacaggatattaaattacagtgtaaattggtagttaggaactcaggagtattagttacattattttagatccttagcctctttccaccatataaatttgagtaagtcagtgagtctctgagcctagttttcttatcagtaaaatgggaaaaataatcccaccctcctgaggattaaatgaaataatatataactatctctgatgtacatacctgatgctcaattaatgttaacaattattattattaatctcaacaataattaatggcatccaatctttgagaatgtatgcttcaagaaaagaatttttcttggagaggagaggactctaaatagaactctcagaatccatgcatccaggtgaaaaagttcaaactgaagcaaaaaaaaaaaaaaaaaaaaaaaaaaccaatagtaaatatatgaggctgtgtcacacttggtattttaaaatgtcatatcaatgatgtaaactgtgaatacttgaaaatgttatttgttcaaggtttactgataaaaactcaaacctcagggatagaaataagaatcaaagtgatcttgaaaagtttgaaagactggagaagaacatgtttgctaaaaccagggaagaaatcaacaggaacaagggcaatatgatatttttcaggataacagcagcaacaaacctctccaaaaatgcagaggcccatgtagatttgggcctaaaatgaacaagattttattattggtccagtgaaaaagaaacaaactcacatattagagcacatctgctaaactagaaagaactctgggcttggcaagaggagcgcttggctggtcctatccctatgctaacttcagtatgactttgggccagtcccttcctttacggggttcatctctaatgtataagtgctagacaaacaagtttctaaggctcttctactcctaaaatgttgtgttcctctttttaaaaaaagcatgaagtaactaatatattgcactctgtgttggttaatttctattagattttatttcatcacttataatcacagctctttgaagaaatgctaaaacaataataatagatactatttgctgaatgcctgtttatacctgcaacagccctgataggtaggtaggtaggtaggtatactcattttatagaaaaggaagctaaggttcaaagaagttaagtgacttccccaggttacctaggaaacctaggtagacttgagatttaacccgttttgtctaactgcaaatcctttgttccttcccatttttccatgcagttttcttaatgcactgaaaaaaaattcagaggatgactagaatgatgaaacatgtagaaatcttatgctgtaaaggaaacgtccaagaaattgtggctgttcacttggttctcacatcaaacattaaagtatattccaattgattaaggattaaatggctaaagattaaactatagtttgctacaggaaaacatgggtaatttgttaaatagattggtgaagagaaaatataatctaaaacttaagagccaaaaaagaaaaggaaattaaataagacttcactaaatgtttaaaaattcactctatctatgatatgaaataatgtacgaaagaaaagttaaaatacaacagtacaaataacaaactaagaatatttgtaatagttacctaagaaggaacaataacattcttcatttgcagataattttttgaaagagcaaactgcctaaacaacaacaacaaaaaaagcaaaataaataaaaagggattttatgtaaaaataaattcaaatatccaataaacatataagaagatgcttaaccttataattgaagaaacacaaaatttaaaaataaaattgtttacctatcagaatggaaaaagtcaaatgtcgaggtatatgtaactattacaagagtgtgaggaagttgaaaatcgtatattatttgttggcatataaattaatactacacttttagaggcagtctggcgatacctatcaaaatttgacattcatatcctttactcaacaacttactgttagatgatatttattacctcattgtttataataacaaaataatgaagctacctagctgtctatcagccatgcactggtaaaacaaattgtttttcattgaataatagaacactcatagctattaaaaagaatgagattaatcggaagaaatatgtaaattagaaagctgactaaggtatattagtaagtggaaaaaatcaaggtgtagaacatgatcttatttgtataaaattttaaattatatattttataaagtggcttatattcacaacaaaaataattagtagtatatacaagaaaccattcacatgattacctttgtagagaataataggaggtaagggagccttttaattgtatgtcttttcattgtgccttacttatgatatatggatatgatgtgggtatattaattttatttttcatatcagtacactatctgggcaattcaattatggcctgtttttgttttcttatttattagttcctatatgtttaatgaataaataatcattttgaaaatgtgcaatagcaaattaaaaaaaaacaagtaatgcatataccctttcaccaagaagtctttccagggaacttatccttcagaaacacttttataagtgttcatagtagcagaaaaactggaaacaaccttaacaacatcaagagggatctcactgaaaagtgctgggacatccataacatggaatactgggctttcattaaaaaggtagaatgatatgagctgatatgataatgaaagatgtccaagatacattgctcaatgaaaagcaaaacaaaagctgtcaaattatatatgttatgatctattcagttaaataaaaaggcaataatatattaaaatatgtatgtaaggagagcaagagaaataaagtcatgtgcttgcatgtgcatatagtgaatctttaaaaagtacacacaagctggaggaggaggaaggaggcgggagaaggacttgctggaggaaaggcgagcgcagcagtcacgccggtcctgggagaggaagcgtagcccggccaccttcggagacgggctcttccctatgttgcccaagctggtcttgagctcctgggctcaagcgatctgcccacctcgaactcccaaagtgttcggattacaggcgtgagccaccgcgcccggctgaccatctcattccatcatgccagaagtgaatcccctagtattttcatccgttggattaggtaactagtcataatgaagaaaatcagttttaaaaccttctggaaatcctttaacttgaataaaagtaaaaaataaactgatttcatggtagtacaacaaccatcgctagccagtgactttggaaagataattcctaatttggtagctgctatggtaaagatatggccaactgcgatatcaacaggaaagacgaaaaaggtggaaaagaaaaaaaagacagatcaaaaagcaaaagcttgatggatacgttaaaaaggcagctttctgccaaacagaagccaaaaggcaaggcgggcaaaccctctgggagctctgccgatgaggacaccttctcctcctcctcagcaccgatagtctttaaagccgtgagagctcagaggccgataaggccacctccctccgcagccatcactgcagtcccatgccatggcctcttcgacccacaaactctgaggagacgtgcatcaagatggaggtgagagtcaaggccactcttccagtccgagtccacccctgaatggcgtccgaaaggatttccacgaccttcagtctgagaccgcgtgccaggaacaagccaattcactgaaaagctcggcttctcagaacggagacctgtatcttcgcctggatgaacatgtgcctgtcgttattggacttctgcctcaggactacattcagtatactgtgcctttagatgaggggatgtgtcctttggaaggatcaagtagctattgtctggacagttcttctaccatggaagtctctgtggttccttctcaagtgggagggcgctctttccccgaagatgagagtcaggcagaccagaacctagttgttgccccagagatctttgtggatcagtccatgaatgggttgttgactggcaccacgggagtcatgttgcagagccccagagtgggtccgcatcatgtccctccactctcaccattgctacctccaatgcaaaataatcaaatccaaaggaacttcagtggacttactggcacagaagcccacatggctgaaagtatgctctgtcatttgaattttgattttaactctgctcctggtgttgcaagagtttatgtctcagtgcaaagtagtggtcccatggtagtgacaagccttacagaggagctaaaaagatcttgcaaaacaaggatggtactggggaccaatcacatgttgggaggcagaagggaagctagcagtcctgccagatggttctttccttgattgggacagttctgaagactgttaccttttaagcttgagctttcgctcccatggtaaaacagttcacactagacttgggcactcaaatggtaggtttagcttttatgaacagccaaatgtggaagggcatacatccatagttgatctaattgagcattcagtcagggactctgaaaatggaactttttgttattcaaggtctcagctgcctggatctgcaacttaccttgtcagactggccaagccagtgtctcggttcatgcaggtacactcgttgcagtacctgtgtcattttgttttatgtcagtataccagaatagacttaattcagaaactgcctttgccaaacaaaatgaaggattatttacaggagaagcactactgaaagactgagaaccctgcatcttgcactttgggaataagaaaaagagattgaaacacagtttacaaactttcattgccatcaaaatcttttgctgccataactatttcacttttatgtataaaagagtcatcagtggtggctcacgcctgtaatcccagcacgttggaaggccgaggcaggcagatcacgaggtcaaaagattgagaccatcctggccaacatggtgaaaccccatctctgctaaaaatacaaaaaatagctgggcgtggtggcacgtgcctgtagtcccagctactcaggaggctgaggcaggagaattgcttgaacccaggaggcggaggctgcagtgagctgagatcatgccactgcactccaggctgggcaacagagcgagacttcgtctcaaaaaaaaaaaaaaagtcatcagtttgtttaggggtggggaagtgtcagcaaggtgtcttgggtttattttggttatttaaaaagggaagtcttgaggttttagaagtgtgaattacctttcctcaatgtgcagaataatcacaatgtgaattatcaaattctcctcaatgctgccccccctcccgccccgccctgtcctttgctgctatccactgtgatttttatgcattaaacagaatggaaattgctatgtctttttaaatggcccattttcaaaagatagtgttgaataaacatacccgtgtgataaaacacagaatttacgtatacactgaagatgaatttttaatctattactttaaaaagatttatttagaatcatgaattggcatactcttgggtaatggaatggagatctacaacatatcttctaacaacacttttttctaaattatttcttaggttgtgctaattttattggttgtgagaagttgagcttttctgttgccttcgtttcatctgttgccttcattttcatcttatagtttgcctattataataaatggccttacattaaaaaattgtaaagaaatgtttaccaccaatttagaaattgttgccttttctgtcattaaactcaggtacaaattgccataacatgaaaacctatggaactagaattatgattaaagaaatattagatgatcctaaaagaaaaaagtatccataaaagtggttccactggaaatggagatggtgaggggacttttacctcttccttttagacctttctgaaacagaatttatttgccatgatcacattttattcttttataaaaagtaaaccttaactgtttgacaagagaataaattatttggcatgtgaagtttgtgcaattcagcctcctgtaggcagtagcctggatctaattacctttcctgtctcttctggccagcagattcatacttctaactcatcaatagcctagacagtctctgaaatgactatatctagcaagaataactcaagaatagatctggaattttatactttaagggggctttagattcatatagcctaacagtctcttccctccgagggaggagaaaattgagtctcaggtagtatgacagtcagcaagagagtggcacagccagatcaggcctagctcagtggactccccaatgttaccatgtaatcaatgctttctgtaaggagttcaccacactagaaagccagggatgaggcaaggaaaattacaaaagagaataaggagatgttaacgaagttattatgagaggatcatgatgtggaatttaagcgtatggatgtcccaggcctgatggggaaacaaagtagtaaccccccatctgccacccaatgtcattctcaaataggattgatgaaaagcaaaatacgattatacattttgaacgtgtataagctaatcagttctttattcttctttcatagcccatatcaacctgccccatgaataaaaggaagcagaattctgctatcatctgcaaaaagttagttttttgtaggttagaaacccatacttactgtgtgttcatcagaaaaacttcttgagggcttatcttgtctccctttgtgctccactcattgtccctcttctggggcagacagagaactctgtcattggagagcacttattaattacattatattgacttaggctgaactgattcaagaaaaattttagcattttcttcttattaaatttgagttaagaatgcctttcaccctggcagagtttggagcttttaagacatttctgtttctctttcagtatgggacccaaaatgggagttagcaatagctaaataaactccaggcactctttatttcattttgtcagaatttattctagaattgtatatgagaaataggacagtcaagtatatattttaaaacaaggcggccgggcgcggtggctcacgcctgtaatcccagcactttgggaggccgaggcaggcggatcacgaggtcaggagatcgagaccatcctggctaacacggtgaaaccccgtctctactgaaaatataaaaaattagccgggcgtggtggcgggcacctgtaatcccagctacttgggaggctgaggcaggagaatggtgtgaacccgggaggcggagcttgcagtgagcagagatcgcgtcactgcactccagcctgggcgaaagagcgagactctgtctaaaaaaaaaaaaaaaaacaaaaaaaaaacaaggcttaaggctgtctaaccaggctcaggatgacaaggctagacaattgaccacagagagggatttggcaaccatctggccccattttataccatgtccccagaatctcatctgaatgttttaatcttttagcatatatttgtctatttacattacatgtgtctctctttatcatcctgttttccctctaattttgaaggctcatatttatccctatttaccctagaaatctaggaagctcacagaggcatattaaatgcatacactagaacatgaatagataaaaatgtttccaacccggtcagaccatggcacaaacaccacaaggtgaaatttaatgtctctcctaactaaaagtgattaagatcatgaaagtccacaaacacctgagtaggatatgaggggtttctgaggcatgtgatataatgttagacagcctggttttgggaaacttttttcttctatcaggataatatgccttatgaaataccaagattctctggcttcctctctttcaggtgaatggcattgacctccgtggtgcatcccacgagcaggcagctgctgcactaaagggggctggacagacagtgacgattatagcacaatatcaacctgaaggtcagtcagaactcaaactaataatgttctgatatgtctctgtgtggatctgtaccctcattactaataatttttattaactagagtcaccatcattggtgttttgtaaacctacctatagtgaaaaattgatggttcatgtccaaagaacgtgaaccgtggctttgttacctctaatcttccaggaaaatatcaagcagttagaaaggcctatgaaaatatgaattcaaataaatagcaaccagcatcagctttatttcatttatattcttatgtggtacacactttcggtcaccaatggatactgtaaaaacagttaagacttaagaagcaaaagggagagatttcatctgcagaaatagaccagtagaccatattctctcctcatggcattaacttaattctcattaacactaacatggcttttgggggtgcttgattgacattttttttgcctttactcctacaatatcccttgtttgaaataaatcactgtaaaccatgagactcagtgagatcatgtaaattagattagccaacttaaacttgatgagatatcctaaattggattagccatgccctgctttttggtttatttaaacatctgtttccgtgtttaaaatgaggctcaatgagacaactgggatgttacttattgtatggttgatttcttagaaaattcatatataggttgctcctttggaaatgaaacgtacttaatgtaagcacacaattatgggtcagatcttgttattaaaaaaagaagaggaaaatggctactgtcttcaagaaatgaagcgcattgcttttggtccatatggctagcaaagaggagtattaaacagctgaacatgagagtataagatgtcatcaaggaagagtctctgtgcatatgagtattaggagctccttttcaagtgatgatttgttagcatcgatgggtctattgttgtttggaagactgaggtttgtgtcttgcctgtgacagcttagatcttaccattaatggtggccaatcacatggtctgcccatgaataaagaaaatattttcttccatgcatgttttgacatgttactttcagttgtgcctggctttagaattagaatttgaaattaatttattcaaaatttttaataaatgttttttcctatgtggcctaggccagatatggccagagagtgggaaagaggagatttgtgatggtcacagatggatgatgacaacaccaaggaaatattctcttctcagatagttttgaaaagtctttctatttgctaaatattagtagacttgtatttcagtagggacaaatgctttaaaaattatccatcataggccgtgtgcggtggcttaagcctgtaatcccagcactttgggaggctgagacgggcggatcaggaggtcaggagatcgagaccatcctggctaacacggtgaaaccctgtctctactaaaaatacaaaaaaatagccagatgtggtagctggcacctgtagtcccagctactcaggaggctgaggcaggagaacggcatgaacccgggaggtggagcttgcagtgagccgagaccgtggcactgcactctggcctgggtgacagagcaagactccatctcaaaaaaaaaataagtatccattataaagctgaaaattaaaagatatatgctggtaccatttgaataacaagttctacttcatatagagtaagaactttttcatcggaatcttccattttcttaatagctgtttttttcagtctcaaactgtatgtccttcaccatcgcctgacattgcaacataaatgtccccattttcctgtttctgaaaaatctcatctcaaacaattctgcagacgataagatggttagaatcatagataagcaattagaagctctcgatagtgatcaagtgttcaaataaccttgaacagaatgacttcaagctttaaagtttacataaaaggacaaacatgtccctgttctatcaatgtagatcttcatctttctactggagcttccttacatcttggtttcctttaagcaatatgtttaatttggttactatgctgtagtttatcaagatgcttgttcaaagcatgtcctataaatcatacaaattgatttttaaagtgcttgtaaagaaacctgcagataacaacaagctttttacaaaatgccaaagtacagattggattcacagaatgacttctctgttttaatagcctaactgtatactaatctgttgcagctttaaattagttggaaatgtggtaatggcaacatcaagcaatcagatttctttcctctcctatccaaactttacgtgtaactgagccttaatttaactgcagttttcaatgaaaaagtgattgaattattgtttagagacatttaaattgtacaacagttttaggaaataaagaataatttacctttaaaataacaaatgaaatgaagagtgcctcatgagattccattaggaaattctcaccaagtgccctttatctgcacccatattgtaagtcgttcaacccttaagacaatgctggcagatgattttattggcatacttttagtatggtcaagaattagactttcagtgaatacatttttcagtcataatcaaatgctttatcaaaaatttcctaaatgtatctgtcagtattatcagatgctcacaaaaatctgcccctaaccttaagtaataagcatagtctttgtcttcaaggatttttttaatctagttgaggaaaagagatttttatacatttaatagagtatagttcctggtaacatatgatcagattgaatgatcttagcagcagtatttctaggaattatggaatgtcagagaaaggataagcctgaaggggtcaggacagtgcaagagtgcaccatggaaatgtggaaatggagccagaccttgaaaaatgggtgaaatttctattcaggagtggagggagaaagaatatcttgctaaactacaaaattgtgagttccatgcatgcagacaccatacctatatttaacaaaatataggtagctgatagctctatctctggtgtcctacttggtatttcttaaagagttgatgaactagtggataaaagcctaccattcctcagcacttgagttttcacttgaaggtaattaaaggttgaagggattcttcattttcactacttgcgcttttcatttttgcttcaaagacataaaggaattgctaaagaaatgtgtattgcaaaatatcaaacaatttccaactgtgttcctcatagtctttagcatatttttgtgataattataaataatttataaaatgtctaattaacataatgtagcaataaatgtcttctttggcaagtttcactttacaaagcgagatcacaattttactcacttctgcttaaaatgagcttgtctccagttgtccacattgctatatccatcctcaatcttattcagtgtctggttcatggtagtagaattgacaccaatttgaagagtcatatatgatgtttttctctggtggtgtgattgtgattcatttttgccaacttttaaaattcaattttatcatgcacttactttgaaattaacatgtattactttcataagaagaggaaaataatgaagttgtttttctttctttcaagaggattacatacattgtacttcaataataattccatttaagcactatgcaaagttaattattgtcaaacctttaattacctatacccagttagtgaagttgctgtaatgccacttcacagaaggaaatataatgtcttacacacatgtgcacccacaggtaccccttccctttccttacccttcccagaaaccttcccctttgatttcagaattatctttctaagagatatgacaccaagatccctgtgcactaactccttgtctttcacaatatattcccagccaactcaccccactcacccctccaccacccacagtatcagcctttctcattgtacccctgctacacaggactgctgtctgctcttacacttgttcctgaactatgcctttgctctgtggaatcctctacccagaattgcctttctccctttccacctgcaggattcctactcatcttgagagcccacagatgtcaattccactacaaagccatttttaatctgcttagtcagcattaattgattctttatctgagttccccaaaactgtatgtaaacacctggtgtgcccattatgacagtttgcacacctctccactcgagtgagctcctagacagcactaggagctgtgatagacccttctgtcactcattttatatcttgtgttaatccatgcaatatgaatttgactatggtttattaatgagttattgaatgggtctgctcttaatttaaatgcaatataatgttttcagtgtgttgacatatattaatagtaggtgcttaagaaatgtttgctgagtaattattaaaggaatggcatgggtttttatattagattcagagatggtaattgaatccctggtttggacatttggtgttgacacagtttttagatggtgccttttggttttcagtcataaaacctttagcaaccctagtagataaactccatttcccctgcattgcagaaaatctacagctgttgttttgaaatatagcacaaagataagatgattaaagcactaacatttttttcaagttctgaaactcaactttgacaccattgatgaataaaaagggaattgattacaacctaattatacatttttcaaaaaagataacacagcatttccccaagtcagatcagggtaaatctgatctgtatttgctgccttctttctaataatatctacatttattgtgagataactgattaggtttgaaataataagccacagatattgacttggagaactaggtaggcagtagctagtattagataaagctcaaaatggagttaagagccaagtggtccctgtgagaaccacaaattcttttgccttgaatatgacttctcaggacattgttggagagactgccaggatttcagaatggcctgcaggtagaaaagaagtcgtggatggtacagtccttaccagtgatgaggaacttcggtagatagtgaagggacctgatttcatccaccctttattctttaataaggtactggagttaaaagaaaagcccaaaaagcagagttgataattgcctggagactcataagtgtagtctggtttatggaattgtggcagagtgaccacatggttcatttattcatttatacattcattcaatcaataggtattttttttctggatacttattatgcctcagtccatgttataaggaaataacaaagcagtgaaccaaaaaagcccctctcaaataaatgtaaaatgtgtcacatggtgataagtagtataaagaaagaagcagcaggagaaagacaatagtgacagagaaatatatagtgggcaagaaagccatgctaataaggtgatatttgaacaaagatctaaaagaaatgagggagtaagctatgcaggcatctgaaggaagaaatgaattattctagagttttgttctactaaatgttgtctacagaccaaaagcatagatattaaatgagagccttcttagaattgtaagatctcaggtctcaacccaaccctactgaatcagaatctgcattttatcaagattccccagataacttgtatgcacattagagtttgtgaggcgttgccctaacatacttggagaccctgcaaaaattgtcacttgtcactgttgggttggactccctctacctggagaactgggcaaagtcacatgaggctgcatcactagatttgatttctggcatgtgtcacccaatgattggtcatggctcagtggttttagcagggataggtcaaactgcaggagatctaagaagttcatgtgccattcagctctactttgtctaccccgcccatctaaataccaatatcaagcaaattcataagtcttgctagaactcctcagctagtgagacaatgaacctattcgggcttcattgcctttagttatgacctctacagcaagtgagtttagaagcagtgagttgggatgaagtaacattgattcctatcctcacagatgcctctatgaaccaagggaaagtcattaaggcttcactataaaatttgaaaatttgaatagcttaccacactttaatgcagaaactcatgtaaataatctgtttcactccttttaaattgtgaggctaattcagaaggaaaactattcttttcagcaataagtgaaactctgatgttatttggggtaaccactgtcacagagcttaaaccacagttggacaccacggtgcatttctctatggggtcaaagatataatgaaagcttgacatgaatatgcaatttatcccttgaaaaatatggacaccttctgtacctgaaggttctcagaaatgaaagtacatacgccatccaagaagcatacttacaatgcaagacatatttctttctttaaatcaacatctatgtaggcttatgcatatgaatgagcagctgtggcatgttgaaacattttcccaactcacgtaactgcatcacaaatacccaggaaagatttttaaagtccagctgtggatcttgatcagaaattgcatcagaatcatcagagaacatttaagtaagctttcagaacagaaagtaccgtacacgacttggactggacaagaccagttttctagtgcaaattccaacttaggtgagatagaagcataagtttcattacttgaaagttttgtcgctaacattacatcttttctttgcatttttaatacataaggagaaatgaatgcacgacctagttaacttgatagattctgtgtagtttaactagaatcactaagaaatagaaattaaaagttttaagaatccttaaagataatcttgtcaagtttactcatttcacatatggaggaactaaagttcagcatctagataggaaagccgtttaatattttaaaattggtatagctgttaaagctgaggctagctgagcagttagtaatttccttgatttttaaaatttactgtagtagctcatgatggggagtggctttaatagcccaaggaatggaatgcaatgagattattataatcaaatggacataaaggggtcaaaaaatttctgagggagcctcaccactttctcgggcatactgcatcactttcatttctagcatgttactgttgttaattgctattgtttctgtatcacaactgaatgatgtatacatgacagcattattgtaagtgtaggcaactattgttaatttttaaaatagccacaaatctggaaatagttatttttttcaacaagtagttcaaatatattacagtttttctctttccatcctaccttcttcgtgcacaccctttatccagccagccagccagctgcttatccattcatttatctgttatcaataagcttgtctttagtgatactctttgttgccaagtattaaatttcacctaatatgttacattaattatgttctaattaatctagttatcatattctaatttgtactgaaatattaggaaagaaacttaaataaaactttacatgactctagatttttattgcttagacatttctttctccacaactctctcccacacatgtacacattctactaacagaaaaaggcctctgccagcaactagacacttcccaggaagtctcttcacttattgtatccttttaataaccttctcctagttgcctttgtttcctccccaacctccatctaacccatagcagcgtagaatatgactaaaaagatgattcctgaacagtctgcagattcattcatgaaaggtcctttccagattccttaataattaatcatgctgcatacctctccccatgcctaacagccagtttttgacctcgagtaatataataaggacaaaagcaggtatcacttcctaactcctaaattagaaaactctcttcatctcattatctatcctgggaatggtgcatctttaactcatatcaaaggggttaaaaatatttacaaagctgattataggttaataatagatataacctcctctcattgtatgattacagttccgaacatccccataaaaactttcattccgtaataaagtatatttatctttgacagtttcatcttgtgattttatattatttgaggggtatgttgacatttagtgacataaatcagtcactcattaatactggaaaaagccaaataaatccttgtgctagagacattttgacaacaaggagacctcttagattcacatctatcattagcaacacccagatcaaatgcatggaaataaagggttctaatactactcttgactctacaagtattacaaaatgaacacagatcttcactagataatccttcaatttgataaggaatttcagggtgttagagaactgtaaaagaatgttgcacagagatatgcaaagaggactataaagcaagacagctttaaaactttctgacttcactctatattctgggtgcccagtatagtttaccctcacatctctttgaatagctatttgtcagtcctcaactttaataatgagtaatgaggcacttttctcgtcctgtccctcactctgcaactttattgagcacgcctaagtcatatcacttttctgaacatggattccattgtttgttaattaaggtggttcaagagattagttttaaggccctttccagctgatgttctatgaagtttagtttattgtgtcttctgattaaaacatgccatcaaataacaattattacaagaaggtaatttctaaatgtttccttttttccccatacattttaaacacacagaaattatctttcacccactcggaagaaggggaaagatctgtatctgtgtaatttgctgtctctgtgtaccatgggatttgaaacattcaataatgattttaagtttaattcaagtagaagcatttattgtttcttgggggtttcaggattaacaacttactgttcatgatctttttgtttatagaaccattgtggcctaaatcttatcagtttaataaattaaattgtaattgctaaacttgcagatagattttttgaggctgaaggaaagtaatgtaaaaaatcaatttcaggacattaaagatgcagaaagctgaaatagtggagatgtcttgaactgtcagaatcacaagtagtggcagctttagggtggaaacccaagcccaagaaatagaaagtatacatctttaatgtgctttttagattcctaattcacatagaattcctgatagactcattacctaagtctttaaaagacaaaaattccaaattgcactttgtttcaagataatctcttattctcctcttagcttcctcacatttatcatgttcccattgctaaaagtaatttactttattactaaagaattgctggcacattggtaaaattaagcaatggcaggacaacattcattcattcaatctttattcagctaatatttattaaattattccagtgagtgacatgctgccttgcactctggagatacaatggtgagcaaaatagacatggccccttccttccctaatggacctacagtcagccaagtaaaatcacactaacgaattatacaaagtgaatgctcaagaaaaagaagagaacttggatccaaaatcttaaagtctaggtactcaaatgtactcagagaatactaaaccagaccaaacgaagacaaacaaaagctctgacctagaggagagcgtcaagaaggcattccacgggaataatactttctttaatctgaagggtgagtaggtattgtcaaagcatagcagaaaaaggaggaagagtatttcaggagggaaagatatctgaagtgtatctgaaggagagaggatggtgcagtggagggactgaaagcaaaccagggaatgtgggagaaacactggaggaggcagaagagagaagcagagacagatcacacaggactgtgttatttctactaaaaacaatgaaaggacctttgaaaggttttaggcctgaggctggcaagatcagatttgctgttcacaaagatggctctggctgctgaatagaaagtaggccagaaagcaccgaagaggctggggtaggaccagttgaaaggcatgagtctgtgtgagagatggtgctagttggataagcatggtggcagaccagcagttcaaggatgcagtgagctatgttcacatcacagcaatccagcttgcaggacagagcaagaccctatctgtaaaaaaggtaaaataaaaaataaagaggggtggcagaataggtagagagaagtagatagattcagggaaggatgtaggtgataaaaccaatagacataaatatggacctatgaatacataaattcatcctttcctgaaaacatggaaagcatgattggctaattaaaaaattaacaaacccttcacagaaaagcatgttttattcatctttatttatttatttattttatttatttatttatttttgagacagagtctcgctctgtcacccaggctggagtgcagtggcacaatctctgctcactgcaagctccacctcctgggttcacaccattctcctgcctcagcctcccgagtagctgggactacaggctcctgccaccacacctggctaattttttgtatttttagtagagacgaggtttcaccgtattagccaggatggtctcgatctcctgatcttgtgatccgcccgccttggcctcccaaggtgctgggattacaggcgtgagccactgcgcccggctattcatctttatattccttctttttccttagtacagtgtctggctaatagtaggcatttaaatgtagaccaaattgaaaaaaaaaaaaagaataatgacaatgaacttattttatataaactctgtttttactttttaaaacaatgtgtagctaaagcagagtaaaatatagatgagagaaaaagaaagatgtagagagaatgggacatggttacaagaagagaataattaaaactcgcatgtatgaagcactcactacaggcctgacacctttctaaaaatctctgcatgtgttaactcatttaaactttgcaaaaacttgtgatataggttatattcccttactcattttacagatgaggaaactgagacacagaaagcataagtggttttcccgaggttaaaaactatacagtagagtaaaacaaagtttcagtctcaggcagaaaggctccagaacaacccgtgcaccatcctgtttctcataaaaggaagaaaatataaacagattcatgctgtaataaaaggcttgaagaggaaacaaataaaatagtttggaatgggtgtggagaaaccaaaagaaaaagatgccaggagagggatatggagggacaaaatttgtcagacaaggaaatagagttaggagggttcatgctggtggagttggagagtttagcacccagttgtaaatgagaacggagtccgacagtagcggcttggagtagggcctggattaggagcagatgcgggctaggagagtatgtcttctttctctttttaaaattgttgttgttcttttgggggatatgggagtcttgggcttggctctaggaatagtttggctctaggaatagtttggccccaagctgtcataaaggcaagcagagggctcaccacttgctagctgtgagacctcaagtgagtgacaacctctctgtgccagagagtcttcaccaggaatgtaggggtaatcatatttaccttccagagttgctggaagattagtgaaaatggatgtagaatgttcagaatggagtaggccatgcgtaaatgacagctagtgtaataaccttcaacacatatttgagtgagcattgtgctgccctttgctctaatcagccctttgcaccatacttagaactatccctgagagggtcaaagagcttcacagagtttgggaagcagcagtagttaagaatttccttacttcctgctgatgggcctgaaatataggaagaaaaaaaaaagaattcctactgtgaaatcggatagatatgttcaaattccagctccaccattaacagctctgtagccttggaaaattacttcacttcttggagtctcattctttatctgtaaaatgatgattcatacctatctcacaggatgactctggggattaaacgaaggcgtacatataaaatgcctggcactgtcctgacagatagtatgtcctccataagcgataattatcgttattatcataattatcagaaacaacagaaaccctataatgtggctattatgtggagagagagataattagacccagaggaggaatggaacttgagaaaacccttgggagactgtggatgcaggcacttacaggatgtcttcagtatcaaaactgatgtggagataacgccctgtgtggaagtttcaaataaactgtcctctgaagagtcctggggtctggcagagggatggcaggagcagggatggggagtgtaggaggagacaacctggcccctggccccagtcccactccagccagagcaatctttatttgtttttcatgtttggtcttggatacatgaagcaaggatcttaccaccaaaaaacagttttaaagctgtttatcagaaggcaagaaatgctcttcagattaaggtatttgtgtgcttaggatgaaaaaagctgtaagctcagttatttttccagtagaaagtaacctccatgagagcatcatgttttgtctgtcttgctcacagccgtgtccgaagtgcctagaggagcacccagcacagagttggcactcaatacatatttgtggaatgaacaaatgggccaaaaaaatgaccataccttgcagtttctcttcgaactatgggtaacaaagtaaattcatccccgctgaaatgcttgttgggagttctgttagttaactagagctcccaaatattgatcttcaatgccgaaaaatagccattctatgggagcagattttctttgcttccaagaatgattctgacactcctgctgaccaggttaactaaagacaaacacacactcagttttactttggttgtttggtgcatgaaagcaaaagattaagcaaacaaataaacatatttcgtaatgatcttaatagtggctttgagaatttgaaaatagagtcttggaaacattaattgaaatataaaatattagctagcacaagtataagactttgcagtttacaaagcgctctcatgtgtgtttcttattgaatctacagaacaactccaagaggtaaatatactggtggtattatcatcattgtaatttcatagataagagaagttaagctcagtgaagttaagtgactcgctcaaggtcacacaactagtaaatactatgagccaaacttgcacccagatgctctggttccatttcttgtgctctttcttcagcatcatactctaattaattttattatccaaataataactagctggagcatagaattatcaggctttccataagtttgctaatcatattttgagaaaacttatttacctgtttgatgagtgaatgcttggtggtatattaactttatttttaatgctaacataatatgtgggttcaaaaatcaaaataatattaaaatgtgtacactgagaagtcacatatcctcttcgtctccattgatcccaatttcttcttgcccctattagtagccagttaaattaatgagaaacttatctaaataaaatctgaaactaagaccatagaggaatacaggtaaatcttattggtattattttaaagaagaaaaaaacacttaacaggagaatgtgtaatggcctggggagttaaggaatgaaacattgtgatttcttagttggcttaccactgacacctgctcttcatgcctaaagatattttcccaaatcagaaataattttatagcattagatcttccttctttcctttcttccttccttcctttcttcctctctctcttttctttctttctctgtttctttctttctctttctttcttttttccttccttccctccttccttccttcttcccttccccttcccctcccccttctccttccttccttccttccttcctccctccctccctccctccttctctttttttttcttttcttttcttttcttttttattgagacagggtcttgctctctcacccaggctggagtgcagtgatgcaaactcagctcagtgcaacttccacctcccaggctcaagggatcctcccacctcagccttccaggtagctgggaccacaggtgcacatcaccatgcccagccaatttttttctatttttggtagcaacggggtttcactatgttgcccaggctggcctcaaactcctgagctcaagcgatctgcctgcctcagcctcccaaagtgctaggattacaggcatgagccaccgcacccggcctagatttttctttcaatgtgactatcataataaccaatcttctgtagattgccaagggatcacaagttacaaaagaaatctccatgcaattgtacttcattaactggtgtgattttctagaaaaaaaaatggaacacaataatctttaaagaggttactggcatctaaagggatatgaaatcaaggttaaaaccaccccattcccttggaaatatgtgcaaaaattaaccagtttcatatcatagacatcttcatataaagatatttataatccgttttcattatgcaatagtcaacgcgtaaatacctctgttgaaggtcactcagaagaactgattttataaatgattgatttcttggtaatagaaataatcataccccatttatccaaatttttaaaataatcatgcaccacaaaataatgtttaacaatggatcacatatacaacggtggtcttataagattataataccatatgtttatagtactttttatatgtttagatatacaaatacttacgttgtgttacagttgcctagagtattcagtacagtaacagtaacatgctgtacatatttgtagcgcaggaacaagaggccataccacacagcctagttgtctattaggctataccatctaggttcatgtaagtgcactctgagatgttcccgtgacaccaaaagacataatcaccattgttaagcaacacattgctgtatttttattttcttttaaacacttgaatttcctacaaaaaagaaaaagaaatatttgaatttcttaaaaataggcattcttcactgtgggagattttcccagtatgcaaaagaaggagtagtagggttttagagacaattccccactgttgtatacttagtaatgagcagcagaaacacaaagagcattctaaaagaaacacaattatctataaaattgcagacaaatagttgctttaggtaactattagtgagaaataatgaaagtagtgtgtctacactatcattatcaaaacaaagctgaaacaaactccaaagaaatgaagatgtgaagattattgggaggggtgtgggagacagaaggacgtgctgagaaaattgctgaggaaaatcaaatgttttcaacttggatagttctatttatcattaggaatgcatttttccctccttctaatagattcaagagaaaacgtttttaatagtctgctgacatatggatgtttaattttcttattgaaagcaaaaaaagtggattttcttattaatctcttatttgttcgttttgtgattgttgatgttgaaatattaaggatacattattgtaattttttctcacaatttgtattttccatctttgactttcttaactataaaccaaaaataaaaagtaaaattttacagaaagcctgagagtacagaacaagctataaagaaaatcaagtataatatctggcttttaagcataatgtatattattttataaaacaagagctggtctttagaagaaaaaaaaataagcgcacttatcaagcatttactatatgtcaggcagttttcttgggcacttttcctctaaatttatacatccaaatgtatgtcttctcttatcatcctcttctcagctatacctctccttgaatgtttactcaaatgacaccaaattgctcatccttcacccgacaggccttgatgtttcatcctctggggcttagtaattatattctgcccagaattccctttttcctttgcctacttaacacacctttactttctttttttttttaattaaagaactttttaactggtttacaaaggaggctatagactacattgaaactaatctttgtacaaaaagcaaaaaaacaaaaaaaaacaccagacaccacgagacaaaaggtaggaggaaagacaagaaaggaaggtacaaaaggagcaggaagaaacttacttagggacaagattagcatcatacaggggaaagagcaagatgagagagtatttaaaagcatttacccacacagccctggtgataatttagttggaatcaacaacaaacacagtatgacattattaagaggttttaaaaggcaacagtcatgtggacgggttattgccagtgttaagagagaaataaacttgggtttttgggcaccacagattggagcaccacccctccattccagaggacaacagacttaggaagaggaagcaggccctggggcagctgccactggaacccacctttactttcaaagaacaaggtaggcggggcacagtggctcacgcctgtaatcccagcactttgggaggccgagatgggagaatcacctgaggtcaggagttcaagaccagcctggccaacatggtgaaaccccgtctctactaaaaaatacaaaacttagccaggcgtagtggtgggcgcctgtaatcccagctacttgggaagctaaggcaggagaatagtttgaccccggaaagagaaggttgcagtgagctgagattgcgccattgcactccagcctgggcgacaagagtgaaactccatctcaaaaaaaaaaaaaaaaaaaagaagctagagtcattctcctctaggaagccttccctaaccatacactccatccccaggagaggaacactgcttcctctgtgctatctcagcatcttgtgttgttgcctttctccctcagacttgtacttcatgtaaacaagcacctgacctggccagagactatgagcttcatgggggaaaggagtgactctagtaggaagtcaataaatgtttgatgaatgattcagtcaattgatcaataaaaatttgagtgccagtaatatttttaagcctaagcatcatgaaaatgggtaggttcatgtggagaagctgatggctagtccttaaaataataaaaataaatggtgaactaacaaagccaaaggagaggttttgctctacaccatcatgaaagtccacttatgaaggaatgaactgggttcaaggattcagaaaaaaatcacaagtgaatgtagaaagaacaggtagtaactagttataatacttgttatcattatggagtgcccagtatgtctaaatatttatgtacattatgccatttaattctcacaaagcactgtaaacactgttattcccattttgtgaatgatagaataaaatcccagggaagttacacaacaattaagtagaagaggcaaaattctgataatggcctgcctgactctggtgtccatttgaaacaccatatctccaagagggggccaacagccagatcttaactgccaatctctgggtcctcacctattcctcacttctttagaaggagaaaaaggccatgctcctttaactagtatgggcgaagttcatggattttacagcactttcccttcacagcctcattaaacttatatgcatggcctcaggatctgctgagccacgttgtgctgccaagccctggggctttagaatgatgctttgctctaagagagcacttttcttaaatctggcaagttgttgcttaataaaatatacaccaactatctgagcaattgagggaagagggtagtgattatggtttaaaactggatgttaaagaaagcagattaccaccgaagtgagaatttctgaatgtcatttggtctaaatggaactgtgattaggaaaagaaaagagacatctgaaaaagtcatgaaaagaaaaataatagcaattttgaatttcaactaaatgggtgaaatctgggggatcacaaatggaaatactttctaaagcaccctactctaaagcatctaatgtagaaggtacagatgcaacaggaaactgcatgcaacctttaaggagcaagatatttggctcgtaattaataaattctatatgaataaagttaagtcaaatgtatataaaagatgttgctgaggttataatcagtctgactttaggcagcagcaaaattttttcttttgtataagaaaaaaatcagaaaagaaaaaggctaagaaggatgagttttattgtcagtaaatgtgcattatctcgctagtcctaaatgtgagattatggatataatgggcttaattaatgagccactagaaagtaaatattcagaaaaaatcaaacttacgtcttatgaagagaggcaaagatgtttgaggacagagcagaagtcaaatgcagtgcttctgctacttggctagctgcatgaccttgtgatagttatttagcctctccaaccttcagatttctcatctgtgaaaagggactaacacctacttcatagggtaattttgatggacaagttataataataatttccggctgatagaaagtatccgggaggtattaattactaaaataatgaaaaaaaaagttaatcttgcaaagtgcctactgtatatcagatagggttctatgtattccatgtattaattaatgtaatccctaaaacaagcctgtgagataggggctatgattgtttccttttcagagatgaagaaacaaaggcacagaaaggctcaataacttgcccaagatcacacagcaaagtattagtgctgagattaaaattctggtctggctgtagcctccctgctcttgaccatcagagcctgctacctttttattgtaaaatgatagcctgttttagtttcttcacagcatttgtcaccacatataattaccatatttatttgccatggtcttccttctcccagttgaaaataagctccatgagaacaaggacctaattgaattataactgtaatcccaggtgatgggataattctctaatcaaataattattactaccatgacacacatttacctatgtaacaaatcctcacattttgcacatgtaccccagaacttaaaagtagaggggaaaatataaaataaaattttatcctaaaaaaagaacactacagaataattaatcccaaaatgtccatatcccaatacctaaaacctatgattacgtcaccttataaggcaaataggacttttcagatgtgacgaaattaaggatcttgagatgagaagtcaatcctagattatctggatgtgcctaatctaatcacaagggccttttgatagaaaaagagaggcaggagagtcagagaagaagatgttatgacagaagcagagaccagattgacagcccgagaaagactatacagggcatcgctggctttgaagacagtttcttccctggacctctaggaggaatgcagtgctgtggacagataatttattccagtgaaacctatttttgtcttctaaactctagactctcagataaatgtatgttgctgtgagctactaagaaaaaatgataataattgtatttactactggtaaataagaatgttaagaaaccataaaagatgatgagagaatcaagttagaaaaatgaaagaaaatatatgtaagaaattaagattctaagagacaatagcaaacaaaagcattgctaataatgactcagaagcattcccacaaattaacaggcagtttgttagaaaagataaccttggcaaaatacatggtacctgtattttccctcaattgctgataatataattaaaggcacacaatctcatttttcctcatttttcaaatttataagaaggaggaacacagtggaatctgcattgccatggaacacaaagaagaataccaaagataaataggcttaactcataactcattataaaaaaaaaaaaaaaaaggcaggccaggcatggtggctcacacctgtaatcccagcactttgggaggctgagatgggtggatcatgaggtcaggagatcgagaccatcctggctaacatggtgaaaccccatctgtactaaaaatacaaaaaattagccaggtgtggtggcacgtgcctgtagtcccagctacttgggaagctgaggcaggagaattgcttgaactcgggaggcagaggttgcagtgagccgagatcacgtcactgcactccagcctgggtgacagagtgagactccatctcaaaaaaaaaaaaaaaagcattcagtggaatctcccaagattagttttaatattcatattgcttctaagaagaaaatatgataatagcatttgtcaacatccaagtaactgagcaaaacacagtgtcaaggaaataaataaaatggacattgtatgctgtcaagtgtgctctcaaaatttcatgtgaatctactttttatttattatctacatctacattccagacaaacatacactatcactattgagtatatttgggtagcaattctaataccttaactttccattggtgcacaaaggcaacagttttctatctctgttcagttggagaaactcaattgtacatatattgtgcctcctatgttccagccctttgctaggcactaggaacaaagacacagctctcactctcataggctgaaaaagcaaggtctacttggctaccatgtttgtctgtctgagacatctgtctacatcttggattctaatgctgcattaaatatctaacctctgttaaaactgaaggtatgttgttagtatcataggcccaaatccagcctatggtgtacaaatggacacttttgtgatttctgttaaacgccaaccccaaatcaaaagccattttcctttctggatattaaacaacaatcaagagccagaattttgatttagaatgtatttatagtatggaattttaaaaggtaaatatttctccttttcaagacagaaactcagatatcaggattattttcagaacaaatctgctgcctctcagtattttgattaattcctctagcagtaatttcttaaagtatttgtttttaattctgtatcccatcaagatgttaattttccatcaagagttttagagaaaatgtgggcttaaaaaaattgttttaacacactgataaaataattcatttgacatatagctatgagcagttccccaggactttctttaggctatattttacaatgccaggacaaaaaagaacaaagaaagtcaaacattacttttttctaacctgggatttgagggtacaggggagatgtcattttaatactataacagaacatgtaattttaagtaaagtttttaattgtatttctaaaaacatggatcatatccaagtcaaatctagagagtgtgccggccatctctgcctgaccacacctacagggcaggcctatcagcctatcattctgcagcctgagagccgagtttgtctctcctcaagtctgggacagaccacagacatctggcttcaaaggccatagtattgtaatgactaaaatagagaacacctcctgagtgaagaaagatgcactgaaatgaagtgatcaaagcacagactctggaaccagagtcctgtgttcaaaccctaaatctgtcacttactagctgtgagaccctgggaaaggcacttcacctcttggtgtatcagtctctttattaataaaattgagataatagtagctatgttataagataattttgaagattaagtaggttaatgtttataaagctcttacaatagtgactcaatgataataaatcccaagtgttgacaggcagaaagatagagtaactcccatccaacctcaccaccacagcaaggtcagtgacatttgccttctcccttccctgcacacccctttggggcaactggcctttgtgatttccatttcttttcagcaccactcattcaaattgctttaatctgattttttggctaaatatattcattcattaaacaaccatatattgaatgtctatgatacatcagcactttgaagttccaaaagctgggagtggtagggtaggaagcttctccctcctgctgtctcacaatcattactccctccacaatcactcccaccgtgattttctcagctctgcacctgtctcaggggatctggtagccaatgcttatgtgattccagccatgcgatagtactgctgtgattttacataagctggtatgaggcatactcccattcattaagaaatggcttctctttcctaaataacccatctgtagttagaatccaccaaacagttttcagaggctcttgttcaaacaaatggccaacatgggcttacctgaaagataagttctgaaatatcttgaactggtctaaattaggtgcaatgactgttctataaatggaaccactttataagaatatgagatccggcaaaatagacaatcaatatttttaaaatgagttaataatatgacaggaccagtgagagaagaaggacagacaatattgtaggaaccattgtgcctgactagagagaaatttcaaaataaagagtgggatatgggtcctggggtaattaactttgagtctaaaatgcagctaatgtgggatacagcattatatgttatattccattttaaaaacctgcctattttaactataaggtatgatcaactgtaagatgcagccttatttcaggtatataaaaatgtggaaaaagttgccttttacaattgatgaaatatggtgatcattcacattttccttgcaactcacatggtgaacagtcacatgtggcataagtgagattggctgtgggtttttctatgcatttatgataagttcactcctttcattcctaatgaagagagcaatttgcaatgcaagcaaaagtaagaaggaagctataatagaaacaatcttgattcacactaatttattaaaaatctgttttgtgagaatgcatggacataaagaaaagaatgagacactggagtctacttgatggtggagggtgggaggagggagaggatttaaaaaaaatctattgagtattatccttattacctgggtgactaaataatctggacaccaaacccccacaacacacagtttacctatataacaagcctgcacatatacgcctaaacctaaaataaaagttaaaaaaattcttaatttcagttctttgtacataattgctaaaacgtgatgtaacagtatgtaatgcaccataggggagaactgatgtcccaagctagcaaaagggtagtatggcagccctttatagggaactttgccttcaagggtggacagggaggttgctgctcaaaaagccaacctggcagatgggaacagaaaataacaaaacaaaacaaacaactacttgcttgaaactatatcacagactctgactcagatgttcaaagcttctaagaagctgtcatataacaatttaatacttggccaggcacattggctcacgcctgtaatcccagcactttggagggccgaggcaggcagatcacgaggtcagaagatcgagaccatcctggttaacatggtgaaaccccgtctctactaaaaatacaaaaaaattagccaggcgtggcggcatgcgcctgtagtcccagctgttgagtaggctgaggcaggagaatggcatgaacccaggaggcggagcttgcagtgagccgagatcatgccactgcagtccagcctgggtgacagagcaagactccgtctcaaaaaaaaaaaaaaaattaatacttaatctcaacacttaggtttgccattgtccttatcatgaaaattactacaattcccaaactcatggcacaaacatgtgttgacaaaatctatatacaaaatgtgaggtatagtcgacaaaatctttagaacaaaatgtgaggtgatgctagaatgtggtgacaattttgccctaacttaattggaaagccattgtaacttgaatagaatggtccacctgcagcatggtcttccctgctctgtcacatagcatcagaaaggaccagatacttgttaagaacatctttaaactgtgttgtttatgcttttgtttttgagtcagcaatcgctgacagattttagaaactggcgggaataaagaatcagacatttaatttggcagggcagtcttgtacttcagataaatggatctggatttgtgatgccttcttcaaaatattaatttctcttttgaaaccaaatcatatttggcttcaatatcttatttaaaatgcatttttacttacatatcatctgctttgagctcttaaatagcctgggagttagatcatggactttgagcttctcaaggattagaacagtgttcttctcacggtttgttggtacttgcccagcatctggtaattacaataactccctgggagattcaagggaaaatttcaagccaagtaagaactggaagggaaagacctccacatccaaataaagatacattttatttaagtaagatttgttgagttgctatgctgttgtgggatctgtgctaggtagtgagtttatgaggatgaatgatacagctcccggcctccatgtttcccatgtattagggaacacacaacagcacgttgtcaagggtgatccaatagggggaagcacagggggattagagatgtctatgtagccatttgcattcaatcagaaggagtctaggagcagttagtctaggacctgagatatgatgttgggggtaatgggaagtaggaatccaattcagacagaaatacatgcatacaaatgcaattcagacagaaataaacaacaggaacaaagcttcagagaagaatgaacagggtgcatttgtttcagagactatcattattcaatataattgtaagttgcaaattgtaattgtaaattaaggcatcaacttgggattggccaaatatcagactggcaaggaaccactaatagaactcgaagtgaattatttgtggagaatttaacataggagttatttaccaaaaagtgggccagatgtattaacacttgagaggtactccaggactattaagtatgggattgttacccctcctagacggggtgtccttgtagcaattatccaactgcagagattctcctaaggagactgcagtgaggaatccagcaaataaatgcccattctcactgtcattctgcttctcatctcctgctagtgttgtccctttgccaaacccaaccagaagccatatgtgctccatgcttatcagcttcccaggcacagatcagagtgaagaagggtggagagctgagaagccaacaagcaaaatctatacagcataaatctgaaaagaaaaatttggctaaaccttgaaaggtcttgtatcttctgctcattgtcttataccttaagacaatgaggtacattcaaagggtgttaaataagggaatatttttatagagacaacccatgatgtacttgatgtaggcagaaaggtagggcaagactagagaaacaaggaggagttagtaagctgctacagttgtctaggcaagggaccgtggtgttgaactgggaagatgccagtggaaatggaaagaagggactggatttgtgactgatctatttggagacagttttttgttgttgttgtttttgttgttgtttttctgtttctgtttttagaatagatggagatggtgggccaggagcagtggctcacacctgtaatcccagccctttgggaggccgaggcaggtggatcacctgaggtcaggagtttgagaccagcctggtcaacatggtgaaaccctatctctactaaaaataacaaaaattagccgggcgtggtggcaggcacctgtaatcccagctccaaaaaaaaaaaagaatagatggagatagtgagattagagaagaaagtgagcaggcattgaactggaagtctagaaatgagaaagaatatgtgtttaggacttggtctcagcttttgcactatgcagctaagtgatccagttgatccagcctcttttgagcctcaattttgttatctgccaataatgggaatataagctggacttcttaaattcttaaatttagtattctgttctttttcattcatcataagcctggagacaatttctgcccaccaggtgaaaggcttttaatgaactgagcatgtcaagggaacttcaggaattcacaagaagagtctgaggatattgctcagctgagggtcttttggatgttgagtttgtttattaagcaattcaactgtcagtgccttagattttaatgtaagggaatagaaggccacccatggagggaaagttagtatgtcctctctgccttctaaatatcacaaaccatattgaatattattcattttgaaatgatttaataaaacatcttcgggagcttcaagattccgttttgaatgtcctacttgtgagttttggaatctgggacagagctgagctgagctggtaattattatcaatgttgtaattattaatttgggttctggatgtcctttatagaacctataggacttctcctagtgaagaacaggaatttggcagtccatcttagctactagtataaatttttctgcagagatctttctccatttaaaaccactatgagtacaaagccctcctaggtctcatctaacgttctgtgattttgtgtcaacaggaacctctctcacagagggaagtcacttcttaaagaaacaggtagggtggtatgacagccgcatgagtgtaatttgttgaacaatgaatgcagggaggaactactctaaattaaagtcctacaatgaaaaaaaaatcaataaaaacagctggaaagcaaagacatttgctaaagccttcgaggtcacagttgtgctaattaaaagaaagcccaagggggtcaagcagattttgaaaagagcttttggatgccccccatctgaacggctgttcccttgctattcaccgcaggtacttgttctctccaaccacaattctatgctcatgcatgtgccttgatttggaatgtgccctctgccattcggctatccctgtctcacctcttattttgcaatcaactcatacaacctgcccttccaggacagctcaagtctccctcctctataaagcttccagttgctatctttctatcttctgaaccattaatgtactttacctatatagacacttatgactttttacattgtgtcatagtaatttatgtacttcttattctctcctttaaatcagaatctttctgactcattccggtgtctgaaatatattagatattcaatgtatatctcttcattgattgaatgaatgaagccatcaattaaccactcaatcagtgaaaataaataacatgtcctttgaagtgtactttctctgtggccttggaaagcatctcttttatagtttctgcttcatcaaaagttcagcagtcgtatccataaaaatattatattacaaaatggtaaatatcctaagaaattacataaatgatacaattgcaagccatattatgagtaaagaggagggtgatataatcaaaacaagaatgatcagcctagaaagtaagattgaaactgtggtatttaattatttttaagttactttttttaactccttactatatgtcaagcactggactaagcagattgcatgcattttttcatttaatctcaaagcatgcctatgagatagttacttgtattctctttatggtacacattaggacactgagacttggcaaaactaagtaatctactctagattacccagccattaagtagcagtgctgggtttcacatacaactcatatatataacttcatttatgctgtactatgcaacgaagtctcatagatttcgataaatgtgactagagaatagaagccacctattctcctatagactgcaaagatatggaaaaggaacatggctggtaagctaaaggatcaagggatccagtcccctgatggactgggttatggggagtgggtggagaggggtgcatagttctgtggggtaattggatgtgatgtggaaagacgtgtggggcctgaaaagggaccaagaaggctgaactagatcctggtggaaatgaatgggagactaaccaatagaagtggcaggtttggaagattagtctagcagaggcacacagagttgttgggtaatagagtgacttgttaggttacagaattttttattacaaccttcagagtctttctcccaagaaaagaaaagacatttacagtcagcaaaaattttatttgaatctctgtatgattacttccatataaccatttctagcctaaattctgtaataattatgtccttgacttatagttggtggacacagatgttagctttgtttgtattaaccaagtcaataggggcaacagacatggtgatcagtactcagtgcagttgttctgataccagcttttctacaggtggttataggaagtgagtaggagagaaaataagggaaatacaaaagtaggaaatgaagagaagggggtggtagttatattaaaggaactttaggcatcaaagtctgatgaggaaagggaatgtgcatgtatgagtgtgtatatgtgtgtgtgaagtcagagaagctttctaagaagccctaaaccccccttcatcaagccatctcctttaagcaaccctgagatcaagagaaggcatcaggatccctgtttctgatcaacacaaattatctaaggtctccttacctttgcccccagtctctgaaagtcttcatctattcatctcagcctctatttaaagacagtttgctttacaacatggtgggttgtccctaccattatgcattgagtggcgatcttggatcccacctctgggtcccagctcacctctttaacactttcagtgccactttaggccacaaagtagttctttgttaagtgatgactttctagctttgaaaagtttcagaatgtaaacaatgcagtctccactcagtagaacccaatttaaattgtttgaaatatataaattcactgttactcagtcagtaagaaccaaagcagtatcaaaaagcagaagagccctagctctggagtcagactgacctctgaattccaactctgtcacttactctgctgaccttgggaaagttgtttagcctttctgagcctcatttttcttcatagtgaaaatggggatcatataaattcctcaaaagtaagacacataaacaaaataatgcagacaggaaatcctagtagagaaccatatacaaactaagcactcggtgaataggacaggtgataactattatcctcataggcacacttgccacatatgcatattgtgtatgtttgtttaatatacaatatatgacatgtatttctatattagtgctttatgtatctgtaatacctaagacacaatgtgacacatagtatatgctcaataaatatttgctgaacaaagctgaaaggctaactataatgggtttttctcatacaaatgttgtattttatgttaataatgaactccaagactccctaagactgctaactctatgtaataatccccagtaacagattataaagatggaaatttttctatttgtttatatattttttcaaaactgggctggattacttttatcaaatgctttctctggtataagatactgttctgttttacatgtattaccacattcgattctcacaagaatcctatgaggttattatctccttctttcagatgaggaatctgagaaataaagatgtaaggtgatctgttcaggctcacagcttgtaggaggaagacccaggactccagctaggaagtctggccttagagccaggacttgaaactactacgcttctcttcacaagttcttattgttttgtttgtttgcttttagcataaaagctatgaaaattagcaatatatctcagtcttttaaagcacagtaaaaataaatgcatttggcaatcttatatctttaccaattatataattacactaagttcatagctatttgccatctttagcacacaaaacattacataagttcacacttcagaattaaacctgtggcccaggtggttctaaaagcaggtaatgcattctggatttcactcctgtgaaataattataaattatttcataaattaattcaattaaataattatataattcaaaaagattctaatactgagggtgtggtgcctctccataatgatgccggaaactattcttttggctctagagcttataaagtaaagcaaaggattagttaagaagaattaaatataccgaggaatagacaacccaatttaatcttttgctgaagcaaaaagtatatgcagtaggaccttgacattttcaaaattaatttgcaactatttgagtgtaactcataaggcccatagcttgtagtgatttgtaattttgttaaaggcacgtgtgggaataaacccttaactagtaagagagtctgccaaccacctaaagccaaatttcaagatatctgtattctcttaaccttaattgcgtagtaaccgccatagtcacttcctattcctcactgtctccctctttcccctttctcctagaagctgtatttcaaatggtctaaaaattgacccctgaggtttgtatggttaaccatttcatgtcctcttacatatttattacaatagcttagattcttggccagtaaattaacactatagatcataatgtgtgtccattactctatctaatcaatgactatggaatttttagggctgtggaaatcaaaacagtgttttttgagtctgggaaagtaataaaacattcctatatttaccctttgttaatgaacttaaatatactgtctagattcttacagtgtattatattaaaaatactatatgtatatgtacattcatatgagactattacattgaaatgaaaacacagtcatatctagtttttgccgtttgcttgtggacatcacccacagatttacttgagttctgataaacatatcgcaaactcgatatcagagtagaactaattttgaatagcttaaagccatttatagtcattcaagtgtataatctgtgctggaaatgtaatttaaaagatattaacttgtattctttttcattatagttacgtttattttatttcttgatttttaaaacctacatttaaaaaatattattttatttacacaatcttctttgaaataaggtaaaagtaggtaagatcttgcaacacatcagtttaccttttgaatgttaatgataggcaacattcatttaaattttctcacaacaaataaatctgacatttaaaccatgctggtatttagaagctagaaacatattctagtacttacctaaaataatattatattttcctggaggcaagttagttttcttccttgcttaaatgaaagcgattatagaaattagaataaataattataaattaaattatcactgataattacatatttttcatcctgggccatatctttgccaatattgtttctccaactaactcacatcactctctttgctttctaatgacttctttttcacatggcaaattgtttcctcctgtatcttgtgtttcagtgaaatctttgtatctcttacatgacaagcttcagcaatcacaagtaaggctcttaccctttggtcctcctgaatctctaatcatcaagtcacaggccagaaaggcaggcaccaaagtgaggaatgtaaagtgatcatgtggaatagacccctattttatttactgtcagtaaggataggagacctctaccttcttgatgcaaatgataaatgttacttttgcaatttactcactttaattagcatgatgcactgcttctccataatgggagtcctaaatataggagatttcaacataataaattaaagacaattaggcaagacagaaaccaaattcattatttgcaattctaatcctcttattggatatacttgacatttaatgcaaaataagtgctccactgccactactatttatacaatagtagatactcattaaaaagttagtgttagaaactccacccctcccccaagaaatatagggcacaattgattttaacagtttttgtttatttgtttgtttgttttttgcgggggtcaagtatttttctaagatattctgctggtagagaactaaagatcattatttggataattcaggataaatttcccccaattgtaaacccagtattttttaactaaataagctccatgtttagggcaaaagcattgtttatgtgcactggggaattggggatggggcagaggcaggatttggttgaattgttgtattactgccttttttctctatttcacttggcatgtaattcgataatttaaagctatgaaatagacactatatatatgaaatatatatgaaatatatatatgatatatatgatatatatcatatatatgaaatatatatatgatatatatgatatatatcatatatatatgaaatatatatatgatatatatgatatatcatatatatgacatatatatgccatatcatatatattacatatatgaaatatatatatatcatatatatagtgtctatatatgaaatagacactatatatattttaaattgatatatatatcaatttaaaatatatatatatttattgatatattttatatcaattttatatatatattttaaattgatgactggcacaggagttaaataaactttaattttacttgagtatgaattttgcatttctcctggaaactccctaaataaacatctactatgctatacagtatagaggaaaacaatttggtcaaagagccatgagtggagagatctcagtttttggttttggttttttgttttattttgtttttgagagagagagccttgctgtgtcacccaggctggagtgcagtggcacaatcttggctcactgcaacctctgcctcccaggttcaagggattctcttgcctcagcctccagagtagctgggattacaggcgcctgccaccacgcccagctaattttggtatttttagtagaggtggagtttctccatgttggccaggctggtctcaaactcctaacctcaagtgatccacccgcctcagcctcccaaagtgcttggatcacaggtgtgagccaccacgcccggccatgagatctgagttttattccttattctattgctagataaataaccttggtcaaaatatttaccctttctgagtctcagttaatactacctaaaaatcatactacatttcctttgtaaattcactgtcccctcaaggactactttttatttctcctcttaccttaaactttcagcaacactctcctcattctcattgtcagctgctgagcttcctttctacttttctgaaacaactttatttaatcaagagagaatcatctgcccatctatctgcatctgtaatttctttcctggaactgtggatgaatttcccatatttctggccaatgccttcttcgttctcatattccaggtgacattaattcagcaattcctctttgtatttggcattatcaacattttctctctattgaatcaatcccttaggagaaaactcacactgctatttctcccatcttaaaacaattaaacaatcttgctttataacaaagctcattggaaaagtgtgctttatatctccaattgctcttcttccattctcctttgaacccactctatctggcgttcatccccaccactcaccaaaatttttattctcagtgttgcaaatgatctccattgtcacttctcaattttcaattttcaccatatttctccatcagcagcatttgtcatagttgaacactcctttctcctagaagtacttgattcgcttggcttatatgattcatacttggatgattttcctcctggtttctcctggtcaattctgtgtgttttggaatggggagggaaggaagttcaccttcattgttaaaacctgtaatttggagtgtcccttggcttattcctcttttttttttttttcttttgagacagagtctcgctctgtcaaccaggctggagtgcagtggcaccatctcagctcactgcaagctccgcctcctgggttcatgccattctcctacctcagcctcatgagtagctgggactacaggagcccaccaccatgcccagctgattttttctatttttagtagagacggggtttcaccgtgttagccaggatggtctcgatctcctgacctcgtgatccacctgcctcggcctcccgaagtgctgggattacaggcgtgagccaccgcagccaggcaagtcctctcttttttatctctacctactcccttgctgatctcatgcagtgtcataattttaaatcccagctcaatgctaataattcccattgctatctgaaatctggacactggaacaactctccaaagaactccatattggtgttctagttcccatttgacttctctacttaaatgtctagtaagtatcttaaacatagcatgtccaaaattgaccttttgatcttctactttctacaaccagaaacttctacaatctttcctacctcagtggcaattccatttttccagttgctgaggccaaaaaacttgatgtcatccttaacttctccctttctctcatcttcacatttgatccataagcaaatttgatcagctacaccttagatttatatccagggcttgactatttcttagcatcctcatttttctatcctagtccatataactatcattcattacctgggttaatgcaactgactcctaatggtcaccttggttatgttctttctcccttcaatctgttgtcaacacaaatgtaagttagattatcttattcttctactctaaacttctcctatcccacccagagcaaaagccaaagtccttaatattgacctctaagctcctatatatttctctcccatttcccatttactctctgacttcgtttctagctactcttcctctactgtttctgctgtattcctactggcttcctagtgttcctctaacacactgggcacacttccagctcaggtccttgctgttctctagccaagaatgttatttctgaaagtatctgcataaccacctttcttcaaactttattaaaaagttagcttccacatgagaacttttctgcctccacagtatacatatactttatatcccacttctctgctttgtattctgactttttacattgaacactatcaatatatattttacttatctaacatatttttctgtctctctcattagaagagaagttcagtgaggacagagagtttatcttgttttgctcactgttgaacctctagtgcctagtaaaatatctgatacacggggagtggtcaataaatgtttgttaaatgcataaagaaataaactaactctgtctactccatatctggactgtaagttaggaggtctataactctgggacaataagtcctaaaggtaccttttaaattattattgaaaaaataatcatatttagtgtgttctttattttttattctatatgttttgatcagtgttggaaatttaacttttttggggctctcagttttctcttgagaagactgaagtacatcagcagttttcataggcaagcatatttatttcatatatctataatgtcatggaaccatttgttcaaatggcacattatttgaaatgtctatatgtagaacagatgaaagtagagatgaatgtagggtacagcaaggagtagagcctctctctattgcttctatggcacctcagagtagagtctaaaggtaactgaactgcataattatctaatcgaaaagtcctattattctacatttggtaattcttatctcaatatttgattaaccagaagactctgctctttaactatattggatttcagtgcaattcaggtattcagaatgttaagaaaacattcctcatacttgtcgatagtattatacgtggtcattagcctcagtcacagaataacaactaaactgccagagggacttcccatgaacaccactagaaaaacccatattctttatcctacacgacttttagccttaaatcctagggccagtgagctgcttcagatgggaatcttgggggttcctcttgatgctttaacttaagaactagagtaaagacaagcttgagcgttttttcttgtgaccccttttagtctttgtccatgagtttaccttagcattaatcagagttccccctccctaaaagtgaaaggtaacatgtatcaaattagttcataacaacctgatcctgaagaattatgtttattcaatggcacaggtggctgtaattagggcagtctttttgattagtaacagcataattcttaggaagcagagaaaacgcttcacttattttatcttatgaggtcaggctttgtggctgttctctctttgaaacaaaacttcagtgtttacaaacatacccataggagacaatttgaaggtatctgccaattttccccagtgtaggtccctacatacacatttctaagaaataatcttacttcgctgtgcatagctagatgtgaaccaaaaggaactcatcagaccccctcaggatttgaaattgcatcttagagatgcatttctctctgttagtgcttaaactcaaagatggcatacagctggggtgcaggctggaaatacagctgctgggtgggggctctgtgtgcagagaaagtgggttggcagagagaaggaagagggaaactgacacaggaagaaacaagaggagacagtataaccaagagagagacaaatggcacagatcataactgaaaaactccctttattcctaggccttgtggttgctgtttctagactgtttcaaagccaggatttgcatctttttcttgggttcctagaaatgacccctgtatcctgacaaggaaattatcactttagcttgagcagtttgaatggacatctcttttatgcaataaaattatttctgaaggagacgctatcaggatgaacatcttcaaaaagaaaggcaaaaaggttgcctctctggcaactgtgacctgattctatggctctccatgctaatcatcactgccatctctcatctgtgttgtgctgctagaattccaatgtggtacctgcacaagtctagaaggacctattgcctatgatggtcaacccacaaaagccatatggggagccatgaccactaatgaactacatactgcagctgcctcagagtcagtcaaaactgatataattgaccaaaatctatgtagaatttttcccataaaatgttagagtatgaaaaatgttttagagataaattgatcttttaaaagagtacggaaaatattatctttcatttatttcatttcaaatggcaaaaaaagcttgtaaaattgctacttctgcttttctgggaaatggaggggaacaaagtagtagagatttcattttggagctaaagtgaaaaattatcatacatttctattttctaccgccaatataaatagtgcacataaaagatacccttaaactatatactaatggacaaagatgagagttccttttctaaatgtaagcaggcattactgtgaatcagtttaaacattgtcttcttagtgaagccttccttgacccttctacctcaggcagagtcatgtttctttctgagctgaatggcattttggacatatccctgtgattgtcatgtactcactgtaatgactgtttatctctcttcttcactaaacagtgagcattttgagtaggaagtgggaccattaaacaggagggctaatacagtagaaaaagcaggcttattagagtaagagtggagtcagggaaagggaaagcttggctttatttaaactaggttgaacatgaggtgtctctgaaagttgcagatgaaaatgtccagttgattatatgcatcctgagaacagaatacaggtctaatccacagttagagatctggaactagtcaaggtgtggttgatagttagaactgtagtaatcagtgatatcgtcctgggagaacatgtcaagtgtaaagggaagaaagctaagaacagagccctcgtgaatatgtatcaagggtagaccatatttcctaaagtggtatttttcaaaccttgacagagtacatacagaatctatctaaaggaaagcagcattttatatgattaaagatggggattctcaagccagattgcctgttaaatcccaactgtaccacttacttgttgtgtgatcatgggttattaatttctataagtgcctcaatcttctccacagcacagtggagctaataacaatacctatgtcatatgattattacaaggagttagtacttaatatctggtatatagaaagctctatatgagtgtttgtaaaataaaattcaaataagaaaggaaaagaatccttgagtaaactcaggttggcttagaatttttgtttatattacttaaatatataatatatataaacagaaacttcatatgaaacatctatacttgcagcactaatacaaccataaaaactaaatatgcttataaaataaatataaagaaaattcaaaaccgggtgcggtggctcatgcctgtaatcccaacactttggaaggccaagatgtgtggatagtttgagcccaggatggatcacttgagggtggatagcttgagcccagcaacatggcgaaaccccatctctacaaaaatacacaagtaattagcaaggtgtgttggcgtccacctgtagtcccagctactggaaaggctgaggtgggaggatggcttgagcctgggaggcggttgcagtgagccagaattgtaccactgcactccagcctaagtgacagagccagaccctgtcaaaaaagagagagagagagagagacaggaaggaaggcaggaaggaaggcaggaaggaaggcaggaaggaaggaaggaaggaaggaaggaaggaaggaaggaaggaaggaaggaagattttaaagcaaattaaaatcaaacttacaatattaatttaatgtaattgcttatgttattctaccaaaactacataacagttctccacatgaagtatgatactggctgcaggtaattttgagtttgatatacttctactttcatgtgctatgttatgactcactccaacctcccaccacttctcctcatttgtataatattccaaggtactgtttaaggttattatatgtccatcaattttcttttcttcttggctcaagaaaattaaatcagtaccatttggtattgacgcattcatacatacaaaggtaagagataagaaatcttatggtactgcttggttttagggcaggcacccagatgatctaaaatgtgtttatattattgttcaagataatcatgaaaatgcaaacagaagcttaatcttcttgtgaagaacttatggaccttagtaatatgtcacctaattccaatctaagaaataaagttataaggagctgctttgaaagaaaaactgaagggagtgtagtattacaaactttttttttattatactttaagttctagggtacatgtgcacaacgtgcaggtttgttacatatgtatacatgtgccattttggtgtgctgcacccagtaactcgtcatttacattaggtatatctcctaatgctatccctccccgctccccccaccccacaacaggccctgatgtgtgatgttccccttcctgtgtccatgtgttctcattgttcaattcccacctataagtgagaacgtgcggtgtttggttttttgtccttgcaatggtttgctgagaatgatggtttccagcttcatccatgtccctacaaaggacatgaactcatcatttttgatggctgcatagtattccatggtgtatatgtgccacattttcctaatccagtctatcattgttggacatttgagttggttccaagtctttgctattgtgaatagtgccgcaataaacatacgtgtgcatatgtctttatagcagcatgatttataatcctttgggtatatacctagtaatgggatggctgggtcaaatggtatttctagttctagatccctggggaatcgccacactgtcttccacaatggttgaactagtttatagtcccaccaacagtgtaaaagtgttcctatttctccacatcctctccagcacctgttgtttcctgactttttaatgatggccatcctaactggtgtgagatggtaactcattgtgattttgatttgcatttctctgatgaacgtgatggtgagcattttttcatgtgtctgttggctgcataaatgtcttcttttgagaagtgtctgttcatatcctttgtccactttttgatggagttgtttttttcttctaaatttgtttgagttctttgtagattctggatattagccctttgtcagatgagtagattgcaaaaatttttttttttttaaggcagcgtctcactctgacacccaggctggagtgcagtggcatgatcttggctcactgcaacctctgcctcctgggttcaagcagttctcctatctcagcatcctgagtagctgggactacaggtgcatgccaccacgccaggctaatttttatatttttagtagagacggggtttcaccatattggccaggctggtctcgaactcctgaccttgtgatccatctgcctcagcctctcaaagcgctgggattacagccactgtgctcagctacaggcttttaagaaaggaaagacttgagtatatttaattgttgaggggaaggagctaggacagaggaagaagttggagataaaatgaaagagtaaaggaataattgagagagtaaaatcttgaaagagacagggaggttttgaaatcaaaaacagaggtggaaggattagagtagaacagaagaaagctaaatcaatgcaattttataaatttagttcaaggatagtgttgcatagttttctaatttttttcaaactttggccacttcttgctgtataaagaacacaaccaacaaaatttgttttcacagcatttggccaggtttttattctacagaatgcatcacaaacactgagaatatatgaggggtttaaatcctgtaaaaagaacctcaggatgagcagatgagttgatcgcgatgcatgggaaccaatcatgagtgtcagtatccagagtttgagaactgagattcgtatttttggttgctttcgctaattgctgatgacaggtatgagtattgcagcatcctaagaagacagctggcttggagccacgctggattaaactgctaagtatggaaagtgaattatttttccctcaacatgaaaggttctggaaattaatcattttacttcataacaaaatctgatgactacagggcaggtctgggcagctaacttaacacagttttagcttctgtgtaggtagaataaaaaacttcctgaaacccttgtttataccaaagccttgtgccaagcaggtgtcctagactcccagaagtggtgaatcataaacattcatgaggcattttctgtgtcagtattttcagctatgaaattgaagtggtaacggatccaaacactaaaagactgctgaggatttccagaattctgaaagcagatgatctctgggtgaggactaaattgtctgttttctagaacatactgtaaatcactctctggtatgtggctacgtaaagtgaatatatgtaagtgtaggtccttaataacaaagggtggtgatgttgactttcatatttaatatgggaaatgagttcacagatttgccaaaaagcaataccttataatttatattcctatagtgcagtacttggtttgtatctctgccctgtacttatgtgtaggaccacaggtcaccatatgatttaatcagagtgcatatgggaaatagaaactatcctatgtagtttaagaagaaagaaatttaattcagggaattaagtgtttgtagtattgctgaataattgaaggagtgggaattaggaggcagctgctggatcaaagtcaagaacacactgcaatacttgaaatctagagagaaggggaaaaggattagaaagcagttatattatccactaccacagaactgcctctcaacattcaattctggataagcttggttgacagtagaaagataacaggaagatggtctctctcttacttcagctttcacatccagttagggcatctaaccgtggaaacccaatttgcattgtgaaccctagctgcaagggagtctgagaaatgtagtttttcattttccagcctctgtagtcaggaaatcccatagaaagaagtaggaatagatgctgaagacccattgacatacccagtacgtaataaatatagccaacctttattgaacattcactgccctttacctgttttcattcgtgtaatccccatagcaaccctctgaggtgcatgctattttttgtctacaatttatagatgagaaaactgaagcactgagaagatgaagtagcctgtccatggctaggagcagtcactcatgcctgtaatctccccacattgggaggatgaggcaggcagatttcttgagctcaggagtttaagaccagcctgggcaacatagtgaaatgccatctctacagaaaatgcaaaaattagctgggtgtgttggcatgcacctgtagtctcagctacttgggggactgaggtgggaggatcccttaaacccaggaagtcgaaattgtagtgtgaactgtgtttacatcactgtactccaacctgggtgacaaagtgagaccctgtcataaaaaaaaaaaaaaaaaaaatggcctgcccactgttatgtacattgtaagtgaaagagagagaaagagacagagatataaagtagggtgcttagggcatagaaaaagaagacaatggattgaagagatatttctgcagtaaaactgacaggatttcatgacctcttagatgcaggggttaggaaaaaggaagagacaagggtgctagaagttactggtttagaagactatggagggtagtcccattagcagagatgaataaaaccacctcttctgctcagtcaagcttccttttaaaacatgaattgtagagctaaatgtagggcctacctatgacctggcctaagaagattaccctagtcttggttggatagatccatttctttttagtcattattaatgcagccaaagatagaattattgactaacattaagttgatggttacagaaacccacaaagtcatattttactttgtttgtgttcctgtgttgtctttctcactaggctatatggtactttaaagcagcaatagagatgtcttcatttacttctaacttctgggtgtctaatgccataactatatgttaaatttaattgaatgaattttatggtccaatggtagattagggccagataatgaggaaactttaatctcaagacagaaaaattctaattctaattctactgtaaaaatgacaatatggaccaggatgaaaggtattttgggaaggtttgaaatgtagtgtgtgcccagtaaatactactgcttcattaacatcaggagtatcatacagaaagtaagtacatactgttaaaactagaaggaatccagagttgagctaattcaatcccttcaaaagaggaaataaagagccagagaaggagagtgaccatgaaagatcacacagccagaaagtgcagaggtgggtgcaaagtcaaggactcctgaatcttggtagcattatttctgctaacacaaatgatagaagtctgtgactatggaaaattaaccttctcctgctaataactaatttttccatagattttttttccttagagtactatttatttttctcttttaaagttttaaaaaaactatatatatttaaggtacacaacattatgttttgatatttcatatacatagttatgatattattactacagtcagtcaaattaacatagccatcatctaacagttacgtctgtgtgtgtgtgtgtgtgtgtgtgtgtgtgtgttaaaagtgtggtaaaatttactctcttagcaaatttccattatacaatacaatatttccctaaaatttgaaacccatttgtttattcagaaaacgtttgtgaagtttctagtattctagctggtctgaagcactgggataaagagataaaaaggcacatactccttgtgcccaagaaatcaccagtcttctgggagacagcattctcagtcttttggttgagcttccaaaatacagtgtgagttttcagggaagagttccagtgtgtctgtctagaatgtcagggaaaggttctcagcctcccaagtagctggaactacaggcacccaccaccacgccttgctaattttttgcattttttttttttagtagagacagggtttcaccaagttaaccaggatggtctctttctcctgatctcatgatccacctgcctcggcctcccaaagtggtgggattacaggcatgacccactgcacccagccagtatggccatttttataatattgattgttctaatccatgagcatgaaatattttttcatttatttgtgttgcctttgatttctttcagagatgttttattgttctccttctagagatatttcacctccttgattagctgtattattaggtattccgttttctttgtggctattatatgtgggattgtgttcatgatattactgttagccatgatgttgttggtatatagaaatgctacagattttttaatattaattttgtatcctgaaactttactaaagtcatttctcaattctaggagccttttggtagagtctttaggattttcttggtatagaatcatatcatcagcaaagagtgatagttttatttcttcttttcctatttgggtaccttttatttctttctcttccctgattgtcctggctagaacttccagtactatgttgaataggagtggtgagagtgggcatccttgtcttgttccagttctaaagtggaatggtccaagattttggtcattcaatatgataatggctgtgggtttgtcataaatgtctcttattatattgaggttatgttccttcagtgcctagtctgttaagggtttttatcagtgaagggaatttggattttatcaaaagctttttctgcatctattaagatgatcatatgtttttttgcttttgattctgtttatgtggtgaatcacattgatttgggtatgttgaaccaaacttgcctcgcaggaaaatgcctacttgatcacggtaaattaactttttgatgttctgctagatttgatttgctagtattttgttgaggatttttgtgcaggacaaaaattctgtccccatgtgttttagtatgcagagaggtaaaacacaagtcactgggggcatggcaaaagcatacagcaatgaaaacttttccaaactcttttcttcacagtgctccctccatggcacaagtgttttcaaaaagcagtaactttttcactcattgctaatatatcatctttactttgtatcaggagagacagagaaagtatatttatttttactgttttcataaaatttgtattgatagcatatagacaggaaaatgcacaaatcagaagtatacagcttatgctaatacatagtgaagatacctacgtgatcaccactcagatgaggagagaaaacaatgcttctttgtacttctcccagaagtactgcctccttctgaagagtaactgctatcctaactcctaatgtctttgattagtttttatccagttggcactttaaataaatataatcatatagtatataatcttttgtgtctggtttcttaaactcagcttgatgcttgtgaagatcatccatgtcattggatataggtgtagttcattcatttttagtgttgtatagtattccagtgtataaaataccacaattcacatatccgttctattgttaatggacatttaggctgtttctgtacttaactattattaacaatgctgcactgagtatttttgtgcatgtcctttggaacaaaggtgtatatataggagcaaaattgctggaatgtagagtatgtattagtttagctttaggagcaactgcttaatagttttgcaaagtgaagatgaatttacttccacattagtttttcttttgcattgtgctctgtgctgtctttgtgctctgtactaaaagggatagaattctgtcatcagctatcactaaacttgtcatcaccttcctcattcctctaaaatttgctctcctcagaggttctccatccacccagatgcttgggcatcatatcctaattaccaagtgtcgtcaagcctacttcctacatacctctcatgttcaccagctcctctccagctgcactgtgatgagtccatgagaatccaaggaactccatactgtggtgtaccctgaggtccctagccagtctgctaccttctgtctacctttcagtcttcctgtgtttgttttctaaataacatgtaagatttttagctgtaattagagggaggaatgggggaaaataagcttactttatcttctgggaaatctcattttggtttaatttgcatttctctgatgaataatgaggttgaggctgaactctttttttatatatttttcagctatttgaatatcttctactgtgaattgcctgatcaaatctctcggtcattttttctattgagttatctttctttttccttactgattaatatcacagaagtattatatgatttaaggctccaatgcatatttttctttatgtcttgagtatgcttaatgttctttttaattatctgctaagtaacatgtttctgttaacaatttatccatagaaacgattagtagaatttagaggcttatgaaaaataaaaatgcataatttattattaacacctctttttaagtactttgacaccagtgaagttctgcatagcacaaaagattcttatggccacttttcagattattacaaaatactgtaaagattctgtgattcaaattatcttaacccatcagtggtgggtccagttaagataatttgaatcatagaattcaaatgggggcacagtgaagcccttcagctttgtgaatgtctctctttcctcaagatgcctacaatccttaaaaaaagagagaagaactaatacaaggagaaaacaatcatataaataataaaataatataaatagaaccatttgaaccatcatgcacacttaactgagctctgcttatcccccagcactttggacttcactgtcaccaacagtaggcaacatttaaaagatgttgagcaggatttgtgtgttaaaagttcaccttgatggcagaagatggataggaataaagcaagacagttactttcatggtccagatggcagacaacaaggacccatcatcatgcagctatgatgggagaggagctggtgaatatgagaggtgtgtaggaagtcggcttgacaacacttggtaattaggatatgatgcctaggatttgggtggatggagaatctctgagtagagcaaattttagagaaatgaggaagattatgacaactttggtgatagttggtgacttagaattctgtcccttattgtacagagcacagcttctccgtctgactgtatctcctgctgttttgaggcagaggaaattggaactaaattcaaattatttcgaagcttttctccctaatgtatttatcaaatcacagcccgctcagctgagtgtgctagacaggtacatttcatttggacaataatgccagtggtttgctagtgactagtgtgtgtctttggggagcagcccccaaagagaagcctgcccctctttttcaacataagaactagaaaaaaaaaatcttggctgtgtactgcacatcatattatctccagaagcctaaattggtaaatgtcagcattactgtggacagtgagtggttgctgatgtgggtttgggtaaacattgtaatggtggctggttgtagataaagagcagcagtttataatttgtgatggtgcatgtttaactccccctggaaaacacagacccttggaatctgaacttgttctaaacctccttttctcacagaaggatcaggaggaagagaattggcatcatcactaaccctgtttcataagctatccaatgccatcctctcatctcttaattgtttccctctggggttcctctctgaatatggatctgagaggagagggaggagagcaagggggcacaggtattaaagagaagaagaagaaaagaagattatgtaaggcagcatcaccaaaagaataagtggagaagacaggaaaattgcaagtacagaagaaaacctcaggaaccagttcaactaacccttttacaggcacccaccaccacactcagctaattttttctatttttagtagaattggggtttcacagtgttaaccaagatggtctcgatctcctgacctcgttatccacctgccttggcctcccaaagtgctgggattacaggcgtgagccaccacacccggcctatttattgtttcttaattattcatttaacaattatctagagttaactatggaccaagcatatagttctatttgctatccttttccaatctgtgtttataatcgtatggactttgatgtgccttgccaccgaatatatttgagatgtgttttaagtagaaacatatctttcagattcagcagaaatggagaaaaagtatagctccaagagagcatgaaaatgtatgccattaattaaagcataattttaaaaaatagaaccaatcaatatgaaagttcatttctcaacatactttatctttttttgtctgattaattgcttttctcctccactcactttttctttatgagaatgtttgttttcagtaggacattatgagaatgtagtgaaaaagtaattctaaaaataattcatctgataaaagagttgtattaactttattacagcttcacacctaaaatctgggaggtaaataatcttttgcagcatcacagtagcatctgtcttctaaacccttttgttctaagtcccattccaaacaggtacagcttccatggtatgatttgtttgcttttatccaaacaggtgtggtttttggggctctacagtgtggcctatggcttaattacaaaatgagatttttgtatacatagtttatttcacctaataaaatgatacttgtagttggaatattttgcttttcagattgtgtagatatcttggaattgtaccacccacagtgtcccaaattctgtcatgcacagatgctcagtaaactgaacactgccatctatagagaagtaattagccagcatcaggtttcattggaatcactttgctgcactctgattcacccttaaattattgtcttcactgtgcattatgagctgatcaaagctgttcttcaagtttggatgctttttttttcttcttcttcttattctttagggcaatgctctagagaagaaacaggcactttagagagcaactacattttcaaaaatagatgaaattaaaacagagcaacaaatcatacacacagttgatttctgttgctaggatgttttggcctctgttttatttattaaccagcgctgtcagcagagaaaaataggacttttgagacaaccattgtaaacaataaagccaaatgtcagtcaaacaaataaatagccaatcttgccaagaaaagacattgcagaatctctgtatctttctcttttttttttgtatctaaaaaatgcatttcagaacaggtgcataaagttgccctaacttggtcaggccatctggctaattagtatgtatgttgagttctagtaataataatattaaaagcaaacacttgtgtaatacccttttcccctatgaggacactgagagacagagaagctaagtaatctaatctgctcagggacacatgaccaatcagtttaagacttgggtcttgaacctgagcggtttggctcaagtcttaaaaaatatgccctcttaacaaatatactatcatgctcctcatgtgaaaagcaaaacctcagagtggcataggcagagttattaaaataaaatgatttaggttgaactgtatgaaaaatgtcaatatttgacagtttgtgacctaacagatctgtagttttatactgtccaatctaatcgcaactaaagcaactaagcacacatttatgaggcctctgctctgggtcaggccctgttttctggatgttgctggagttagtatgatttggtggcagagagtgaatctggagactggaattttccaagtcccattgctaattttgattagtcagttcatttccctggacctgtcttttcatctgttaaataagcagatctcaaacttttcagactgtagttcacttagaaagggtgaaccatcttatgtctcattcattccaatcactctcaatttccagtggtaaacagaaccgctggttagaaagaatgtgactataaaagcaaaatgtacgtgtgggaagaattatgtttgcatatgctttagcaataggaatacagatgatttaagtgtccatatgtcttaaagcctaattattacaaaatattaggccaaaatatagtcagagtgcaaattatgtgtcaccaagagttaacaaaattatctgcaacaaatagaagggataatggtaaacctaaattaaatttatcattaaaagtaggaatagtaggatttaacaactatgaccaattaaagaaaacactgaggattcagtggctttttaaaaagcatcttgcccccaaactgggaggattccacctctctgcctgtgcagtagaagctgtgtgacctagtcttcctggtataataccaaattaaatccttaatcaattttactaaaacactaatttaaatatcaaatcaataatccttaacaattcactcagtgctggttacattttaaaatacgtacctatgaaattacaagtgatttaccttaaaaggccaaagaaaaacttatgtggcatgattgtgatgccctcaccttccatcctaaccctctctaatcggccaatattaatatcaaatgttaaaaaaataattatatttattttaaaacagaggacacacatacacaaagccaccacttatgtcaatacagtttaacccctacacaaaggtgacaagacaaacaggtgagtagaggctaatacctataacaagttctgcacaatctgtgtggggcgccttgtttgtgtgtggtgtacgacaaatatgtataaaatgtgtattttatacatatgtgtatatatataatattaatgtatatataacgatacataggcacacataattaaacaattgacataaatgtttcatgaaataatactcttactgtgtgcattatcctctgaagtttctattttattttttaaagaaaactatgggctgggtacagtggcttatgcctataatcccagcactttgggagtccaaggcaagaagatcacatgaggtcatgagttcaagatgagcctagccaacgtggtgaaaccccatctctactaaaatacaaaaaaatagcctggcattgtagcctgtgcctgtagtcccagctactcgggaggctgaggaagaagaatcgcttgaacctgtgaggcagaggttgcagtgagccaagatagtgccactgcactccagcctgggtgacacagcaaggctacatctgaaagaaaggaaagagagagagagacagagagagaaaggaaggagggagggaaggagggagggaaggaaggaaggaaggaaggaaggaaggaaggaaggaaggaaggaaggaaggaaggaaggaaggaagggaaaattagtgatcataaattgatttgatttcacaatccacttttgggttgtgatttgcaatttggaaagcatacttttaaagaaggttactcagatatgccagatatgagttcaccgtgacctctatgaatagtgtgggcaacaaatgattgggtaaagaaaatgtgatacatatagagagatgtagagatatttctgtctatagataaatatagatatggaatattagccaaaaaagaatgaaatcatgtcttttacaacaatatggttgcaactggaagccattgtgttaagtgaaataacttagaaagtcaactaccacatgttctcactgataagtaggagctaaataatgtgtgcatgtggacatacagagtggaatagtagacactggagacttgggagggtgggagggtaggagagggatgaggaatgagaaattacttaataggtacaatattcactatttgggtgatggttacactaaaagcccagacttctccacttcacaatatatccatgtaacaaaactgcacgtgtatcctcctaaatccatttaaagcaacaacaacaaagaaacaaatgagcaaaggcacatttggaaatttcttagatgaagggatttgaagttgattgctagaactgggcatagttagcctgggctagagacaagtgatgattgtagagaggaggaagaagccagaagagtaagtctcagtcctccaatatttgagcagctaccgaagtaacaagacattagagggactaagcatttcttcctgtggctcccagggatggattttcactcattcagccacctgagcactatttaacaccagctacttgccagcttctgtgctagagactgaaaatcaaataccaaatacattagttaatctttatgcaaagaaaccctgctttttcagtgatgtgataggtcaacatgcctgatacgatatgcagtatggagagattttgttaagtcctagtgagtggttttattagtgactcacagagctcctcatttaccagggttgccatttgactcaatttctttttccttttctctttccttttttttttttttttttttttttgagatggggtctccctccattgcccaggctggagtgcagtggcatgatctcagctccctgcaacctctgcctcccaagttcaagtgattctcctgcctcagcctcccgagtagctgggattacgagcacccaccaccatgcccagtaatttttgtatttttagcagagatggggtttcaccatgttggccaggctggtctcgaactcctgacctcaagtgatctgcctgcctcagcctccgaaagtgctgggattacaggcgtgagccgtcgcgcccagccattgagtcaatttctaaatacttctgagtgttcactactgtgcagaaagtggttcagttatggagaagcagatgtcctcagaaggtgagctatgagctttctacctcagcgaaagtgtttcccagtgcttccttcccccattcccctccccagttggagcatgaaactatgaaagagcttccatctgaactttaaaggagccattttagaattctagctttagacattttttcttgagaaaaatcattaagctttccttttattttagattgtttaatttgcaggaaagcacacatgataatgaatacataaatcttctcaaatacccacaaagcctgcataatgaattcttggttttatacgctttgggctcttaccaatttcttttaaattccaaaataaatccattagaagttgtgatccccatcatttcactacacggaaaattcactgttaaagcttgtttagggttatctgtgagtttattatcaacatgttgaagttacagaaagacatattttggttccatataaaactaaatttctaagcataatagctaccttggtaggtattaagctccccaacatgagagacatttaagaatagttgaaggtcacctggcatctggttggagtaaggggagaatgttacccaaaattaccctttagcttcctaccacccttgagattgtatgttttaattaaataattaatttaattatttctccagcccacaaccgagttttttccctaaaacagcttcctatacgtgctttctggaatcacatccaaaaacacaaaatggctttctctttaaatgaacacgtctttaacatactaactagatcgaaattaatcagtaagtacatttcagtcagtctcttctgacaatatagccatggctcagcaaaatcaaattattagtaataataattatgaataataccaaatagtaacaaagcactagtaacattgacaattgttcttaagttgctaacatttatttaaatgactattgtgtggcaaatgctgtactaagtgctttaaaggtactaatttaatgataaccctttctggtggtatagctcttattttcatttaacagataagaaaactgaggcaggcagccagaatggagattatcaaaaagtcaagaaacaatagatgctggcgaggctgtggagaaataggaatgcttttacactgttggtgggaatgtcaattatttcaaccattgtggaagacagtgtggtgatttctcaaggatctagaaccagaaatatcatttgacccagcaatcccattactgagtatatacccaaaggaatataaatcattctactgcaaagacatatgcacatgtgtgtttattgcatcactatttccaatagcaaagacatgggaccaacccagatgcctatctatgatagactggataaagaaatgtggtacgtatacaccatggaatactatgcacccataaaaaaggaatgaaatcatgttctttgcagggacatggatgaagctggaagccaccatcctcagcaaactaacacaggaacagaaaattaaacactacgtgttctcactcataagtgggacctatacaacaagaacacatggacacagggaggggaacaacacacaccagggccagtcaggggctggggggagaggggagggagagcattaggacaaatagctaatgcatgaggggcttaaaacctagatgatgggttgctaggtacagcaaaacaccatggcacatgtatacctatgtagcaaaccttcacattctgcacttgtttctctgaacttacaaaagaaaaaaagaaagagaactgaggtagggaaattacataacgcagagggccacttggaaatagcagaaccaggacttaatgccgatgagtatactaactcaacagaataaactcataaccactagcctatctataaaatgagctttatttagatgtttttgacccttgctaatttctgtttcatcatctaaaatttagggacctagtaaggcccccttattggaaataatcatgctgagaaaggaagaatgacccctataggttcttagttggaacagacccctggtttcatatacacatgggcgacaaccagggcatgagtaattctcaaagaagtgactttgaaattcagcttatgtaacatcttcaacgagaaacagcaaatttttagagaagtgacaagatgaaggaaaaggactttgagtctcttcaggcacagcgagcagtttgtaggaagccaaataaatggcagataaaggctacttagtaaagcttgttaatgtagattctcctggtaccatgaccaggctgatgagggtccaaagttgtgttcagtggttaacctttgctctccctggtagaaaagcagggatggggggagaatacctttgtctttgtaaatctatgtgctgcttttaggaaaatggagggcagagagttttcccacatctgcttcttcttgattgtctttagctcagtaattctttatattttggggaggcatattccggtctcccacaatcatatacattatagcttaagtatatgttcttaaaatttgaaatattgtattataaattttcaacaagtggaaatggttaagtaatttacaaggtatctactcagtgaaattttaaggagttattaaaatgtttctgacaaagaggtattaacaggaaaatgtgtgcaattatagcagatgaaacagtaaagtgaacatttttttgatatagtgtgaccttaacattgtaaaaaaaaaaaaaaaaaaaaaccataaaaaaacacctagaaggaaatgacaaatatactcacaatgattgaccctgagtagcaatatctattttgttctaatatcttttctttaaaaatctcttgtatttttacttagtaaactccaattgtttctacaattaaaaaaagtttgttttgttttatttttggttctataaagcggtttacttttctgatacaagtgacttggtttctgatctgacgttattgtgtataaagtatcatgctttcatgctcactcttcttaaatgaagatatattttaatggtcatatgttcatttagcaataaatgaatctgtatagaaatgggcaactcagattcactataaaacattcaattattaagatgcacaaagactgccaattcaactttgcccagactggagtctaatgtatagaatctccactgaatttactgccaccttcatcaattccaccgaattgactgctgcagaattttatctgcagccctgcgaactatgatcctgtatttttcagctcacagagaatggtgaaggctggtccagctggtttgaagaacttaatgcaaggtgatgtgatttatagtccattttggaaggtcctccacatgtgtactatctccaggctcatgatttaagtacccagctgaggaagagtaattcctgtattattagacttgattaacctgaggaagcttggagtgcttcattttcaggaaggctcgggctgtcccacacggagattgtatgcttgaaatatgcttttgaaaaactctacctttgtttttcattcagtaactgtcacaagtaccacaggaaacttctgcctaataaggtccacttcccttccttagctttagatttgaatgaaagatgtccaccccaccattaaatgttgtatttagagtcatttgcagaataacttacaatattatccttagtggcaatgaacgtccaaacatcagaatttaaacctttaactttgcctgttaagcagttgataaataagaaatatatactttacagacttacacatgtctttcctgggtgggactttttcttacctagcattgtctaaaataatttattaagatatcttcacagtagcatatcttggaacttacctagtggaagtaacaatgcttataatcatgcctgcattgtagaaggaaagaattttaaaaagaaaaaagaaagaaaaataaaacaggacaacaatattctaccaaccttaatttattcctgggcaagacaactgtgtatcacggttttgcaaacactggcataagtgctgttaaatccctgttcagttgtaagttaaagtgcagggaccaaatggattcccaggaactgaacctatttcaaggaggaaggccctgtgatttaggcctaagacaagagtgttgctggcatgacattgctgaaagcaggggaagaatgactccttgccccagaactgcttagatgtgtccgggatttgtgcaaagtcctttgtgagttattcaaaccaggccatcagaaatgctatgttgggtcataccagtggaaccttcagccaagcaaggatccaaaacattgcaggatagtgtgagaaatgctggaataacaggcatataggaaatgctatgggaatagtgggttggtcattatctcagtctgtgaggtttggaaggattcccagaggcagcagtgtttgagtgtgttttagaagaatgaataaagtgagtgtacaaaaaagaagaaagagctgtctgtataaagtcaccaagttttctaggaagaagatggtgagaagagaggctattagggaagcaaaattgtgaaggtgtcatgtgctttactaaaaacatgggctttgcgctttagttgatggggagtcagcaatggatttgaacagagaagagacaagatcaggtgagcattttagaaggagtcctctgactgctggtgtggctaatgcactaagggaacgtgacataagagggaaggagcaagtttggagagagtagcattcatgacagtggcagtggcaacagagggacatacagagtagagagacattttggaggtaagattaatgggatttggtgcctgattagatgtggaggtttgaggctgaagattctagttcatatcactacaattgtgataccactaaccaaagactttatgccctgtaaaatccatgaatttggctgaactctccaatctatagtatgacttcagctgtataatagttctgtggcctttaaaatttgaactaaacttttaactttacagagaacttccttttgtttgatctcactaaatttatagtttgatagatgaaaaagccaagtgaaaataatctgactaaaatcaccgaagtggatttttcggaggttggactagaaccaagtctccatgttccctagtcttaaactttaaatcaaataacaaatctgatagctttgcactccatccactccacccattttatattttacatggactatattaaaattggagagacttttgaacagaataggaagcagggagctttggaaaagtcacaaagaaatcctgggaacttttgggaaggaagaggtgtccagtagaaggcaaaggggagccaagtaataatgactcttccaggctttccagatgtcaatatttgcattactcacagtccaagggcacctgttgcacctgaatccactgagttttccctataaacctctcccctgtgcaccacattagccttgggtggtggggagtggaaggtggagagggaccagctgataatggctgtgaacaacaatcactgtggcctctacataggacagactctggaaccctgggtccctcaagtctcctgtctgtttaagaggtcccttacaacttacttatcggcatcaccctcaaaatctgtccctaggcaatctcaaccagggaatgagtggactgttgattgtgttgaataaaattatctatgtagactatgtagaggctatgaaaataagcttgttcagtttgaaaagtgataggagctgctcttatattgttaaaacaacactgaatctcaacctcagtgagcagaggaattggagagtcctgatccctgaaaaccagaagttctctactagaagtagtagaatcattttgcaatggtgggagaatcattttcaattattttttatccgtggtggtgattgggaagaggtaagacacctgtcttagatgcaacaggcatttgtgggcaggaagagagtgttcatctgaaggggtcattattgtctttctaggagccaaaaggggcatgctatcaggatgcctgcagagaaacggaaagtcttcatgatactcctcaaagcactgtttgtttgtttgtttgtttgtttgtttgtttgtttgttttcaggcagatctgatgtctctcagggtctgcaataactgacttgctgtcaagattagcttccacttgtggctgacctgtttggcaatggtcaaatacctgtgtctaacagagagatggtctacaggtctacacttgtgcagcccttatcttttggggggatttgattgaatacctgccttcctgcctggctcagtgactcatctgatttcccatacctccttgtcatttagacgtatgattggcagactcaataaccaatcataaaataaatgagcaaaatactgctttgaaagaaagttctttttaaaaaacttttctcctaatatttttgtgtggggagggaaggaaattcatatagaaaaatacaatcccaagctcgtaggtgtggtttaaacagaccttgtttagttttatgatttaacctaaaaccctggagacttccacagctttcaatcccatcgagggaagccctttgtcaagattagttagaaatgttagtgttaaccccattttatccctaaaaaacacttttaaaatgtttttagtctccaagcaatgagcagattcaacttttcagtgctgttttcctagtgatcatttgtttctgatgaatacattcacagctgattttttttaaaaaataaaacatttacacttagatgactttgcatctcaggtgagcttgattgactcctatttgagggacttttttttccctcatagggttttttagcctgtgcactgctctttaagtgttataaagtgaaataacagggaaaaatgagtgggtggttaccatggtgaccaccacagctgatttgggtagcagtagaccgtgctgggaaatagtgccttgttaaaccgaactgcagtgataatattgagagggaaagtgaaaatgtctgagctccgcttaatcaaatgaccaaccattaaaacatgaatatcaacatctgtgctttggcttcaaatgcatatatagcacacatcaaaacaaaagtccttaagcgtacctggaaaatggttttaggaaggaatctaaatcgtcctggtttccaagttttagctattcatcctaaaatattaagaaaagctttaactaacaaagtcttgatgttggcattacaagttttcctggttcaaattaaatgaagacaaagattaatttctgagattgagaggaccttatttcttgacttggttttgccacgcaaaaaggtgaaattagtgaaagtccgcctccataaaccttccctttttgaattttcttcccacctaagggacgatttaagcaggcatttcctgcctaaggggagccagcagattccagcctgcagctgaagaattaacactacgctgtgaataactttgtttactctcttccacattttaaaagaagataccagactaccacttcagagttggaatttcaaacaccagcagctagctgggaggcaggattgaatttggagataagaattcttcctggcgtccttcagcagcctccccaggcaggttttcacctcttcgacttttccaggactaagcctttttaactgagaagagaaagaaaaagaggtgagtgagatagccaacatctggaaagtgatttgttacagcgtttaaaacggagaaaataatcccatctttcaaattggcttgtttgtgttgcaaagcatctcaaactagctctgccactagcctgggaaggtagccctacctgcttcactcctaacaggctttggccaccactcaagagcgtcaggaggtgtgtgctggccaggcggagtttatacaccaagcagctcaaccaggaggagggaacagagctgaatttgggaagcagctgcctgctatgctgaaaacccctggaaacttgctaaagagctgtggtgagaatcatgctgcttttctcagacccatttctcttgacagaccatgtgggggaggtgtggccagtaaaatgaaaagagggcagcagattctcctccctttccttcctaaaacagcctttccctgccgtttgttagtagccactgcttgcaggcattttctacagtggctctgttttcatgtctgttgctatctgtgttctgtgagaacaacaatcagtgaatttttatcctccttcaactaaatgcaacctcagaatcacactctgagtttgatttaccactggcctcttcagcaggattatctcatgtgaactgctagactcttgatattctctctctctctctctctctctctctctctctctctctctctctcacacacacacacacacacggagagagagattgattaaggaatgtgaaatatttgctttagacttaaattggttccagcaatacctggatccacattgatttcagatcagacatttaatgtatgcaagtcctgttcaaacagaaaccagagagcgtgcttcgggagagcctagttctaatccagggagccaggcttatgtgtgtgaaagaaccagacagacttgaatgttgaattctgctttcaccaatcataaactgtgcaaccttgggaaaccattttattttacgcgttcagttttcttatcagtaaaatgggtagtacgttctggtggttgtttaaagattagtagtagtatatggaaagctagactctaacatcctccagggggcacggttaccttattttgggccacatagttaagtaactggaaaggataatttttaacaatcatagcttcatagttaagaatgtcagctcagattattctgcctgaattcaaatcccagctctctcatggttagctgaataacataaacctgtaaaatgataatggtagtagtaactattttacaatttctgaggttcatgctttttatttttacttatgtatttattttttttgagatgtgatctcactctttcacccaggctggagtgcagtggtgcgatcttggctcactgcaacctccgcctcccaggttcaagtgattctctcacctcagcctcctgagtagctgagactacagccatgtgccaccatgcctggctaatttttgtattttttggtagagacagagtttcaccatgctggccaggctggtctcaaactcctgacctcgggtgatccacctgccttggcctcccaaagtgctgagattacaggcgtgagccactatttctggccccccaagataatgcttctttggtaaaacccacagcattgcacccagcacaaactaatactcactcaatgtcagctgttgttattatgatgcaggaatctgactatggagctaggcagttggcctccttcgactaaattcacctcatttgttgttttgttgttttcaatttaattatttatttatttttattttttgagagagtttcactctgttgcccaggctggagtgcagtggtgcgatgtcagctcactgcaacctccgcctcctgggtttaagcgattcttctgcctcagcctcccaagtagctgggattacaggtgcccgcccccatgcccagctaatatttgtatttcagtagagatggggtttcatcatgttggccgggctggtctcgaacttctaacctcaaatgatctgccctcctcggcctcccaaagtgctgggattacaggtttgagacaccacccctggccgttttgttgttttttaaatgagaagttggacaagatgaatcctaatgaaccttctacctcttagtggctttgttcctaattgcatccacatgcatgtaacatagccacacatctttctggtaggggccataaataaaattttttaaatgttttatgatggaaaaacagtgcaatgtaacatacgttctggacttaaaaatcattgccagctcataaagccagatgcgtcatttcatatgctcctataactgtatttccttaagaacatatattgtcacagcccctgatgcttctttgcatttctgtggctctggggactaagagacttgcatccaaacattttgtactgattttaagaaagtttattcacctaagttggctgaaggtggcacttgttagcatttcaagtttctgtattacttttgagaaggaacttgaacctgtgtctctgctttctgttggcaattaatatgtatctggcattacagctgagcagttggcagccagtttaaaaaccagcctggagtcactccccaccccgcctctggaggtgaggaggtaaacttgctggactggagagatttgcattttcctcagagttggagctcacccccatcagtacttcctttgctactttctccatatcccctaccaaatttacttcccacaactcctctacaggctttatgagtgccttgagctaggctagcacccttattaaatagaacaatcacagatttttagaattaattgttgccgtaagaccaccatgagggtagggaccatgtcttcttatgcttggcacttaaaacaggaaaattcttactttgcatggcagtgggagaccataagaatgaaaccataatgatcaatgagaaaaactatgattgacccataaactttccagttttttgtcaaaacgttaaaaattatctttttgttagatatatagggaaataaaaaatagtaaaataatattttattagtatgctattctttaaaatattagaaacagtgaaaattattatatttctttggaaaaaagagtagttggaatagtacttgcctttttcttcttgtcagtcatataacttgtgatacagagcaagtattttttatatgccttggcaaactgtcacacttttttctaatcatctggcaaccttttatcctttgcactttgtgttttgaaatacctacaagagttcttcaatgtaaatttttttgccagtatcatattctctgggacattttcatcctttatatcccagccaccttctttatttatattcataagtttgccttcagtaagttcctctggctgcatatgtggaatttctcaatgagcgttgaggtcgacattcccatagtcagctgtatcttctataattcgttgtcgcatctaaatttcacttacagcattataactttttgttttcttgctgtgctttcctcattgctgacaaagtccctctttgaattatccatttttgtaaaatgtctgtggatttatcactggagacaaggaggcaaaacaagtatgctttactgtctgtgttgtgaagtgaatagcaggtgctcagtgaccagtcactgacagaccttgaaagaactgacgtgagtcactgatgatgatgcgcatgtgttattgtgtagaaatttgtgaattgaagagctagtagcaggtttgtgccttatgcaatcactcatacttaatatattgtggtagctaaagtttgaattgtgttgttgggggactggaactactcaaatcatggtaatgaaaattcatgcatattggaaccatgcaaataaaaaatgtctgtagttactcaatagtaagggtctgttaaatgagttaattaacttgtacgttcacactgatctggtttgcagtcttatagtgtccttttaagtgtccttatagcttggccaactgctatcccccttctcttctcacctgtataagatgtccaaaatagctggttaaagcatgtctattaaaaatctccctttgaacaagtcattaaattctgagcctcatgtttcacatgctaaaggcccagattctttctcatcaaaattttcccttcctcagtacccagctcctcacctctgaaaacaattaatcagattagttgattcacccccagatactcaaagagctctcaggctccccagggtaggttggtttcttcccgcggtgagaggaatcagcatgtggcagagaagttctctcaaatgctgccttcacaagggctattcagacctggtgagcagcagaagagagggttcttgagttagagaagcttcttccctggccctactctctggtaattaaaaaaaaaaaaaaaaaaaaagggagggctgaagaagggagtcaaagataatcctaaactttacttactctttcatttcaatgtgttaatattcaagacggactgtgaattctggagatatgtaagtatttacagtgtggtggttaccagcattggctttgtcagatatgggttcagggagagatccatcacttcttagctctgtgagctttcccaagttactttatatagtctttactaagcctatgaagcttttagaacctcattcttccatctgtaggttgtaattattatttccctgggcttttgagaatcttgaaaaaggtaaagaacacaatacacttggagtaccttttgtagtggaaaagcttgagaaacagaaatggttttagcttctcaggcataacttacataacttaagtgaatgtcattcttttttttttttttttttttttttttttttttctgagatggagtctcactctgtcacccaggctggagtgcagtggtgtgatgttggctcattgcaactccgcctcctgggttcaagtgattcttatgtctcagcctcccaagtagctgggactacaggcacgagccaccatgctcagctaattttttgtatttttagtagagatggggttttgccatgttgaccaggctggtctcgagctcctgacctcaggtgatccgtccacctcggcctcccaaagtgctgggattacaggcgtgagccactgcgcccggctgaaagtcattctttttactaagattttcttattcacagtatacaagagttctggatgtggagatagcatgtaatatacagattcaccttgatggaagttatccagtctgtttgtcgggaacaaaggctaagactggtgttttctcctgtctccttattgactgtcattgatgattaagaacctgtattatattctttatagagtcagtcccccaaattcttttggaacacctcctgctatagttttgatatttttgcccgccaaacttctcgttgtaattttctcccactgttagaggtagggcctaatgggggctgtttgggtcccagaggcagatccctcatgaatagattaatgccctccctggggtcactgagtaaattccttcagagctggttgccaaaaagggcctggaacctacttccaccttgcctcttttctcactgtttgacttctgcacatgcccgctaaccttccccttttgccaggagtggaagcacactgaggccttcaccagaagcagatgctggtgccatgtttcttgtacagcctgcaggattgtgagccaaaataatctctttataaagtacccagcctcagaattgtttttatttttataacagcacagatggactaagacatctcctttgagtgtgctcagaggtatgttcaaatctctcaagatcaaaacactcaagtcacatagtggcagggcgtctcttccatttctgctaatagtgatgtctcccctggaaaaagcagcttgcttcatgggcttctcagtcctctaacactgcatccattacaatgtgtcccaagtgccatatgcatacacctacagacttttccagaaagacaccaaataagagtcactgttaggcctgactgctgtgtgggccatggctctcagttctggctgtgcagggtatttttaaactgtagctcctttcagggattctcactcagtaggtctgaagtagagttgaggcacctgcatttaaaaaacgtttcccaggtgaagaatgggcaggattgagaattgctgctctggtgcctataggtgctggaatctgagatcaaaactagtcccagctgcagttgtctggacaagaatgtgaccttcacttgcctggtgactggattgggctaggagatgcaagctggccctacggtgtattagaacccagttgctccttattctttttaccccagggcaacattttcttcaatattgtcttcttagagagtaatcctactcatcttgacttaagtttttataacagctgcctaactgggctccccaacttcacctccctctcagcctctcagtctattttccaccctgccaatatacttacctcgctaaaataagaaacccattgtcatttcctcaatcttccagccatcaagaactgctgctgattgtttccataacatgggatatttctttttttctttctttttttttttttttttttctttttttgagatggagtttcactcttatcacctaggctagagtgcagtggcacaatctcggcccactgcaagctccgcctcccaggttcaagcaattctcctgcctcaacctcctgagtagctggaccatcatgcccggctaatttttggtatttttagtagagacagagtttcaccatcttggccaggctggtcttgaactcctgacctcaggtgatccggctgccttggcctccaaaagagttgggattacaggcatgagccattgcacctggccttaacaaactcttaatgaccttagaagcccagttttaagtcctgctctgagaagccgtctctactcccaattgcccacagcagagaggtgctccctttcctctgtgcacctatagaatttaaactattgcattttaatttactgtttatgaccaatcttttctcccaaaagcatgtgctgcacttgtctttgtccccctgagcataatggacccccagagggagtacggagcaggtttgaaggtaaagccgtctttactcccaaagatagaccagaacagggattgttcctttactattgagtcagtagccctaagagtatcatcgtttgtaagtcatttggacacagaaaagatataacccaaaggatctgtctttgaacacaataatgtaacctagcacctggctcctaaggcatttcaaaccacagtctgcaaggccacctttttttctgtgtcagcagacagtgcctcctaccacactgccacgtcactgggttcactctgtttcttaccagagaggggctggcttgcattgcatcatctatttgtaggatatttcaccaacaaaaggcagccaaacaggccatgagtttttctgtacttttttccccctgtgtttttacagacagacactgtaatcaactgtcgtgacagctatagtcaattagcctgtgggctgtttttctccatctagactaattgaactgtttgtttttatttttgttatcccctctctactcatttcccaactattactactggactatgtgactaagcccctacaaaaccttcagctactcctcttttctctagtggccacttttaggatgtggcagtaattcattaatctccagacagatttgcatctgcattaatatctaggagtctttatttatttgaaaaatatttttaaatgggttccctgctgttaaagtgaaaagcaaacatttaagtcatctagattagatgaattaagatttaaatttaaacttgcagagtgttgctttttaatttgtattggtggtcgttttttagggagctcagtgtgtgcaaatcatgttctctgtagcttcaaaggaaaaatctaggactttttcctagttagtgagaggtatactgtactttctcgaaaagacaggagctccaatttactgaagaagtttaagtagagtataacattagtacaatcaggagtggggaggtggagggtactacaaaatatttaagttccttttaaaactgagatttcagtaaatcacaagacaggaatactttcatgacagtaagcctaagagtatggttgttagagcatttgtaagagctgggcaaacatttcagtaacatttttttcatgcctacgcaattccaggtcctaagctaaaaacagaaagaaaaacaagatctagtccctgcctacaaggagcttaaagtctagtaaaagaaagacttataaaaaaccaaatacattaaagcattgaagattatgtgagaaaagtctgtatgatgggccaaaaggaaagaagtagaatcgagaaaaaaaaatctcttttccaaaacattctattatgtgatcaaaaggaaatcatcccttgacctctcgatctttggtttctatctgcaaaatgggtataatctgtgacagtgacctaatactttttttgggatccattttgaagagcatttggagaggacttaaaacagtttgtatatccccgagcatagataaatccccatgttaaaacacagtgcatctaaagcaacaccactgagctgtcaatttttatcactagttctataaaacttactgagagacactgaagttcttgtagaaatgaaaaatgagcaactgatgttaattccactggttaagtaggaaaagccagggcctgagagtaagacaactggccaagaaccccaggactggctgccagggctgctggctccctcccattctctagtctctgtgcttgaagctgtaacttaatggttttaagtaggaaatagatttattgatatgtggttttcttctgcggaaaatcaaaataaaccaaaaagaaagaaaaaacaaacaaaaaaacacgtgcttccctgacctttggagttaggactctcatggagttttaaatgtactaagcagatctttattgagcacttgctatgttatgtgccaggcatggtgggcattggaggacaaatcaaacatgacctccatcctcacagagcttagaatccagtttgggggcaatcaaaatgcaatataatcaatgtaatcaatactatgggagtcttataggctcctaggtgaggaatgcttaattcagcctaatgagatgatcagaaaaggcctcctggaagaagaaatgtcaaagctgaggtgtgaaacattgagaagtcaaccctgaagagtggaaaggagaaggaacagtaagtagaaaagtaggacagggagagggagctctcagcttgtcctaggaagtgaaagtagttcaataggcaggagcttagatgagtatctggtcgggcctggattgctaggaaggacctgaatcagagaaggatcacggaacaatcgttatgcccagttgagtttgatttttagtctgaaggtagtaaaaccagttaagtggttttaagcaggaaagggacaagatcaattttgccattagaaaaaaatcacatctctctgcagtgaacaaaggacagtcattaagaagacaagggtggggatcatttgcctcaaaggtggaaatgtcaggtataggcctcagctggctgctctcttgcctctttagtgtggaaaactctaagattatacttatagtcgttcccaggttttgaatgcaaggaatccctttttaactgtttgagaatgctggtacttttagattctgttgataaagataatggtgaatgatagaatgatacatcaaattaaattattcacagtgcaatctatgtatatttaatatctagtaggaaatatatggagaagatattcttgattcagcatgtggaatgtttggtgcctggtggatttgaggattctttcccagaacaccaatgattcctgtgagtttttgatcctcagacttgggaccagagggaaggagttaaaattgtagttaccagtttcatccatgtccttgcaaggacatgaactcatcctttttttatggctgcatagtattccatggtgtatatgtgccacattttctttatccagtctatcattgactggatttgggttggtcccaagactttgctaatgtgaacagtgctgcaataaacatatgtgtgcatgtgtctttatagtagaatgatttataatcctttgggtatatacctagtaatgggattgctgggtcaaatgacatttcttgttctagatccttgaggaatcgccacactgtcttccacaatggttgaactaatttacactcccaccaacgtggcacacgtgtacctatgtaacaaacctgcatgctgtgcacatgtaccctagaacttaaagtataataataataaaacaaattatagttatcagtagtgagttaactgatcctctcaaagggctcctgtaatgatagctgttactgtggagcttactgtatccagcagctttagaaatgctactcatctttcaaatgaggaagcacatgttaatgttagagaggttaagtagcctagtatggcttctctgactgacattcacttcaatatatcctgagattcaaatgaattgaatgtttgaattccagctctactatttatctatgtgatcttagacagattacttaatctctaatagtatcagttttcttatctatgaaatgggtatactatctaccatatggagtcagatcattattaaagtagataatgcacattaaaaggcttgatagccctcaattaagtgtctccccaccattccttcttttcctctttttctttatcttttctccccatttcctctgcatttgcctacattttactctcttctcctcttcctcaattgtttcccctttagaactactccttttctctctttcttaatcttcacataatattaaactgacattttaaagttttactttagttacatttgtagtttctattcttaacataaacagcaaccaactgtttctgttttgttaagaacaaaacagttgctttggaatcaagttgttttatgtatgtgacccttagtagaaaaatatgtcccacttgcacaacattgacccaatagtatgttttcagacccactctggcaacttcacttacttcacacttttgatactctagagatgaatcatccacctaattctctgctgaaaagacatctgtgttcctagccaatgctcttttcatccttgcacattcgcaagtactctggcaaatactgtatgcctcagtcagaaaacagtgaagtcaggtctcctgaaatgcagccagcagttgacgaagcaggtgcagaattacagatggtgcaattgccacagtgcagtagtgtgaagagagttttctaaagtactttttggaatttattcatccctcattttaaaagcatattttccattgcatattaaaatctacaataaaagcttaatgaaccaaactggaataatttatcttctggaaatatattccttatgtcactctttccctgagtttccaagtagcccaactctctgccctatagctttcaaggccttccatgatctggttttcatcgtcatctcattcttccctcctgctgctcacgtaggaacatgaaccctacatttaaatactttctttaggcttctcctgaaaaatactttgtcttgccattctccaagtatttgtgtttttgatgttcttcgactctggaaatccgtcttttatgcaaacctcacccattcttcaaatctcagttcaagtttttccttttttgactactccaagttaaagcaaccttctaaattcctttaatgaggtagtgtaacttatggggaaaattgtggaatctggagctggaatgcctaggttcaaattcttccccaatgatgagatctttttaccttcttcagacaatttatttatcagtaagaaaacagataagattttaagggttttaaaaagattaaaggaggaaaacatgtgaaagcactgtgtaactaatatgataatctgcctagtgtattcatttatcttttcctttttgtatattctcagtttgcaattaaacaaatatttagtaaaaaaataaatttttttttattttctttctttttttttcaacttttattttaagttccggggtacatgggcaggatgcgcaggtttattacataggtaaacttgtgccacggtgatttgctgcacagatcatcccatcacctaggtattaagcctagcatccattagctattcttcctgatgctctccgtgcccctgtccccactgacagcccccagtgtgtgttgtttcccactgtgtgtccatgtattctcatcattcagctcccacttataagtgagaacattcagtgttcagttttctgttcctgtgttagtttgctaaggataatggcatccaactccatccatgtccctgcaaaggacagaatcttgatccttttttttgagatggatttatgttctcttgcccaggctggagtgaagtggcatgatctcagctcactgcaacctctgccccacaggttcaagtaattctcccacctcagcctcccgagtagctgggattacaggcatgcaacaccacaccgggctaattttttgtatttttaatagagaggggatttcaccatgttggttaggctggtctcaaactcctgacctcaggtgatccacccgcctcagcctcccaaagtactaggattacaggtgtaagccaccacgcccggcaaatcttgatcctttttatgactgcatggtattccgtggtgtatatgtacgacattttctttatctagtctatcattgatgggcatttaggttgattccacgtctttactattgtgaatagtgctgcagtgaacatacacgtgcatgtatctttataatagaatgacttatattcctttaggtgtatacccaataataggattgctgggccaaatggtatttctgccactaggtctttgaggaatcactacactgtcttccacaatggttggacttatttacactcccaccaacagtgtaaatgcaacttttttcctgcaacctcaccaagatccggtttttttgtttgtttgtttgttttttgctttttgactttttaataacagctattctgactggcatgagatagtatctcgttgtggttttgatttgcatttctctaataatttgatgttgagcttagtaaaaaataaattctttaaaagaatatgtacatgcttcaccaagtagagtctaaaatgattatagcaagctctcaggtgacctagtactcctgctttggcccatggagcatgctttgattagcaaggcttcctgtaaaccctaataaaaagacaggcaatggaaacacccacacacttagactggagtctagacatgatacttgcacagtgaccctcatcttagtgttcaattatgtttttctgcctgtaacttttcttacaactgtgaaagctggctagctgggtagttaccttggtcacacatagatattagtcagcctgaggtgccaagtgtgttacttcagaataaatataaaactcaccagcaaacttgcagggttcccacagggtgaacttgatctacactgaggtgcctgccctatgacgacagtccaatgactcacttgacgtcaagtcacagatggacgtcatcccattacccgagaagacctccttttgtagcaaatgataccacagaggcgtccaagtgaggggaaatgctgggaagctagttatctgtctaactaaccttcagcagtgtagtgcctctactgagcagagtggtcatagcatctatacaccctatcccatgtgattgtccctttacacagcttatcagtgacattttggcctttgctgagttgtcatcttctttatctagttctctttgtgtgcacaaggcaagaaggaatgtgtatctgattttgaattgcattctttgaatgcacagttcaataagggggttggtgactgctgaggctatggttttatagtcaggatctagttatgtggaaccttaggtgtgtcacctaaccaagtatcaggctttacatttgtcaaaggggctgtgagaataaatgagacagtccatgttaagagtttaacacagtccttgggtacagttagtgctccatgaaaattggttacatttattagtattacaaatgattgttactagcatatttatgttactataatactttataatattacatttaccttttttattctggagtatatttatatgaacccattccacctgccctcagcttcttctcgctactagaaaaatacataggatttggagtcagaaaatttatttctgttgtatttacaagactaaaccctaaatgtctctcatgtcctactaactacatgaatgtccttgtaccagtttcaagctttggttatgccgtccacatctgcaaatagaaacatgttatatgaactatatattgttgttaattagtctctgattatcctcttctgtcattccaataccactgctctttgttcctatgaattgtccatcttggcactcactatcttatactaaaattatccgcttcttgtgtcttcctcttgagtggatgaaaagtatctggccaggcaaggtggctcatgcctataatcccagcatttgggaggctgagcgggggtggatcacttgagatcagaagttcgagaccaacctggccaatgtagtgaaaccctgtctgtatcaaaaataaaaaattaatcaggcatggtggcgggtacctgtagtccaagctacttgggaggctgaggcaggagaattgcttgaatccaggaggcggagattgcagtgagccgagatggtgccactgcactccagactgggcaacagaataacactcagtctcaaaaaaaaaaaaaagtaccttatttgctgtgctgggcttcattccatccacatttcacatgtgttaaatgaaatagttcaggacagtgtacccacctcatattcctctctcctttgttttcatatgatcccaggcaccctattttcatgttacactttcccctttgctttttctaaaatctttcacaaaatgctcacccacaacagtgagacacacctatccagtggagtgtggacagcaagagggtaaagctagaaagggttgggaaaggaaggcctaacctgatttttagaggctgtatctgccctttcaatgatcacctacttacgcttagaaccttctttctcctgccttcttttgctaagtaaccaggaaggtcaagtgccattgttactttccaaatgacttgggggggatcacttccagatacatcaagttctgcttctgaagacctgtatcaacagttaatttggagagtcaagtttcaccttctgaaacaagccaaggctgttatgtaacctgaagttctttgttgaaaacaaaacctgcagatgctgagaaagctaaattaaacttcttacttgccactcagccactaagcatcacaggcagcctagagaatattaccagcactggggtggtaaatgtaatgattgtaatgaaacaccatattcacctaccagccagtgtgattttaaaagtctgcccagattagttggccagaaagcaaactaaggtggagctgaactttacaatgtggttcttgcttaatgagcaatcttgttgaaaaaactaaagttatatatatatgtgtgtgtgtgtgtatatatattatatatatgtatatataatatatataactttatacatatatacgtatatgtatatatgtacatatatgtatatatacatacatatatacacacatatacacacacacacacacacagtgtaaaattttgtcctaggcatgctgatttcagacttttatttttttcctctcaaaaagattctttcttgatgaattgcataattaagaaggggacctgaatgaatattattggcagctaccccaggactcagacttgtctcttacctttaagaggggaagagaacaagcagcggttgagtacataccacatacagtggactctgcttgttcccctaataaatcatcaagtaaagtcagggaaatgggcaccagcagcctcatactagagactatgaaaaacagatttacacaggaaataatttgtccaagatcactcaactagtaaataagtggcagagctggaatgcaatccaagtctttctctcatgatccaaagagaatacccactaagcctacacagccttgggcattgatcttctatcccccagtttcttccttagtatctgggttccatatcccattaaaaaaaaggattccaaaatagatccttcagtctgcagaatctaaatgtaaattgtaattaagtagtattagctaattaggtactttaaggaaaatacagtactttaaggaaatacatagctctgtaatttaaaaaaatggcaacatattgcaatttttgaccataaaacacaagtgatacgaaattggggaggtacataaagccaagtattgaaagacatttgttatcatattgtcttgagaatgattaccaaatttctggccttgttttatggcttcacacctttcataggttatatagctgtttctcctctttgtttacagtcagatcttgggctactgatactttctccctgtcaggtattaaatagcaacgtatattatatttttctattttcaacatttgtgctggtaattcatgccaaaagcaaacatggctcattgttttttatctgacattcaacaaatatttattgagcatcactgtgtacaggtactatctgtttcctaggtactttgtgttctagagattttcccatatgtgccactgtgaacattctaaatgtttcagatctagtttaggaacttcaaatataacttaaacacagaataaatttccaacaattatcataatatctaatatttattgcaagattgccatgtgccaagtattaatgataagagcttttacgtaaatttcatgtaataatcaccacaacctcatgatggaatacaattagtatcatgcttttttgcaaatgaggaagctctggatttaaaagactattacatagttcactcaagatcatataactagttaaagtatcaaaggtgggactctaactcaggcccatatgacagaagctgcacgtttttaaccctatgcattctgccttctggaaaattttattctgttagggcaagcaaacattgaactatgtgtgctgggtgctgggatataaagatgattaagacagggttcctgctttcaagaaccgtgagtgcactgagagggaacagacactcaaccaatctcaaaagcattgtgcacttgtttgtttgtgtttttgttattgctgttgttattgttgttgttgagaccgagtctcactctgttgtccaggctgaagtgcagtggcaccacctcagctcactgcaacctctgcctcccaggttcaaacgattctcttgcctcagcctcatgagtagctgggagtacaggcatgcaccacaacgccccactaattttttgtatttttaataaagatgggttttcaccatgttagccaggctggtcttgaactcctgacctcaggtgatctgcccccctcggcctcccaaagtgctgggattataggcgtaagccactgagcccggccaacagtgtgcacttgttatatgtcatgcactgcacggtactggatataattcaggaataaggcacaatctctaccttcaaggaactcttgtcagagacagatatagaaacaggaactcctaagggcaactgatttctacttctgttctcctatataggagaagtttggatgcttataggccctgggggagtcagtgttgttctagggctctgcagccagtccttcagcctcatcttttgttctccatttattgatgacctcaggcagaccacttagttctagaaagctattttctcgtatttgaaatagagataaaagtatatataaatagagataaaagtatgacctacttcatggagttgattttgataattaagtgataaaatgtatggaaagtatctatgtttgcttgatgataagtgttaattacttttgttgttatcatgaccccatatgggttagaagaatcttaaaggtgttgtcacctcttgcactcagtcttgcattttttctgccaaactaactcaaggcattgctgtagcaaccagcttcatccaggtgtaactgacaccaccttgccttagctgccacgcctctctctgctttctacccgagagcccactcgccactctggcatgcacaaaactggacgtgcaagggagttggcatcgcatgtggcaactctcgacaattggagaggaagggaactggtgggtagagctctcctccatcccttggatagatagttctgaattgcattgtgtatgctcctcagaaggtttccctgcttcctctttcctcttctcaggatcactgctcaaaatgaactatcacatgtgagcctctgcatatattactgcaaacctttgattcaagctctgctttcctggggattatggaagtgcagttggagagggtgagaatcataggagttgggggatattatgtatttggattccccctataatatctttgccaagtggtcattcagccgctgccttaacatgtcctatgaaaggaatatgctgtctccagtaccatgtctaggcactagacacatgtccccggcacctagcacaacacctgatatagaataggagcttaataaacattgtcaaataaatttttaagtaaaaattttgttggttttaaaatgtttttttttttttttagatggagtcttgctctgtcacccaggctggagtgcagtggcgcgatctcagctcactgcaacctctgcctcccgggttcaagcgattctcctgcctcaacctcccgagtagctgggactacaggcacccgccaccatgcccagctaattttttgtatttttagtagagacggggtttcaccatgttggccaggatggtctcaatctcctgacttcatgatccaccagccttggcctcccaaagtgctgggattacaggcgtgagccaccacgcccggcctagttttaaaatgtttaattgtgaagttgaaacttttgttggtgtgcgcgatgactgcaaatctattgtcttttgccttccaagcatagttctacttttccaagagccatgcaaaataagccttcatatgcttttgagtctatgtggttttttcacgaagagaattcattgctagagaatctgtaaatcttttatggcatattttaaaaaataaaataatggaattaagtagaaactgtaaacgtttctactttatttaattgatataggattatattcttagatttattttgttgttctttttaaatgttagcaacatggaaagtaaagtagatttgaatttaaagggttagaagtttatttattaagaactacttgatgttttattatcacaataacagatcttcataatgatagttttgagtcatcagtttaaaaacctattatatctagtatattattctggaggtgaggcaagtatttaataatgatgttttgaaaagtaaagtaatcgcaaaagtaatcaatttaactctctccatttgaagtcttaatcttcagctatatggaaaattcagatattcagaaagatacttcttttctctgaggattccagagaataaaagtttacttgataataacaaataagttgatttttaggcaatcacatgtattaattccaaaataatttttttacattgaagatttagcctggagaaaagaagtttagaactcttttaataagtgaaaatatgcagaggaaacagagctgcagctaattcccacctgcattcagaaagtacaaagggcaagtacaagttaggtatatcacattcctgttcatgtctatgctttattttttaattaaattaattaacgcatttatttatttttataatttcaacatttattttagattcaggaggtatatttgtgcaagtttgttacatgggtgtattgcattatgctgagatttgggatacaaatgattctgtcacccaggtagtaagtgtaatatccggaagtttagtctgaataacttaatatttcagtgactttaaggttatactcagtttttttcctgctgaattatatctttattttatttttgagatggagtctcgctctgtcgcccaggctggagtgcagtggcgtgatctcggctcactgccacctccgccttccaggttcaagtgattctcctgcctcagcctcccaagtagctagaattacaggcctgtgccaccacgcccagctaatatttttttttttttttttttttagtagagacggggtttcaccacgttggccaggctggtctcgaactcctgacctcaggtgatccacctgcctcagcctcccaaaatgctaagattacaggtatgagccacctcagtcggtcaaattatacattttttttaaaaaaagaaaaaaccagaaactatttttcaattataatggtattacatgtttattgttgaaactgcaaaatacagaagcatgtttaaaaaaacaattgaagaactaagcaataatttctactatccagaggcaaccactggtttctgtttttgtctcattttagtatcatttctgtttatgaaatacataagggaggttatattatatgtacaactaactaccctggttcattttagttacattatagcataagcatttaacaatgtcatctaaaatatgttacaaacatttttcatgcaaagtttttcatgttttcagatgcactcttttttatacttccacagcctgccagcttttacttagaaagttaaatatcttaaaaggatattttattgggatttttttaaattataaaaaataaataaggcaataaaaaataactattgattttgttgtaggtccttgccatttattttctgcatcctataaaactgtaattttattgtacatggtagtcatggtagttgatacttcctttttcatttaacaatgttttgtgggcacttcttcatgtccatacattttttttcttttgtaaaagtaaattttaaaagagatctaagattccataatagggaagtgacactgttgacttagcctatttaccattattaaacttttaggttgtttctgatttttcactactgtaaataacagtcatgatgagtattaggttagcttgttatgggttatttatatgatctttcagagctctcatctaaaaaccaaagcttttcaagataattggcatggaaaataattatttcaaatgtaaagaaaactttggtttttgttgattttttttgagacagagtttcactcttgttgcccaggctggagtgcagtggtgctatctcggctcactgcaacctctgcctcccaggttcaagcaattttcctgtctcagcctcccgattagctgggattacaggcatgcaccaccacacctggctaatgttgtatttttagtagagacagggtttctccatgttggtcaggctggtctctaactcccgacctcaggtgatccacctgcctcgacctcccaaagtgctgggattacaggcattagccaccaggcccggccgtttgttgaaatttttatgtgtactcttccattaatgcttggcattaaacattacaattcaagaacctaggttaataaagtcccattttgtttctttgtcactgtttttttcatcagtgggtttacaggatccagattatagaatttgtgtgatatggtcagagagattccctttatattccattgtaggtgacctttattataaacatatttgtgagctacagaggaaataggctttaaccagttaaagatgctgggttaaaaggcaagagcatgtggctttcctggggctatgtgagagttcaatcttgtctgtgaaatgctggaacagcacagatgtaccatagaggataatatattttcccccctggggactggattgatgcgtcattatattgtcatttacagtgcttttcggaagaactgcaattccttaccatcagagtatatttgctttcttcccatcacctccttaactaataaaatttgtatggactgcagaaaaattgctgtatttagcaagtttcattattagcatctctttctgctccaaatctagagaccttaagtaacttgaaacttttaaaagaaagtgctttggttagcctttatttgtccatgaagctcaggctaggtaggaagaattttcatgagcaccaggaagagacagatcagtgtcttcaacctcagtttcaatcaacacacaggaattagagctttctctgggcccagccccagtcagaacatggcacaatttagcagtgcaaggtggcctagcttcctctgccttcaaacaaacctggccttcttcttccccaacagactcatttctttctcccaagcctgccatgtaaatcacctacttcaccttcatgggcaataatgacagctaccatttgtagaactgtgtcagtcttgatagtagatacttagcgttaattactacatttgctcctgtcaacaccccatgagataagtcacattctacctttttgtagataaggaaattgtgatttataaaggtaaaaaattgtccaagttcataccattgttaagtagaagaagatgtttgaaactgtaggtgtctatatcctggtcatttcaccacaccccattaaaaaacacttttttaaccagtactgacactgttaatccttttgtacagaagtgaactacctgtttaagagaagatatgttaggggaaaaaaaaagtgaaagttaaggggaatttgctgagatatcctgatcccaagccaacactgagtttgcaaagggggtaagtccctggcaagatcaggcaagatactctttcagcaggtatcttatacagctgacaaagaaagcacaaaattatctttctactataataatgtggaatagcctcaggatgtttccctagcagggcaatgctgactatctctcaacttcaaattaagtaagttgatttgttgaacaccaaattacagaaacttccttgtatactcagcattatgtgatgtggcccctaggcctctccaggcttacctatcaagctggctcacttgttctctgggacccagtcatactagacttctttcccttccctaccacgacaggttatcccagtgtctgtgctcttcctgttgttttgtcctgaatgccttgtatatacacacatttcaagccttttcaagcctttcattaagtatcatcttctctatgatactccttccacatcaaccacttcctttgtatgtcccggtataactgatgttgacttctttcatagcgtccctaattccatacagccttctttgttcatcttcccttaatgggctgagagctttctgtgtacaaggactatgtcttattcttcctcaatttcctttgtttaacccaaagattgacctgaagtggcccctaaatgatggtttaatggatggatgaatgaatacaaagatagatgtttatgatcagggctaatatttactgatatctactccagacactgttctaagaaaggtatatttaaattcttaaatacattatctctttggatcctcataacatccctataaggtagggattatatttatcctaattttattgatgggaaattgaagttcagcaaagttgagtaacttgccaaagttactcaactaatgagtgacagagtttgtgttcagatctttctactttcagagctggaattttcaaccaccataactaacaatatggcagctacccaaagggggtttctcatcaccatctcccggactcctgcctgcttgctccttttatagaatctacttaaagaagcatctaacaaagcctagacatcctgttgtgtgcgatttcccaaacaagtacccaaaatggtgcttttctatgttacaaatgctgtgttttaattcaaaagaaactgaaagaattagtctttattttgtcagccacttagcataaccctaagtaaagcaggcactactagagcaattgtttgggttacaatatctgaacacttgtgattcattataatttcctacctttgtatctgattattaaattttccttttcagtgcagatggagcaaaaaaaatgtagattatcaattttgtgactatataaaggattttattcagagccagtttttttttattttcattccattgtggcattttcaattaatcccgcaagatgtattatttaaggacattgaataaattttttaggaacacagtgaaagaaaataacatttcattggcaactgttcatcttttctcattttgttctaagacattcttgtttttaaatcatttctaattctcagagtcatggatcgatctggtatgtgttggattttgattctctacattttgtagtctttcatccactgtattcaggttcctaagtaaaagctccatctttatttctaagtgggctttttctctcaaatttctgggaatagagctgcatgacctaggaagataccagaaggtcatcatagcctctttgctccttaagtctcaatgaaagccccagcagtcagcctcctacaacttgtctccacctctctttggcccttgagcagaaagttaaggccaaggaagggctccttcccactctttctcaaaaagagaggataatcttcactgatgtgtgtcaatgcttactgtgtgtcaagccccatggtaagctctttcaatacattattatatttactcctcaaaacaaccttataaggtatgtaccaattgctatcctaattttattatttaaattaatttaaatatttaatttttataaggtatttattgaaaacttttgttcctctcctgccctcattcgtctcacaaagctaatcactatttttaggtttttgtgtatctttctgtagtttcctttgcaaatgcagcaaactgtatttgtgtgtgtgtgtgtgtgtgtgtgtgtgcatgtgtggtggggggatagataagatagatacatacatacatacatacatacatagaaagacagacagatacatgcatacatacatacatacatggaaagatagatagatagatagatagataaatttttagccccattcttatataccaaaggagcattctataaacactattctgtattattattattattattattatttttaaattattattatgtttttttttagacggagtcttgctctgtcacccaagctggagtgcagtggcgtgatctctgctcactgcaggctccacctcctgggttcactccattctcctgcctcagcctcccaagtaactgggactgcaggcacccaccaccacgcccggctagtttttttttttttttcttttgtatttttagtagagacggggcttcactgtgctagccaggatggtctcgatctcctgacctcgtgatccgcctgcctcagcctcccaaagtgctgcgattacaggcgtgagccactgtgcccagccattattattattttttacttaatgatgtgtcttggagatctttatgtatcagtacatagaaagcttctccattctttcttacaagtgtggagtagcccaatgtgaattgtgccatagttttattatctcaattttaaagatgaaaccagttccaggagctaaataactttaacttggagcagagcaggttgatgtgctttgttttcttctttacatcctttttaactcatgtgatatattggggacatctatccttatgctcctatctgcctttattggggccctttagacgtcttctctagacagatatttggaagcagttatttgtaataagctttggaaacctagggcatgatcacaggtcccaaagtttctgatgtttgcatatattcagaactattttttttctgcccctgctggacgtctacctgcagcccacttctcacatgtcaaagatgcagctctctcttgaatgcagcaaaagctactgatatttttggctgtcatttagcagccctctgcctctctaatcacctgatcccacctggcgggttctgaactcttggccgcagaccctgactttacaaccacactctggaaggtaacataggatgtggaagagataacataggatgtggaagagataacgtaggatgagaagagataatttaggataggctttcagagcttggcacatggcaaaaactcagtaaagatattattatcatctcatgaaattctttcaaaaccatttaactatagtacaattattatacctgttttacagatgtgtatactgaggatcagaaagtttttgttttgccagagcttacagtccttaagtgacagagatgatatctacattgaggtccttccaggctaggtttctctatattttatcatcaaatagaattcagaagaaacccatgataccaaatgtcacatggaagtacatatttagtaagacattgtacatacagttcaggttcactcacaaaataattttactatgagaaaagattcatgattggcataagatgctgctatgttcttctgcacattataattatatgaaaatgaaacacccactgccatttctgcaaacctatcatctatatatttcatttcagtctcagaaatgtttgaaacagggtttttagccaattttggaaagaacatttccctctcagcaaacataattataatagtaatagtcaccatacttgttatatgccaggcactgtactaagctgtttacctctattatctcatgtactccccatcacaaccctgtgacattattcatcatagtcttcatttacagatggcattgatgcttaagtgagactcaatgacttatccaagtttgtagcagctagtgaatggcagagacttgatgacaatcaagccagtctgtaatcaaaagctcctatgtgaaatcactgtgttttatcaagttggcctataacaaggttcagagaccatgagccaaacccattgcaagtcttttagaatcacttcttactggccaaagattttaaagtaaatgtcataattcttaccagctggtatctcaatattctgggcctctctgttcttgaaaaaatatcacaatgtggtgcatgttctttttaaatcccacctgcattgttagcacctttaattttattaaagctttttacataccttatatgccaagtcagcaacttttcttggccaggctgctagtagaatccccctgccatgccccgaagacataactttttctttctaagcaacaccattcccaagtttggtctttctagcttacatgtttagaaacagatcagcttgttatacgtaaggggttggaggttgatttgtcttaaggagagttcaaaaaactgaacttactctggcttaaagaactaagtgtggtcaaccaaatgccccttaaagcaattaggtaccatctgcttcccaagactttgggagtagagacctgctgcttagaaaccttgtttgaattagtattacaacaagccagtggcctgtggtttgattaattactcatgacttcttacataaaagtaatctttcctaaatgtattctttggataattagaggtcaagtatttgttattttagagtcaacttcattttctttctttaagtagcaaatttaatattgttcacttcagttgatcatttattgagcacctactttgtgctaagcactgttcaaggcactttgaattgttaggtagaaaaagtagaaccaaacttctactttctcctccccagaattcaaaatgttacaaacactgactcatttctttgagggcaaagagcatgtcttgttattcttacgttgaacacctagtataggacctcacccacagaaaaatttttgtttagagtaaaatgaatgatctcttctttcatctgcttttctgaaggtgcttttagcagcattgaaccacagaaagggaaattatatttctgtttactatggcgaaaattaaaaatggatttttgacttggtacatattctcttttgtcttgggctcccatagtgctttgcaactctccaatagcagtatcacttttcttccatttgtgactacgaagtccttcatgttagggaccatgtcctatttctctgtttccttactatgacagacccaatactctgcacatagtcatttactcaatatttgtttaattgaattaatcataggctgcctcatttccctctcggaaggtagagaacacatcttggtcatttctgtttccattatatctatagtagattatgatgtacattttgtacttaatgtatcatcagtaaatgcttatggacttcaagtctcctcattcccttggttggatttttttgtactaccattttgctttttcatatcaagatgcccaaaactgtgactcaaggaatgagtgcctttactgactgactgactggctggcttacctaatgagtaaataataataaccaagtacatatataaagtgcattctcatatagccacaaaatgtcgccctctcacctgccacgttgggaaacagggtccagaaaaggaagagcttatctaaggtcacgttaagagattgtgccaaagctaggattagaatctagatttcattacctccagcccagattttctccttcctaatattagttctcccttcttttctttacattcccactgctgccatctaagatcaggccctatccctcctacctggactgctgccattgcctcctaactgttctctatgctcccagcctcaacacctccagtccatcctccacctggttgccaaggtgattttctaaagtgcaaatcagatcatgttcactctgctgtttaaagtcttacagaggctcccatggcctatgggatggagtcccctgacccacatgacagagaatgatccaccccgtgactcccaagcctgcctctcatttctctcctcagtctgttttccagctgggttcaaatgtctacagtgaccataaccttcaggttgtttcacatcacggtggagcctgtcccaattcctcctgtgctctctgcccagaccatcatctcaacctcttctcccttggttaacagcttcttaggccttctaggtagacagacaggggattttctttttttgaggattttctttttttgagatggagtctcactctgtcacccaggctggagtgcagtggcaccatctcggctcactgcaacctccacctcccaggtttaagtgattctcctgcctcagcctcccaagtagctgggattacaggcacccaccaccatgcctagctaattttggtatttttagtagagacagggtttcaacatcttagacaggtctcgagctcctgacgtcaggtgatccacccacctcggcctcccaaagtgctgggattagaggcgtgagccactgcacccagctaggactcttttactgaatcacaaactctatcctcttcccctccccacacataatttctccctcattagaggtgatcgctaagcacctcatatattttcttctatcttaatagcggtaacaggcctttcactttcacttagtttgtgaatcctcccagttctgtgaacgtcttaagggcaggggctgggctattcatgtttgtattcccagaacctggcactaggtcaggcatataatagatgctccattacactgctgctgactctctggaataaatatagcttccataacccttcacagtgaattaactcaacttatggttttctttaaattaagcctcacatggaatgatagttgaattatgtaagacttaaaggaaagagaatgtatttaaagaaaaccagctcttgaaaatgccttacttttataggtggtgaacaaatatttcgtagcaaccatgggataatgtatcagcatattggtaatgcaaagtagacggggccactgaatgtgtctctgaagctctttgccactgccttcccactgcgtctctctttagcccccagtttactgaaagaagtcagtgtggttacctattcggtgaaaagaacttgtgccacattccgatctttcatcgtggagtagattttcagctacatttccagctccgttgttaaacccattcctgcctgatttgccaattgctaaagtgttcatttgttttatttatttatgacgcgagtcccttgggttcaaaaatcgcttcaaaatgctactgctccatctggtttaaatagagcatactaggaagaaataagagaaacaatgggaccgtgaggttgaaggaagaaaggaacagtctggcaaacaggaagcagaaggaaattaagattcttttttctttctttatgactttgtgctggggggagggaagctattttcagcaagaagatatggttgctatctggaagttcacatttctatctgcaatgatctgatattcaaaatctatgaggtctgagtccatgaatgactgtgaatcatgttcaggcaggctagtctccagggccggggacaatggcctttgttcttcccttttcttatctgtttcattattctcttaggcacttaatatgctgaacacaggcagccctgtaggatgttctttccacgcaagggtagacattttggctttggactttctagattctccagcagaagagccatttaccttgctaatgcttttcatttgtttgaagtccttgaagggcatggtggtgagagatttagttagagtcccagctctgttgcttactacctgtgtgatcctggggacacggctttgcttaacctctgagcctcagtttcaatagctctcaagtggaccaataatacttatgtattaagcttgtcaagaagattaaacaagctatgtaagagggcttcacagtaaacactcaggaatcaatagctatttttataagatctgactgtacttcattttacatgccctttgggttttacagcactcctctgtgagaaagatacagaaggcatttttggcccaatttgacacaattgcatgagggaaggggctcacaaacccgagaaaccctgctcccagtgattggtccctttccgatctgtcacctttggcttgtggttgcatatcctctcttcaccttttctaaagaatgactcagagcttttccttttgacagcaaaccctctgaaagagagacaatagcaatcaaatactttggcattattcacccggagagctaaaagctgtctctgccttccacatttagagtgtaggatactgctttaaaaagcactaagcaaggacaaaacaatgtgattgggtcacatctttaatttgtattactttcccttttatcaaaagggaagtggacagggtacggtgtcctccacaaagaagggtaggagagaagggtggagcagcaggcacagagctgccttcgccgttcccacaccctactgctatgcacggtttgattgcgtgttgcctgctgttcatttggcccttcctgaagggactggagggcaaaacaaggactctgcttccccaaagttggggaaggtaattagaagctgcatactacactcaaactgtccagtgactattcaacagtactaaaataatgctcaaattcaccagacaacttttcctgtgtgcactcatgcccccagacccagcatggtcagccaatctacagtgaatttatttcaggcatgtgacaagggctgacacttctcctcaatttggtactgtaaaaactaacaataatatgttagttataataataccagtagctgttacaatcaaaactcaaaaaaaggtttaaacaattagaagcttatttactttctcagaaagtctaaagccggtcttcttggctaatgggcaactctcccctggtcagtgattcaggaactttggcttttccacactatggctccttcatcttcaacatgtagctctgaagccaaaagattcattgcatcaagctagtagaagggaaataacatgaaggcttgtgaggggattatttttatgggccaagcttgttcccttacattggccagaactcacattcccttggcccagactcagacacatggccacacctaatttttagggtagagtctagttttgtgctctaggagaagaggaaatgagtttggtgaaccagatagtctctgcctcaaagtagtaatgacaaaaattaacatttataaagcatttgttttgtgccaggcattggctaagccctttacctacattatttttaaattcatataccatattattcacttgtttaaaatatacaattcagtggattttattatattcacagagttgtgcaaccatcaccacaattttagagcattttcatcatctccaaaagaaaccccataactattagcaactcctcatttcctcccaccccctacctccagccctaggcaccatcaatctattttccatctatatggatttgcctattctaggcatttcatataaacagaatacctacattcttttatataaccctcaccatgatcctaaaagttaggcatgttattacttccattttacagataaatttacagagaatcaggctgtttaaatgatttgccaataattttaagccctgctcatcattgaactccattatgctgtactgcatcccagtcatatcatgccatgatttgttgcagggaaggggtgtttgtttgcttgttttctaatgactattatggcaacaaactgacttctttataacaggctcctttactgaaatgacaggcacttaggtgtcagaaagcttcaggtttgaaactcagatctaccacttaccggatacatgaaaaatatacactgcttagttcctcttgagtcccagcatctttatctataaaatgggaataacaaattcctgtttgcggggaggagtcaatgagattaacatatgtgaaagctcttctcacaactttacgtagtccatgtcctgccagtgtagttgtccttgcttagaagtgaagttctaactataattgggcagccacagaaattatgttcacatgtctggtcttctggataccgtccaggaaaaaattattgtaacttgcacttttcggtatccacgttacaacccaggagtggccgagacccttggagaatctgctacaatgagaatgagaaaaaagggaacatattctccaggacagcaaagcatatgcagagtatcttctatcggcttctgatctccactgggcagagcagcttgttacaggcacctagaaccagctgagccagtgtaagtttgaagttcgttgggaaagaagataagctggctgagtttctgtaggcaaagagccagtaatgaggtttccagcattccatcacacgtccttttcatcactttcagctcagccagagacagcagagcctcatacgcaggggccaagtgtgtatttgagagactcgaagagggagaatgaaaagtattgtgaatgagtgaattgtacttttgttccattgacctgttccccaccctaccctgtccttagccataaatatattaaaagctagataggagagtacagagaagacagtggaggcagtggggaagttatattacgtgtggctagttaagttacatagccagaagaggccagaagagaaaagtgtcctgaactctaggtgagatcaagtgcatatttcagccttaaaaatttatcctaaaaacctctgattctgccatttcctaagtgcatggagaagtgacaacctctctgaacctacatttccagataggattgttattggaaccatgacttagagccatgcaagctgcaacgtgcacatgtccagtagactccagtcatatacacaaggggccagcaaacttgttttgtcaagggccagatactaagcattttatattttatagggcatacaatctttattgaaatagtcaactttgccattgtagtgcaaaagcagccatagacaatacataaatacataaatggatgtagctgtgattcagtaaaactatttgtggtcatgaaatttgaatttcatgtaacttttatataaaagtttcatacaaaacagtattcttttctgatttttctttccacaaactgaaaatgtgaaaaacattcttggcttatagactatataaaaatggacagtgggacagatttgcctgcaggccatggtttgcagacaccccccccacccccacccacagcatggaccgaaatgtttgataccctctacagaggtataatatggtgtccagattattgtaaagagcaaataagtacttgtaaaggcattaatgtagtgtctgccccttataagtgttcagcaagtggttattattacaattagctcttttagaaataatgaatattgactctctatttgccactgacctttgaggggggagagccattacatttaggttgtttaacatttctactatattaaacttgtattataattaaaatatatattaaaaataaaaactaaaaaactggtttgtacagatagtggcactagtaggccacagagtttttgggttttttctattgtcccagtgttgcttcttcaattcctagatatttctttagtgcttggtctgtgcttctgggtgctccataaatgaatgagattaggtcttttctgtctaggagatcttggtattcttcaaagtgattatacgcaccccagtggtagccaagaccttctctttttattaatttttcatcacagcctttaaatttctgttttgttatatgttttatagtgtgccacactgtgacacagtaatacagttacacaataatttataatattttatgtatataaaaatacataatttatatttacataaatatttattaaatattataataaatataatattataataaatatattataatataaatatatattatataaatatatataatatatattatatatttatgtaaatatataatatttacataaatatatttatgtaaatatcaattatgtaaatattaagataatgggtgagtatgcaaagtgattttaaatgatggtgtcagcaagcaaagttttgaaaccactggtttaggaagcaaacagatgaatatatcccaatgggaaaccagatttggtatgagtgatgaatgttcttattcacaatgacacaagtgttttcaggacataaactgacatttagtctggtgtcttgttttgacatttaatgtaagtacattgtgtgagaaacaagatagtttacattttttttatttcataagaacacaacagctatatgaactagataatattatcctcatttgatagatgaggaaccaaggtttaattcagagaagttaagcaacttgcaaaggtcagcttgaatgaatcaggactgtctaactataaagcatgacattttccactttagccttcattgcattgaagaagttcataaaaaaagatgattagtctctggtattcctactatcaagttagtctttttttccatcacatgtacttatgttattaagtgctaaatggataaaatttcactcctccagagttccgtggttaaccccccaccatctctttgcatatgcttcttactctgattgcaacacttgttgtttggatatctcaatatctcctactcatctattaagacccagcttaagactcatcctctccttccagaagccttcatgacctcagtctccagactgagttattagatgccattgctctcaacctctatagcaccttaatgaaagtccttataaaaatatgctatgcagctgtgtagttagctattatctattaaatttattactccctggactgagagcctaaggagagggagaatatgaccttgattacatcgttcttctggcattcaacgtaataatgtagtgcctgggacatcgtaagccctccatatatactcacagaatgaaggaatctcttctttactgatttgaagtctgagataactttggcaaagggatagattgaagtggtcttaactaaggtttctcaggataggacaaattggtggtccccaaattagattataggggaccagataatagataaacaaagaaggcaaactcttatatgtaggaaggctttctccttctgagttttctcagaaattgaagaaggtacacacaatcataccactcaaatttatattaatgatgtatatgacatcaatatatattaatttctatatatacttatgtttatatgtatgcacacatactcatgaacacgaattcataaaaatagactgccacaatttctataaactgtcatggggatcactgaatgttcaataagagggtgaagtttattaacactctccaggctggtccatcttgcaaagtcatccagttgctgtaaatctcccttagtcctaaagtcgtttcccttctggatgcataaatcttcacttctttctttgaagggaactagcatttactgaaagcttttttatggtgttctagatacttaacaaaggtgatctcatttaatcctcagacattcgcacaagcccacaaatcctgaacccgaaagaaaatggatcaagtcaaaagcaactcaagaattttactgaaaactaggaaatctatactaaaaaggaaggggacaagactaaggaaatttctgaataaatgaatattgttaaattcaaacaaattcgttgcgtgggattatatcagaataatttcgtggtaattaattgagattgtgaccattaacgtggacactttgtttatgagcagggacctctacagttgattgagagcacagcttcttctctctaccaagtgtgttactgtttgtgaagagcttccttttttttttttttcttttgagacagggccttgctctgtcacccaggcaacacaagtgcagtgacgtgaccatacctcactgtagtgtcagtgtggctctcctggggtcaagtgatcctcctccctcagcctgctgagtagctgggacttcagatgtatgccatcatgaccagctggtattttttgtttgtttgtttgttttagtggagatggggcctcacagtgttgcccaggctgaggacttgtttcataaaggggacagcattggaacatttgtcttcagacatttatgtttcataaaccagaaacatttcagaacaaacttctataggccacagaattgccaactttttatcttgtcaataaaatgaaagacattaaaaaacaaaataaaaatttacgaaaaaaatccaactactgtttattctcaccatcatttcagaagtaaaaagaacaataccaaaacaataggaagaaaaaataaatagcaggaaggcaataattctataataaaagaaggtcattttagctcaatgaaaaatcactgcatcctacttccttttctcagtctgctctggaccaacaagggccagggaccagtgtctaagaaccaccgccactgtgcatagactttgaagcggtacagattttgatttaaagcccggccctgccaatttctagctgtgaaacctggggcaggttactcaacttttctcagctgcgatttcctcatgtactaaatgaggataatatctcactgactatactcatttcctaaggctgctgtaacaaagtaccgtaaactgggtggcttagaacaagagaaatgtattgtttcaacattttggagaccagaagtctgaaatgaaggtgttattttggccattcttcctgcgaaggcactagggaaatacctggtctaggcctcttctctgccttgtggtagtttttgggtttgtggcaccataactcccatctccacaaaacattctccctgtgtgcacctctgtgctcaaatttcctgtttttatgagaacatcagccatattgaactagatggaagtagtggcccaccgtattccagtgtgacctcatcttaactaataacatctgcaacaattctatttcccaataaggtcacattctgaggtactgggggcaaggacttcaacatgtgaattttggggtgacacatttcaacccacaacattgaccaatctctggaattgttgtatcaaagtcatacacaggataggctgaatatattagaaagtacctataaagcatcagaaagaaaaataagggagggttgtttgtttttaaaaaacaagttataattgagaaatttataatgtagggacagtaagaaatttgtgtaaggatataggactaagaagtagtgaagataagacttcaaatacattcatttaataaatacatattacatataacattcatttaatgtgtacatattatgtggcaagtcctgttctggtgctggagattcaaccaaggacaaaaaagacaacgaccctggcctcatggagcttacattctagttgggtagaggagcaaaagtaaagaaatgaacaaagaactataaaatatttcatatatacatttaatatacaatatttagtatataatgtttaagcagagataagtactataaattttttagaagtctaataagagggagagataaatggaggaatagaggatgctgttctatacaggatgtcagagaaatctcttcttccaaggagacacttgagcagatggaattctggctgcagtgaaaggagcaaattccaagtgaaaggggagctgctgaagggagctgagcaaggagtgttggtgtctgaattttgttttaaaaacatggctggctgctgtgtggaggaagggtggcggcaaggcaagaatggaaacaaagaaaccagtgaggaggtggttgcagaaatccatgtgagaaatgatagtggtatagattagggagatgagggtggagatggaaaaaagacagagggtacattttgaagacagagttgacaggatttgatgatgaataaggcatggggtgtaagataaaaaggagagtcaagaatgactcccaggtttttggccagagcaactaggtcaatgattgcgccatttatttaaatggtgcatactgggagtagagcagattcaggagaggaaaccaagagtttagttttgagcattttaaatatcagaagcctattattaaacaatcaagtagagatgcttagatgtggtatgcagctggatataagagtctggagcttagagcacagattgagactggagatctacatgtggtagcctttgatctacagatggcattttagtcttgataccggatggctagccttgggagcgagtataaaaaagaagtctaatgacaaacttggggacactcaaatttaaaatatcagaaagcagagaagcgcccagcaaaggagacgtagaaggatagattagtgaagtaggagaaaaaccaagggggtcttgataaccaaacagagacaatgatcgattcagggaagttgtaattgattctgccaaatgctgggaatggttgaataaactgaaaactgtgcaccggatattgattttgtgagtgacaatgttttcatttaccttgataagaacaattgtagtgggaagcctgattgaagtcattaaaggagagaatgggatgtgaggaagtgaaaacagacactaatgttttatgttacctgttgccgcaagtgcttagaagcagtggatatgagatttaagagaacaggtgctgtggtcttagacctcagctattattgtgactgtgccatctgttagtaagttacctaacctttctagccagagtcctcacctatacggtaaagataatagtacagaccatttcaaaaagttgttgtcaagcttaaatgagagatatgcataaagttttgtatattgtcagcccataataagtgctcaataaatactagcaccatcactaatttaagcaaaatattgatacagcttcaaggttctacataattcattatgtctgagagtaattgttggttgaagtggtaattatgaaagaatatgtataaaattatgattattcgtgacaggggaacagagaaatgctacaatataagagttatcatgactcatatatattaatttttcatggaatgatggtggtatagccaggtagcaggggaaaatggacagggaagaaatggctcctgaggggatttgggggctaaatgtaggtggaaggcactgagaagacttcgagaccaagccatttcagataataagtggatacctacttcagacatataggaagtaaccattgatcttgtagctgtagttatcacctgttctttgtttacatctgacttttcttaccagtttagaagcacatgtcttactccaccccttacctccaattatatttcttacctctgctcctatagtacctactattaagtatggtcaggaaagacggcatctcatccatgcgtattccagaccttctagtaagacgctcagaggaaaagctaaacaaagagagaacagactgtatgtgagcaaattaagttggccacagagttattctctggaaacatggagctaagaaaatctctcatgtctaaacctgcatatcctgcaacattacagcatcaccttgtcccacagagggttacttctgatggctctcaaggaatgctgactgcataccttgaagatagcagtttctgatcgggaggagctcatcagatagagacctcaccagtggccaaatactaggttatactgacttacggtaggagttagcagtggaacgttcaagacagagatacctgtcttcctgcttggcacaccatgacttagtggctgtaagtgtatagttacatataaaagttcattgtttttatgggttttgtggtaggagcttgtttgaaaagggtgagagaagccaagatggtctcacagtggatagcagacatgttgcaaatttgctttcttgggctgatgaatttatttgagtaatggtggaagtaaagcagagagaagctagtgagctgggccagcagcccagcacagagccctgggcccttcattctcttatagaaagcccatctctggtagagagatgttaggtctctttagggctttttccccttcactgactggcaggttagaagactccttagcacagtaaaattaacatcttaaaaggtagttgagggagaaggtgtggcagaaattcattttgtcaaaggaaatacggcaggaatgagaaccatttgggggtacatactataaactaggcactatattttcttgatattctccatttagtcttgtgatgtacgtttcaatatacccattttacagataaaacaatctgcgttttagtaaattagtggcaaagacagggttaaacacaattctgttgaatttcaaaacttatctttttatcctttctactaaaggccatagtaaatcagtctgctctcattgttcatctgcctctagcagtttagtgtaaaacactacttggggccagataatatatatgagtctgggctttgaaactaaattgcgtggagtccattagagctctgccacttaacagatatatgatcctgcgtggattagttgacctccctgaatctcagcttcttctctgcaatatgttgctcatgatagtacttaccttacagggacattttgaagattgagtcaatacatgctaagcatttagaatactgcatggcacctaaaatgtgttcaatagatattagctattattatccaaaacatattttccagtgctgttattcgatgaacctaaaaaggttaaactgaccttgtcagggagggaacaaaaagctcaggcactgctccccatgaagcctgcctattaatgatttttggtcaacagtactgtttatgatttccagtcttctcgtttgctgggctttcatgctccagaggcagcatggtagaatagaaaggcactgtactttgccatcagaagacctgggtttgggttcaagttcaaatcacactttgtgtgacctgggcaagtcactttatctttcttgccaggggttccttatctgctcagtaagggggtaggactccctaatctctaggactccttgcattccataaattcagtgaataccaaataaagccatttagtctctctgatctctggtgctcatctgtactgtagcactcctgataccttctttagtcactgagagactcagtgagagtgaaagtgtttggtagactgtgacaggctatgcaaatataggagttgatccttactattaagagctttaaccctgagtaatacgccttgctgtatgtgcattggtgcaggggctttttccacattttgttgtctttgcctactcctcactgagctgggtggatccaccttaacaaggtgtaggggaacacgagcagaggatgggggtacactactgatggtgggaaagcatcttattggttaatagtggtacatcccaaacaccaattactgtcactgcttctaaggctgatatatttatcaggatgagttacaaggaaatatatgtacccagtgagcgagaatgctgcatggtcaccccctgtgatgtaaaatatgagaatctaggaggggctgttttataattcatcaggttccgctagtgagttctgtcagagtcttagttataaaggcaagtgtgaaccggacagcagacaggagaacctggcaccaaggagacggagaagctgcctttggtgcctcctgcctcctccctgctttgttccaataattttgtgctcggtaagttcctggctttgcagctaatcgttgttgttgaataagcttggcaaacgtacccatagtttggaataggcacttgctgtcagaagtgtgtgtcagtgtttgggctcctgacaaattccacaatttccttttaacgagcaaaatagcttaaaagatgaaagaaaagccgatgaatcaattattcaccttgatccttggaaggctgctttctttggttgctaaagtttctcaggtttcattctatcagtttcatttgttgggtgagctttgaaaaaaacaagtctctttgtcacgaaattgtttttcttagctgccaaaaggaggtatgtacagggtggtttgtccatccccaccccactaattcactctcctcagcaatcggcaaatcttaaaacagactgtttgcctggtaaccagctccaactgagctgaacctgtgcaaggcaagattcaaattgcaatcttttgtgtgaacagaacagaggggctgtgaataattggcattgtggcgattattgtgaaactcagtatggtggtagtcctgcgttttgccgggatgggatcagaatccaatgagatttgcatttggcgtgcctgttgatgatgtgggagagggagtgaaagaaaagactagatcgttatggaaagagctgtacgacgtacccgcaggacggacaaatgcagaaggcatgactgttgtatttgcatgacttgtggctggctgttttctctagtttcattatcaccattaacaattacctgaagctgcattttggtctcatttgggtgggctccgggtatttgctccaggtcctagctccaggcgggatgcgtgctaactcctggtcagctaactataggaagtcatttcctcttcagaaggaaagagaagtgaaagctgtaccttcttagactctctgctgtgttgttttgcctctgtccaaatctcatggaaaccgacagcttgacgtacttttttttgcaatagcagatttaactctggtgtcatatggcatattatatatggagaggagtagcaaggacatttttttcaaatgtttcaagtgtgtctagcttgttgacatttgctttatttcactggcaagtagctactgtcttctaaacccataattgtttgtccaaagtgtttacctgtacactattgtaatttctctttacatgtagaatctgtagatgtgacaaatgtcctctttaacctcaaagaaagcaactcattttagcatctctttgaaaaaaatgtatgcatttttttcaccaaagacttagcttactcattgctttattttttgcataaatattttggttatcggcaccaccacacttccaataaagttatttctcctttcttagtatactttctgattataccaaaaacttggcagatttgaaaatggaatatatattttttcaggaacacttttttgttcatgcttcttttgtccataaatagcttttccatattttccgtttctctgaataagttctgcttaaagagcagaggagtgatgtattgtggttggcacttaggggtgtgtaacctgagacttggtttctaatccacaagcggctgccccacaaggggtctgtaaaatgtcttatgtttggctcaaagcttctggatagagcaataatgattaagataggagattcagcaaatcatcacagatacaaatgaacatctgtgtttgatgctccagccagcctatgacattttttaaagcttaggtcacacagctgaagggtcctaaaagtgttaatataccttaatgccaagaacaaggtagtttatttgttgtaaagtacctttgagctgcactgtacattaaattttttaaaattacacgccacactccacggtttattttacagcagtatctgggttttgattcagtgtggttttatggaaaaataaacctatgtaccaatctcaacaaactgaatttcttctcatttggtggtggtttttctattttctccacccacccgtgatgaactctatttatagcaacaaaagaaaatttagtatgagttattcccaattaaatttacagcaaggcaaatataagctgtgacaagaaccctcttacaggacacatacacacaaaaccatgtctctcaaaacaggattaaaagcgaaagaggcaaatgttaattttgcctacgtgacacatataatttcctttgagagggtagggaaggtggcaaaaaggacaggtttaaaggtgctgttcaaagacctggctcagcaaggtgtaaatggaaagggcaggggttctgtgtccccaaccaagtattattgtctgcacctcacactctttatctgtaaaatggaggaggggaaaattaggagaattaaaccaaattgatgatgtaggtaaagcaaatagtatactgtttagcacaaagtgatgcccaatgaaaggtaattattattgttgtaaattgtattttgtcaaatactttaactcattttgatagatgttgattttgaaagaaattggcatggtaaacaggaagattatacaattttttaaattaaccagatagacttcttataactagatcattttgtgtttttgtttttattttggaaacttagtaaaaacagggttattacctttctgttcacttttaactaattcctaggatagtatccaaaatccttacataattattcaaagaatacattttatttcaaatagagaacatggaaataaactgatgccaaataacatatcatagctttccacgttatttgccaaataacaactaggccagaattccagccctaacattgtattaaaatacctgacaatactagtaaatatagtttatgatgtcccaggcactgtgctaatggtttgacaagcattttctcatttaatcctcctcactaccctaccaggtagatcctattttgctttccgttatcaaatgaggaattgataaagaaaattttgtttaaatatactactaatgtaaattggcatatagcagtgctaggatttaaacccacgcctgtctgatttcaggatccacacgatgaccaacatgttggaagtatgcaatagagtttgcccagctcttcacacttccattttgggatcttggccccatatctgctttgattcctctcctcatatgtttaatccctctcagagtttagggaatattttaaaaatgaagttggggatttccttgctctcacttttggtctatgccagttaagatcacattttcctgagccatctctcctatttttaccgaagtataaaatttgatataaaaaatgaaacataaaaagttcgtaaatctaccaaattcaaggcaagctctgaaagttaccctaaatcagtaccaccctttgaactgagcaaatttccccatatctgtggctttagaggaggctgtaggccaagaggatgggctcacttagatcttgctctctgtcccttctggatcacattcagggtaaataggacccaataattttttccccaaacattcctaagctcactttcaagaggtgtatgatgtgcctccccaacccgttgcccctgagtctgaggggaaaccaagagccttctatttgcatgagggtaggaaatagggcaagggatggatgctgttaatcactgcttgcactcatgagctgagatgtccacacatctgcatgaaaggtcttttgtagtgcaggaagaaactatgaaaaagaagaagggctagcccaggactgggagcttctgcttatgttcttgttctgggtcccaaaaatatgagtcagcctaccttgagttgcagaacatttacttctatttcagagtagtaaactaaaattccactgcgttggttttgtggggcttttgtctgtttttgcttttgacttttttcctccattaacccaaaagaaatcatttgaagaaggaagtggtcaaaacaatgatgatctcaggttcaagggaagacattggcttttctagttcagagggcatagtcttactttggaaagcaattttaggattggctggattaaaactgtctgccatttgtcttttagggcacttgaaaacagttgcttggagagaccctagctaatttcaggtgtattttccttatctctagttttaaattgcaattgtaacacttagagctgaggactaatagaaagctgcctgaagcatccaagtggaaccctgcctcacaggggaggttccgcctgtaggaagagtcaagtcaaagcagagatggctatcaatgtctttgtgtggccttatgccattactacagccccttctgtttagtgcatcattctcccaatagttccttttcatcttatgtcacattggagacaaagaccctcctaaggagaattaacagccaggagttctaagcaacaaatctttttgtaattactaagaaatttgaggtttgggggattttgtttttgttttttaatgaaatgaaagctattatgcaattaacatgaatgattttttccttttatttttatttcttttagtattattttcacaaagtagttttctaggtgggaagacagaatgcattgttggaagtattccctactactaaaccttgcaactttgctttccttagctataaagcaggtatagcaattcctgtctcaggaagttgggaagatgtaaatgagataactttatttcccagtattagctatgctctcctccatatgaaagtatctggcacagtaaatacttaacgcatagtatgcctacattaagtgtttacccaatctgaaaatacagcagttaaattgatgactctgtgaagactaatgggtgccatatttattttgcctggaagagttggtagtagggatggtgcaaagaggtaacaaacaaacaaaagcaagacaaagcatgcctttagtggtagtatctccattttatttttagtttcttctttatgttttatttatcatttgaacttttaataaacatgaatcattcatatgattataagaaaagggaaaacacacttttaggaaattaggggagaaaatagctgttagtatattgtgaacatctaactctgaaagagtcaagccaaatatcaaaaaaaatgcaaaatacttgggaaagccatgtgttctagtcagaataatccagattaccttgctttgttcggtcgttttctagttcatttgtctattattagttatttattaagcatggaccacgtgccaagtgctctgctgggtgatgagataacaaagatgaaatattttaatctttgaactcgaggagtttataatccaagggacatggataaatgggcccttagttgcaagtgtgattccttctcagccatgacagtaacagataaggctgctttccattgtaagtagtgccaagcttgcaaaacaaagtagttttctaggtggaaaggcagaatgcattgttggaagtattccctactactaaaccttgcacccttgctttcctttgctataaagcagacatagcaattcctgtctcacaggcggttgggaagatataaatgagataagtttatttcccagtataagctatgctctcatgcatatgaaagtatctggcacagtaaatacttaacacatagtatgcctacattaagtgcccacccagtctgaaaatacagcagttaaactgatgactcaaactgacttgctcaacaaagggaatatatactcatagtggtgattataacttaaaagtacatcagtaaagctagcttcaagagatctgatcctgtagctcagctcacaatattgttaagaaatcccttttggtcctgccacactgcctgtctttgtgttagcttcataccaagactaattgccctcatggccccaggacagttgccagtgactcctagacaacttgttttcatagtcacatccagctagaaagagatcctggcaatgattcctagaattcactttgaagagactggcttatatccacccctgaacatgagaccaaatctccagccccattctaaagcttaggtaggataaagacagtctccccaggacattatgagtccttaactgaaatttggcagctgttgctgttaggatgggatggtggtggggaaggatgctggaaaagcatccagcagccatctataacttgtgaaatgtacaatacataatgtacaaatgtctactagagttagtacataacataatggaatgaaggccaagcatatgatggtgcatgtccttaaattggcttccaggaagagtaggagtttgctaggggagaagaaagaaggaaaggatttgaggtagagaaaaatgctctttgcagtcacaaaagctaatgaagtaattgttcaactcgttgcctatctttacgttggcactattgcagaaatcaccagacagccagaagccatgtgcccagtagaataaggaacagaaaacctaaagtatcagtctcacaaaaatttgttgttgaaaaatgaccgttgaattataagctaaaccacagtcaaatgttctgattctttacaatgtggatacagatttggagtcaatcaatgtgaactttaaaatatatgttaccaggctcaagaattattgtattttgaacaaaatcatcatcatcttcttcttctcctttttacttctgattaaacctgctcagagaagattaatgacttatgcagtaactcaagtgtatttggattttgatatcatgatgtttgtgatactaaaaaatatgataagacaaataagaatatatttttgtacatgtgtttgctaattgtatggtgtatatcactttgcgaatgagacatagagtaaaatatttgttaacaaaatgtcaatgcttcaaagaaaaattagacttcactctgatttctggataattcaaagtttatataatttataagttcttcagcctttggcaataatcatttctttccactgaggaagtagaatagttccttcattaagattgtacttaatgggcttggtaatagttttccgctaaaatttctgactccaaatttaattaactacactttggattgtttttccacttttacagcatagaagaggaagtgacaaaactgttatttactttctatcacaagcgtgatcatacagttcacaattttctggcatccaaatgcaatgataaaacattcttttttcactcatgaagcttgtctcagtgctgtcaatccacctacctggtgggtatgctcctaaatattcatttttctatctagcttctttccaaagaacagacaataatagcaataaacagaatcaaagtatatttcttcttgcctcttgcttctggtgtataaaatctgttcataaaacctgcatccaggcatgagtaagtgctcccagcctagctgtgtcactgaggagcccaagacttctgttttcactcagaaaacatgcttgagtcagagaagggtgcagtgaccaggtaggaaatgcttcccagggcactggcttcttcctcttcagattagacagttcttcagtgcagagaaagaagcaactaaaaatagtggaagggtgacagataatgtttatttaaaagcacatatgtcatatgtcatataagcattaaaaggtaccattattactatggcataacttcatttccccatagcacaaaccagataaaatcttctttgtcttgttttgtggcttccttgtacaaatagagaaactgttccttggatgaatttcttaccttatcagtaagtgtgttgagttcctgacaaatagaggatgccaaagaagtatcaaagatgccagcactaatattctggctgcaggcagtgcttctgcttcttaaaatattgaaatatattcttgttagtaaagagcttctaccctgggcccgctgagtgctcctctacaagctgcttcacactggaacccctgaatcccttccctaggactctcacacatctccatgattgagcaactaaagcattaatacctggcacagctagttgtaaatattttgacatcacttctatgtaatactcatcttatttttaaagaacttacggctacaattagggagaataacatttagacacagaaacaatgtgtaactaagtattaagatgtttaaggcagccatgtatgagtttttaaaaagtggtaaaggagatatttgaggttgtctggaaagacaggtcagggatttggatagggcagaggtaaaggagtaaaagacaatggcagaatgtacaatttttaaaattcatttacttaacaaataataacaaaattctccatttgtttactgctgctgtgtgcaaagcactgaatacatgttatctcatttacttctcacagtagcactataaaaatagaggagaaaatgaggcttgttcacacagttggaaagtagcaggacagcacatatgatacccaccatttcccacaatgttcaagacactgtattaggtgctggcatggtgaatatgaagatgtatctttctacttgtaagggccagtagcaaacccaaggaaatattggcagccccttaatcgaacaaaaaagtgctagtgggccttctaccatcaacaacctcattttaaaatattacaggataatgcattattgtcttgcttgcttcagttgccccactagcaacataaagagtaaaatgtgagccatagggtactagctaaactcattataatttgattatctgatcttccaacattagtcttctcatgaccttttcataacataggacgttagaaaaagcaataaaacacagtcaaaatgtttagcctattgacaaagtgttgctttccatctttaaatggaaactgaaagagcgagcctatttattaatgattctgtggcaaatattgcttttttaaaaaactctccagttatgccctgcacaacaatgagcatgtgtttgtcatgactaaaaattatatggacaaatatatgtttttagtccaaaacataggcattgcctcatttcttactaaaatacctcacagagagttttttttgtttgttttgttttgctttgttttgtttttgagacagccttgctatgtcgtccaggttggagtgagtgcagtggcgctatcttggctcactgcaacctccgactcccgggttcaagtgattctcctgcctcagcctcccgagtagctaggactacaggtgtgtgccactacatccagctaatttttttgcatttttagtagagacgggtttcaccatgttggtcaggctggtctcacactcctgacctcgtgattcacccgcctcggcctcccaaagtgctgggattacaggcgtgagccaccgcatccagcctgagagtttcttgaagacagggatttgatttcattcatccctatatgcctagcatctcacatgatgcctcaacacaaacacaccaaaaatactggttgataaatgccagctgatacatccttcaaaggaggatggagacaacatgagatagaaaaggtggggaagaatttctgaagctgaactagaagatgatacaggaatttactagatatatagagaagagtattgttaggagtacactgagcaatcttcccaaaataagtaagtatgctcacagagtttgcatgtttaagaaaatcaaggaggccgggcacggtggctcacacctgcaatctcagcactttgggaggccaaggtgggcggatcacctgaggtcaggagtttgagaccagcctgaccaacatggagaaaccctgtatctactaaaagtacaaaattagccgggcgtggtgcctgtagtcccaaccacttgggaggctgaggcaggagaatcacttgaacccgggaggcagaggttgcggtgagctgagatggcaccattgcagtagcctgggcaacaagagcgaaattccatcaaaaagaagaagaaaaagaaagaaagaaggggaagaaagggaaggaagggaaggaaaggaaagaagggaaggaagggaaatcaaggaaggcctcaatgtttctacaacatttttttctcctggtgtcccatttctctagatttccttccttactcccttcccctttatttgtcttaccctccattcattctttaaaactcaggcttcttcaataaataattggcaaagaaaaaagagacataggggaaacacttaaaagtaacaaattgtaagcaatgaacatttgtgtatttcaattcaaacaaaacataaatggtaaaacaagtcatgacaatgagacaattggagatttggacatcaattatatatgtggtgaaaagttattggtaatatttgagatgtgacaattgtattgtgcttatattaaaaacaagcacccttatcttttagagctacacgctgacataggcatggatgaaattatttgcctcaaaataatacaagagagggaaagggagtagggatattgatgaaacaaaaaataaataagcattatttatttattgattaattgtccttctgaaagatgtttctcttcccttcctccccaccagttgggtctttcttgctatatcccaaatactcacagcttatttctttaactacatttatcttattatatgataattatctgttttggtggatcttatcaccagagggagctcattagtaaggacagatttttctttgtccttccattgactgctcataggaggggctcaatagtattgggtagaaggatgaaaagataaatgaatcgatacagactctacatcaggatgtgtgattcaagcagtgtgggttcacgttgatttcccctacattcatctaattcttaagaaataaatctcaatttatgttctatataccacacagcatttgctcacaacggaaagccataaatgcagcactctaattaaaactagataattcacacattttcatttaatattaatagaataccacgttgcagggccatgttcttaattaggataagatagcattgtaccaaacccatttagttgtcatagtgataaggaagatataaaggaaaacattttccttgtgtttaaaatttttaaaaattaaattagggttatttgaatctactttttaaatataatatgtacaaagaaatgtacgtgtacacagaaatacatacatctatatatgtattcatgaagatggagtacaccttccatgagacacagcagcctagaatgtttctttatagaaacaaaagtttgcctcctttttatttttaaggagaatattttaatcaaatcacttcatagtagtatactattattggaaatatcaatttacttagattcccttctaatgttaacatgtacatgcccaaaaatttgcctgagaaagaatttgggaatatatctgtccttcagagttcttagttacccacccaggagcaatgcaatgagataaatttattaaaacattcatgatgttcccaagagaacctgtttagcagaccagatggaattgctgggtttttttgtgttttggtttttttttttaaagaaatgtcttcatctatgacaacacaatgaattttcttacatcttaaaatttcatgaatatgtgcttgtgagtgagcccaaaggtattcattttcttctgtggtagagataaaattcctgatattaaattgcaaataaggacaatgtataccaaaacctatcatggtgaccaagaagtattgagactccatatatagagtcaccagtgatgggttttttttttctgtatgtccagaacctagccttggcctgaaacctgtgggtgcttggtagatgtttgttgacattttttcctgctttcaccttctcctgggaaccttgtcacctaccaccacaagcatccactctatttgtaacacgtagaagaagcctggaaatgataaaagcacattaactggagaaaagtctacagagtttggcaagactcttgagaaatgcagaggtgaactagacatctgtttactcctaatcctcatggaactcactggaatatttatgatgcctgtcctcagctggataagctggttgagttaggtagatgtgatattgcacccaccacagtatacatcactgctctgagagctaagagaccaaagaatttaaagcatagctataagattaaaattattttcagataatcatcttttcaccatttgggtcaagatttggttttaaactatctttccctcttaaatccatagctcttcctttggcttgtcctaacgaggaactgcataattgcaagtgtttgctctttcatttattcagttatctagaaagtattcatttagtgcttactttatgtttagcactgttctgggtgcagagaaatacatgatagcttttcatgtttgtttgtcttaaattttttcctttgtttttcagggttggaaaagttgtctgttcctctttatttcagggcataaacacccttgtggtcccttcaaaatagagtcaaaacatagcaatcaacatgaaaatagttaaacttgaaaatcataggccattatattaagggtacaaattatgcttcgtttttaattaagtggacctaagtttgaaaggtcaagggatccttctgtttataagagggttgtattcttttgtgagccttaattgtgtattgcatatctataatatatgtatacattggcatagaaatgtacatgtagacagaaatacatacatctatatatgtattcatgaagatggagtacaccttccatgagacacagcagcctagaatgtttctttatagacttttcagcagaaacatactcagtatcaatttgcttttatatgtggccttctgaattgaaaagttattgctagaggtgcgaatattattttgcagtaaattaataggaatgagtaatttgaaagagtgtgagtagggagagggggttcatgaggagagggaccaggactgttttacccactactgtattcctgggacctaacataatactctgcctggcacacagtagcaggggttcagtgaataaacagatcaattagtacaagctcaggattgggaaaatattccaatagagcattttgatgggccaggaaattctttggccataaaataaagaagaaatttttgctgcctgtagatttcattaaactcagcaaacatgtattgccttctgagttttaccagggactagtaatttggtgctgagcgaataactgttcctgggctttagaagctcatagtctatcataaaaaaaaaatatatatatatatatatgtgtgtgtgtgtttatatacacatatatatgtttatatacacatatatatgtgtgtttatatacacatatatatgtgtgtttatatacacatatatatgtgtgtttatatacacatatatatgtgtttatatacacatatatatgtgtttatatacacatatatatacacatacatatatacttatacatatatacatacacatgtgtgtatatatacatgtgtgtgtgtatatatagtttttcttccattttattgtaatttaaattacagtaatagcatatgagtacaattatattactgttaaaaaagtacagaggtaacccagagaaaacagtgattacctctacttagtagggctaagaaaaacttctctgaatgtctttgcagtattttaaagaaccaaggctatcccaggtagaatgagcagcctatacaaaagtatggagctatgaaacagcaagatgtgtcctgggactgatagctttttgttcttaagctataaaatgtgttgtctttgcagagaagagtggtagatgagcctggagaggaagaattgaaaatagattttcttggcaaattgacaactggatatttttatgcatcagtctgaaagccctccattctaccttgtttctacataaatctgaccctgcttcaatatccaccacgtctgtgatgccagacatagccattgcttccatgaacatcagcctgagtgccctcattttgtttgtttggtttctttgtttttgtttctgctttttttttttttttttttttacttcatttccccagaaaattgcaaagtgactggcagccaggggccgtcatttccctcttcctttaatttcttttttttttttttttttttttgagacggagtctcactctgtcgcccgggctggactgcagtggcacggtctcggctcactgcactctgcctcccgggttcatgccattctcctgcctcagcctcccgagtagctgggactacaggcgcctgccaccatgcccagctaatttttgtatttttagtacagacggggtttcaccgtgttagctaggatggtctcaatctcctgacctcgtgatccgcccgcctcggcctcccaaagtgctgggattacaggcatgagccactgcgcccggcctcttcctttaatttctgtacatgattagtagcaagacctagaccaactagaaggaagttagccacctctgaagagaacatcactaatttccttagcatggctttctgaattgaaaaggagtttgaacaagctggctgcatttttggaccaactaccgtgctgagacctttatattcaggtaatgagtatttgtgaagctcacatgaaattcctcctttaagactagaaaacaaaagttcaatccaaaccttgggatcggcagaaataaaaacagaattgtttacaagtgaatgagaaaatctattaacatcatgccagctgcatattcaccaccctccaggaatgcatgtcaatctgaatgtcatatccttagacagctataataagcgtaggtaggacagagtttgcttatcaccattaaatggtaataagtccatttcaaagggcaaatgaatgaaaaatgcacttgaaaactcattggatacactaagaaaaggttatctaaacttcattgtagacagaagacaaaagcatattttaagaaattcttccttaaaataaatatcctttattcatatttttatatatttcattgtcttggcttatgtctatgaatagatacaactttaattattcaaaggcaaacatgcctaaggaaagataaagcgttgaccgtatatcgcagtttgcccaggccagttccggtgtatgcctgggtttggaagaagatcacagactcaaggcaaatggggctggaatgagagtatggtgttgtttaagatctgttggagagggaatgaaagggactccattctttctctgtatttagaggttggatgagaactagcacagaaggccaaagcccaggctttgaattttgcccccttcacttaccagcattgtgactttgggcaagtcatgggacctctcttgggtatcagttcttttcaactcatggtggagtcttgtgcttggtacaaggatcactttattagatagttataattaagctgtttcaagaggtaaccacgtagggaacaaaagtctggaaatcttactggataaaatgagttaaagcagtggtccccaactttttggcaccaggaactggttttgtggaagacaatgtttccacggatggggtgggtaaggggaatggttttgggattaaactattccatctcagatcatcagtcatcgggcattagattctcacaagaagcagcaacctagatccctcacatgtgtagttcacaataggctttgcactcctctgagaatctaatgaaaccacagatctgacaggaggtggagctcaggcagcaatgctcactcacccaccactcacctcctgctgtgcggcccagttcctgcaggccatggacacctaccagtctgcggactgggggttggggacctctgagttaaagaaaccacggctgcctagcttcaagggataagaacaacaaatacaataacattcaaatacaagacagcctttaaagagataagagattataaatttattttataactgcaaagggcagaagtagatctcatgtggtggaatgaaaatagttctgtataaaaaactattgaataatgagatatatctagcaaatggaaggggctaatcttgaaaataatgctagtgaagacaggaagcagagaacttgacattcatgtttgtaaaaaaaaatcatgggggagatagtgggtcaagttggagggggcctgagaaaaattcccgtggaatgtgatagtcctttatttatcttccaattcccatgcacccttgtatatatcacttcttcgtgtttttgactcctaactgctacagctgatagagaattccaatctcatgctcctattgtaacgcattccccgttctctaaaaaaaaaaatctcaagaatctccaaagtggtagtagaaattattcatttttccttagacgagttgcctagtggttgacaaggggcacgtctgatctgcctttcttttctctagaacatacggaatggtttgaatatttattattgtagttaaagtaacatttaaaaagataaaagaaaatggtaagctctatagtcttgaaattctctccgatctctcttcctttgagcttgcttaacccttgaatcacaatatctgttgaatccctcaggtcatccctgcagagggagagtacataagagataatctaatatttagaaagtataacccccatttgtactctatattgctctatgctgtgacactatgttgtagttgactgtttgctggtttaactcttatagcataacgtaaagcccttatgaccagatgatgtgccttattcactgtcgtatctccattgcctagcacactacttgacataagaaggcaacccatgcatagttgaagaataaaagacagcccattgcttctctcctagaactaactctaccagcctcttctatgcaagattccccctcacaccccagttctattttacggtagcttggcacctctttctaaggcttcttaagccttctctctttcaagctgagtaccagtcatctcttacaggcacacacttcatttttccacacatctaaagtttcaaggcattctatttatttctttcttccctaacaatactttaatattggttgattaatcaagtgctacatttctatttattgagcacttgctatagtcaaacactctgctagatactgagaaattttcagccatgcaaaaaaatgtggtctctgtcctcaaactctagttgaggtttaagatacataagtagaatgaaaaaactcatagtgtcttccaggactcagttaaatgctaaataaatgttagtgctggcttcatgagctttcagaagaggacctttccagaatgagaaacttggaatctttaggaagcacatagacatcagttagcttttcaaaggtaaaatgaacctggatcataagttagacacacagacattttaaggaagggtgatgcactctttaaccttatgcttttaactcaacaaatattcattgagcatctgctgtatcccaagcaccaagctagagactagtactgtgagttttctgaagtcaagtgtggtttcgttttccctcatttaattccaaaccatccatgacctcattcattcctgcagctttaactactacctcccagtgtacaaaagccacccaactctacctgtccacccctcagattctttcagtaagtcaaatcttggttcccatttaaaaaaaaaaaaaagtgaggtttgacgattctgctctacccactctctaccagccattcccactcccctccacccaaaggcatcagacaccgcgaagcttacaaaatatgcagacatttaattccttgcaactacataacctctctagtaaaaaacatgcttttaagtattccttcacaccactgctgcctatttgggactggagagccttgttggcttatgtggaccagcctgcaggatgacagcctatgtgtcaacagactcttggtgttagtgaagacaatactattttcattcactgaatccataacatgggccaggagaactagatgctttctgtctacaatagcttatccttacagtaagctctgtaagagagctatcatctctaccattatataaatgaaaaaacaggtcacagaaacagctcgcccaatgtttcacgtctagtaagtatcaggaatcaggatgaaaacccagatcagtttgattccaaatgtgacactctttttaatacattacaatgaaggcagattaatagttttcagtgcctcaatcttatttggaatgtagggatggatggattcttatttctatctgcctcggaattacaatgcccttgacaactgaggcttccaaggaaaatcaacagccttatgtcagtatctaggaacctctgaggtattcttactttgctgaactataggagggaaccaggcattaaggataatagtattaccaacccacagatggcttatggcccaggtgacccctgagtcagagcatacaatctgcaaaggaatgtctggcggaacaaaaccagtgaactttcattcatttattcattcagttaatacttggcaagcttctactatgtgccacacacacattgtatctgcaatgacgctgcagatacaatgtatgtttttaacagggtgtcttgccagacctaatacatatttaataaaccacttgtcttgggaatgaatgtcctttgcctatgtatagagaggttttcagctgcaatggtgctctggcaggaggagaaatacaaacaactcttaacctctgagataagattttgacagcaacgtggtatattatacccactgtgagcagtccttgaatggaaaaagcaaaagcacattgggaattagacagtccagggctctactctcagatctgacatttaatactttgctgtataatcttaaattattttgtctctaggagcctcaattccacaactgtaaggcagggataataatgcccactgaatgggttgtttactcaattatttaacatatatttattgaacattaaattagtcaggaaaatagatagcacctttattattttaagcagaaagcaatgtaattcagggtaataatgtgcttagaaattgtttgaagactgctagttaggaatggaggcagctacaaccaaatcaggtaacctcaggaagccgtttcctgagccacagtttgttccagccctgaagctagagaccaacagtggactgtggagtctgaggaaactgtaagatactgtagcagtgctgagagccacaaaatcctgtgatcctgtgccagtctgctacttgcctttaacatcctggaacttaacagaagttactgtggttgagagaatctaaactgcaattctactgacaaaaggttctgagcatatagttctcgggcttcctgatcttgtaatacagtgggaagcatggtggtggcagagttaaggaacagtgcagaggaccagtagcaagagccagaacaggcacctcctatgtgccaggaacagttctgagagtacagggataaatagaagagacaaatattctcatgtggatcacatttaattgttggagattcattgagttaatgtattgatgcattccatagagccagaattatagcaggttccttagaagtatttgttcccttttttaaagttctatatattggcccaagagaatataacactccgcctcctctccatgagatttctgacaaggtaaataattctgagattagagagagaagagctgggggtcgtgtctttggggccaaatagtgaggtttcaatacagtgcttgctttttgcagatagagccattttcaatctgtattgactttgaaagacatttggacctgcctcagagcatgtattctttccatagataattcaggccatctttgagtctggggtgaaagctgttttgagcactgcagatgcccttgtcattattccaagctgtgggctacagtgggtagacatgaactttggagtcaaacaaatctggctgtcctagtagagtcataagtggcaaagtactttctttctgctgctgtttccttaccaaaaaaattggtatttaaggtagaccatctttgaagacatttttcaatacatgtgtatattaaatgcactccaagtatattaaaatacaaatgtcctatagagatacaaacattgcctcttcacagtaggcatgaggatgagagatgaacatgtcagggcatgtgttaatgttgtcatttacatgaatgattcattcgctctgtcctgatgctttgtcagtcaccttcatatctgcccccaataggaggtcactatgtcttgatttctgtcttgagtcggaagtgtaaggtgtagcggatttacttgaatccagcattgagggagccttgcagtgccctttggagtccagggtaaaagctgtcttgagcactgcagtagcccttgtccttattccaagccgtgggtcacagcaggtggacatgagctttggagtcatacaaatctggctctactattagagtcataagtggcaaagtactttctttctgttgctgtttctaaccaaaaaaaaattaatattataaaatctaacttgctgtagcagcatgaggattaaatgagacaaaatatatattatctggcacatagtaggtgctccacacacgttaatttgtttacccactaataatatattgttgtagatatttcctttgttatttcaatttattttttatctgaaaaatgataggaatagtagatgctttttacatgggcatcctatgcagagtttgtctccataacaactatataaatagttattatgaatagttatctgaataataattatattctcatctaatagatcctgaatttaagcacaagagaggttgaataactcacccaagatcattgcactaattcagagttataggtggaatttaaatgcaaatgctttttccccagagccagcacatcccccacagcacaaggttgtctcccactaacctcgggcaaagcaggagaactggtatatttggtgtttgaattttctgttactacaagcagagcaagcaaagggcatcatgcaaagaacatgatgactggaatcttaaaaacacatctttgttgtagagtaatatcagtctgcagggttgttgttcacaaaacttagtataatctccaacactaagcaggtgcttgatatagggttgtggatattattattatggggggagtcagaagaagaagtgtacatatggggagagatgagatgagggacagaaggagggagaccaagatgggaggagggagagaggtcaaatagtacaattttatcaactttctgtttatctttccatcacttttttccatcagccacccccttatgtacctcaagtctttctccttctgtctatactgccttgataatttttatttatgtcaccttacatgttagtgtgtgactttatctatagtcacatgggcagtgttaccaaggtgacgtattatatcatatgtgcttcttgtagaaaatggctataggtaagtgtcctaaacattgttaaagaaacatgggaccatccataaaaatatatgcacataccacccctggaggtagcagctactggactcaggctgatggtggctgcgcaggaatgggggttcagtggcatcaaacttttcactttttgggtagccaccaatgtggattttgttgtaaaatttttaatttttaaatgttaacccttgattcatatttctgaagacactgtgaaataaaagggaacataattgtgggtcacatatggttggcagtctgctgacttatgacctcttccatagcgtctctgtcacagaatctttcagattacatgttattacatgttattgtttctgtgtattcttcccactgggctaagagctcctaagggctaggttatgtcttatttttcaaaaatcagagacacagtagatgctcaaaagaaaaaaaataacaaaaacctatccttttgcacattttctttttcttaaagtatgaccctctatttaccctccagaacaatcttttcgtatcttagtcttctcagctatacaacgtttatttgtaaagttctagtcgtcagaagtcacagtgcttaagcagatattccagtctgggacagaacctccaatttaggattcagcaaataatagcattgagataggcactctgagggccacaaaatgaaaagaatgacatgaccccttaaacacttgataatcaaatgggctgtattttagaaacaattacataacaatacaatttagtacaagatcaatacaatataatacaatacagtttagtatgcaaatgggaattcaggaagggcgtgttcttatagtgtgtggattaaagggcaggctctggaggcagactgtctcctaccaaatcccagctcagctgcttacttagcctttctgctttccagcttccttgtctatatcatgagagtaatccctacaccaccagggttgcacacaaagaaaggcagagccccattgacatgttagcctggatgaataagattgtaagaaaaccttacaggccaaacctattggcctgccaggtgagtagccttataggacctgggggaaataatcacccaagttttccagaatttgactgaaagattcaggagtaaagaagggtaaaggagtaagcaaaaagagatggagtgcaattgtatgctttatgtatgggcagagaggattatttggactcctgcagatgctctggtctgggtgtggtccaagaatgctgtctctctctccctcaatctctctctctctctgttttattaactattaactaatccccgtgtgtctcagtttcttcatctgtaaaatgggataacagtacctaccttatagacttgttaaatgagttaacacaggtaaagttcttagaacatttgatgacaaaagtaaatgcttaaaatatgttggccattataatgactgttatcccataatcattgttgtattccttatgtgtatcagaaactacgacaggcactgagatatggaagtacagaatattatgggcagccaaggcaatacaagacagtaagtgagagtaccatatctggacaggaggacctggtttcagatctgggattcttcatttagtttccacctaagtaacctggagcaagtgtctacttctgtaaactgggtgatgctactacacaccacaggattgttgggagaacaactgagataaattgctacatatggcattcagtatagctcctggtacattgtaaatgctcaatactagaaagagtgatgaaaccactagagaagtggtaaacttctttaaggtgcttaaaatgcagaaaactgaagagtatatgcaattccagggctttccaaaagataagctatttttccaagttcattgttacattgctcaagcagtgttttcaagtactagagcagactgtgaataggaaggtgggtcatgctgggcaaaagtgaattttactaagctaaaagcacttattgtttcaagcatgaaaattcattgcaaatcatttcgcttataaaaaaatgaaagtcaaatggtgtcagttacaattgcaaaatatactttagctactaagaataactgtttattatcattgtcattctgtgaagcagagaacagacttaacctttgatctctttgctgacagttggatataattaacataattatggtttggactgatcatttttggcaagaatttttcttctctcatctatctgttggagatttagattattacagtaaagaagcactttttggaaataataaagtctctatatatttgtttccatccttcttaagaaaacaagaacataaaaatgtaatttttcaaaaagcccattagatatagaaagtatcaagtttaaaatctcttaggaattcactataagcaaataagaatcagggaacattatgaggctggagtaaaattaaaagatagtaatagaagtagctaatattgtgggggcacttcctgctaagtgttttccagaatttagctctggtatgcccataaccatgcagccaagactggtttggctattatccttattccacagaggtcacacagcagagccatgtcttccttcctctgcagccatgtcttctttgatatgtgtgtgctcatgaaagaaatctgagtctattttttataggcaactattggtgttctcttggcccaatgctttggtagcaagaagattgttaagaatagacaatataggctgggcgcggtggctcacgcctgtaatcccagcactttgggaggccaaggcgggcggatcacgaggtcaggagattgagaccatcctggctaatgcggtgaaaccccgtctctactaaaaatacaaaaaaaattagccaggcatggtggcgggtgcctgtagtcccagctactcgggaggctgaggcaggagaatggcgtgaacccgggaggcagatcttgcagtgagccgagatcgcgccactgcactgcagcctgggtgacagaacgagactccatctcaaaaaaaaaaaaaaaaaaaaaagaatagacaatatataaaagcacggactactggtaaacaacagtataaccaagacaaagtttactgataacatttaccaagtaagtaaataactgatacctttggtttaccatggtgtgagcttggggaaaatgttagtgccagaagtgggattagaaccaaagtctcttagctcctaggctatgtaccaactaatggataccagcctttcatctaagcagtgttaaggcctcactcgtgatttttcacctcactcctgctgatggggttagtgagctagggaaatcaattcaagaggtctgttgttttgttagcccatccaattgactcatgatgccaggcactaggtgtgtttaatacgttttcattggagttgtagcagcaggaaattacagacagaataagacaagttttaatctagatgttataataaagagatatggaaacactgataagagagcaactcttgctgactgaagctttatggaatgttgactagaggaggtggcatttgcactgggtcttggatgactgagtaggatttcaggaggcactcatgggggtaacaaaggccttgtagggagaagacctggaagtatgaaaaacgtgactattggaggttccacctcttggtgggggtggagggaagcaagtggtggaaagggagatgttggcctctgcatcagtgagtgctaagcaaaggggttgacaacctaagcatcatcatcccgtattggtgttgtgtacacttgacttcagtttcacatattaatattttaattcattagtgatatctaaagtacaacaaaatgtagattagcagattgcattgggatcaatgtgtccctttaggaatcaatagagggagagagaggaaatgacttttcttgaagaatgaattggtcatatacttgaagaaaggtaagaataaatacatttccaccgtggaaggaattctgacttgaggaacaacaagttttctatattattcttcctctactcattcttccctccctcctgcttccccaagtgttctactggggaggaaaagtaggcagaggaatgaatgtcaggctcaggaggagaagttctgagtgctaccaggcattctgtctcatctgcagaggctaagattgctggagagaaatctgaccaggacccaccttggagaggaaatgatgggtggaaaggccctgaggctctaagacagttcttgttgcctgcagggattcaaccgggcctggcatcatagtaccctgtagtcactttcatttaagcagattgacactttttgaaaagcgatgtttcattggaatgagattttgttggaaatagattcagtgatgactcttaatgagtgtcaccctgctgactgttcagggttgtgttctgcatgccatctgttaacatttctgagttctctgcaaaaccagcaagtgctgcaagatgttccctgacctgcgtaatctcagacatgttatggccagatgagtggggtgctgaccagggtgcctttgtggcacagcctttcctagaaggctcaagttgcacctgcagaattcctactgcactgtttaggcatctttgaggagatgtcaggacttggattagcacaacttccccagagcactgtgatgccaacagcttacagctgaaacagtaaaacagtatgtgacagcaattcagggaaaagaaatacacattgggggcagtggaataggtccttttggatatgaatttggagaatgaaactttggcaataagaatgggagaggggttggtaggccagggtatatgggtgtggggagctgtttcctgagctattagttggcctaaacactctcaattaaaatttcccttttctttaaaggaatacaatgtaaatgataaaatcaaatatcttcagactttcctcagaatttttattattgcttcttttaaatccatacaagcatgtacatatacacataaactctcagggttacagagaaagtgctactgaggtctgggcaggaaatgggattaatccatctgctcccaagcatgtcccagctgacccaatataagcactctgacaagtgctctccctgaaatttagccttttctaaacagaaaaggctgagtaatattacagtgaagccagtaacaatgtctatatcataatgctcataatctccacaatgattccaatggatattcttcaaaaggctgaataggaaacttccatgttcatgtttattgtctttcattcttttcttcttatactcttttcttcatttattcaataaatatctatttatctagggctgattatgtgctaggcactgaactaggtgttaagattatgtttttaaactgtaatgccctagtctttagtaatgagtcacagagaggccactcattacaatacaactggagagtaaatgccaagatggagaaaagcactggatggatgtgtgggagcacagagggcacctcatttattaagcgtctacttcatgccacctgggcatgaagacaaccattcattctcacatgggctggaatcttacaacaccctgatacagaatgtacagttatttgtgatagttgtttctcttgtcctgcacctggaccagtccccaagacatcttatccatgcccccatctctagatgtcctcaagaagaccacacagccaaattctgggactaaggtcttatcttctaatgaatatgttaattattactagcatgctgtaacctcattcggcaatatcctaagaaaatgctgccatgcattaaataaaattacttcatttctatagacgtatttaagtcgctcatacaagactctctgctggggcattagatgttacagcaatagctaggatgtgtctcctatccttctagagtgtgtcctccagtagaacaagtacacacatagaaccaaaatacatcaaaatgcctgaatgtcataatggagtgctttgtaagtatacaaaaaatgaagtggcttcttttggacctgaggactcaggaagagaaaatggtaattgttctgagtcatgaagatttgttagaatgtcaagacagaagaaccatcattgtaaggggaagaaaaaataaaactaaaaggactatgaatgggaaagtacaaggtatgctctgaaaacacttggtacacttggagtgttatcaggaaggttgtcaggaggggataaaataggaaagcagagggcagatcaaattggcctcgaatgccaggctaattcattcaaggcacattctctgatattattctaatcctaatgtagctccatgacagagtccaaatcatcctttaacttggttggtgaaagttttatcttgtatgggggcaaagaaccagattgggtgagaagtggcaatagcatggaaagaacacaatcactgctttaagaacttccagactggtgggcagccagtcttatccacagaatagaataaattcagcacttcaaaatttaatattcactagttaaaaaaaaaaattcttggccaggcgcggtggctcatgcctgtgatcccagcactttgggaggtagaggcaggcagatcacttgaggtcaggattttgagacgagcatggccaacatgttgaaaccccatctctactaaaaaaaatattagctaggtgtggtggtgcatgcctgtaataccagctactcgggaggctggcacaggagaatctcttgaacctgggaggcagaggttgcaatgagccaagatcgtgccacggcactccagccttggcaacagagcaagactccatctaaaaaaaaaataaaaatctaacttctacctcttaacgtgatttatttttgtgctccttggacatgtgcggtcactttatcaacagacaaaatgtatgtatttcttggggaaaatggccccaaagaaattcttcctgtgatggagatgaagtgattaatactttattggactttatgcatggatatgacatgtacagtgacagttataaatcaaggaattctcaggggcccaaggtgtagcctgcttgcatttacagacaaaataaatttaatttgggaccaagaaaaaatgcatacaaatagtaacgtgcatagaaaagagatttatgctgtttaagagaattatatatggacacaggagacagggaggagggattgttgcttgcatttgaaagacggtctatttgtgaattgtgtcttttatctctggaggagaaaataaataacagcaagggagattcactgcaaatccacttttgtcagccccatggcaggtttcttcagtttgtagttgttacatttagatatgatgcagcccccatggatattaaatcattatgataattgggactatgatagaaaagtcattgtcttctctttgttgttcaggtaatttctcatatttacagtcattttgtgtacatgaatgaagttgcgtacagcattgggaagttattagattggggttccacttctgccaccaacattttctagctgtgtgactgggcatatttcacaactagtgtgagccttagttttcacatatgtacagtggaataagactatcttccacacagagcttttgaaagaattaaaagagagcatatataaaacctagaaggtgtgagctagtaatgtacaacttggtgggatatgaaactcaacaaaaagggtcgaataaggaaacccaaaatataacttattagtcttatcaaagggagatcagcctgaggaggaagtgacaaccacacttatatgacactatacacagaagggctaccctcaggtgtcattaattgtgaatcataccacaatgatattaagacaacacacttaaaaaacacacatctaggctaggcgcagtggctcacacccgtaatcccagcactgtgggaggccagggcaggcagatcatttgaagccaggagtttgagaccagcctggccaacatggtgaaaccccgtctctactaaaaataacaaaaattagccaggtgtggtggtgcacgcctgtaattccagctacttgggaggctttggtgggagaaacgcttgaacccaggaggcggaggttgcagtgagccaagattgcaccactgcactccagcctgggtgacagagcgagactccatctcaaaaacacaaaaacaaaccacacctctgcacttcaaatatacacgtgaggactattcatcttaatcatctctcaaagtgaataattagctttcaaaggttgttcctctcccccttttcaagagcaagcagagaaaaaacagaacaagtgcaggctattgccagatagataccctcctgcatgatctacagtcgctgctttgtggctccaagctggggtccagttgcgctgccaagattccacaccaaaaaaacacaaaataacatcacttacaaaaccttttagcatttgggggcaaacgatgatactacattttaatttatactgagaaaagagcataattttttctcttttctgctgtgaattcaattctctaacagggccaaatttgattagaccaacacaggctgaatttaagtgtgtagatttcaggtgatttgtttcttactttctgcaaaggtgccgatatcacataagatttcaccagggcttcttctagccagaagacatgtcctttgacagccaatgtgaccttcgtagctctgagccaggtagggagcaaatctttcacatgctgtaatcctctaagtgtgttttggaaacaggatttacatgtctccctattagatgctctttacttagaaccaaacagcattataaagtagacttccgagggcattctctttctggttagtaatttaactagaataaattgaatgctctggatgttttcttcctcctcctccaactcctcttctttcttcttcttcaacattgtcaacatcatcagacactgataatacagcaaatctgtgaaagagttatgctaaacactaagttgtcctaaattaactcagaaggtcttgccaaaccctgaatacaaaaaagggcaggaataagtttgttgcaaactaattttcaatttattgtgaagagaatgggcatttattatgagaagaatggacagtttcaccctgtcacccaagctagacccctactttgtacagcttctttacctgtgtcatcttatttatcttcacaatggtcttgtaattgtagttggcattatttccaactcagaaatgttaagtaatttgcccctggtcaccccagcaataggtatgtacttactctctgacattccatctgagatttttttttaacctaaactcagttttcttattcaattcaattgatatttattgagtacctattatgtactaggtacttacttgtactaagagctgagtatacacagtcaaataagacataatgtcttcctccatagagttttaggctggcaggggaaacaggtataataaacataaaagatatgtcataaatgcaaaaatgaatatatatatgaggtatagagtaagtaagatgaagaggggcatgattaatttcatttaaaagagcaaaatcataaaagacttactatcaaattttaaagaaggagaaggagtatgccatgcagataagaataaaggctgcatgttgcagacaggccatttccctgtttgaatagaagctgtcttcagccaatggcatctggagtagaaagtctttcagtcttgaaaggggatctgaggcactatgatatctgaggcaaagaaattttatacacttccttaaatgattattttatagtaagctagaatttgtgtatgaattttgctaatagcctagatgtggaatttttaaagcaagaggaatatgttcacattcaggtggcgtgtttaaagaaaaagaaatttttttcatatctgggaacattggattagtttcctattgctactataataaattactacaaatttagtggcttattacagcacagttctattctcttacagttttggaggccagaagtctgaaatcagtttcactaggctaaagtcaaggtgtgagcaaggctagtcccccgtgaagactctataagaaatccatttctttgtgttttctagcttctctaggccacctatgcttcttggcttgtgacccccttcctcacagccctccaacctcttgttttcattatcttaccttctatttcctcctttgaccttgcctacctcttacatggacctgtgtgattatatttaggacacattcatataatccaggaaaatctccccatctcaaaacccttaatcacaccttcaaagtccctttcagcatagcaagtaacattcacaagttctcgggattaggatatagatatacttgggggccatcattcagcctactgcacacgggcattacagtcaaaacttcttgcattggcactacttatgggtgcatttttctggtgattgttagaatgtctgtgctaatttacacttgtccaggtctgcctccttttataacatcaggataactaggggcaaataatgtattctctagcaaacccctaatatgtttgaataaagttaaaaaactttctctttctattctgactaaaggaagccaaagcaagagcacattgagaaaccttcatacctatgctaatggagacttgaaaattaaggaatatctatagaaatcatggaggaaaaacagacattcttgaaatgccacctgaaacagagaggggaaagaaattcccttatgcctcccttcctcctaccctccaatctcctgttagtgcctcccattggctgaacctagtcagaagtgattttcccagggagcaaattccaaattacatgcaaattgcatgtaatttgcatgaagtcagcactttcgatgtaaaacagagcaggggaagtaagggaattagatatgagagaaaatgatcagcacataaactgaatcttgagaaaaccagggttgaagttcttactgagtttgtcctggttattcctgcctcatccccttcaattttgcctaaatatctagacattctgtgcatagaaagaatttcctcacttcactggttctttacaagctgagtcattagtgatggcactattcattgtgtgtgatttcaagatcactttcctgaccagggcttggaatttcttagcctttctccctttgagcaccaggagggaacaggagctgggagaagctgggggctagtggggcatattgtatttaccagtcactgggcttgatcatagaactggaaaatagaatgcccagcaggaaaaattcctcacttcacagtggattttgatcaaatattaactatcctgagtatattttaaaatttgtacagtggttcctatacttagaggccagtgctttaaactccccactcagccctacttctattgagcagtccatctcccccaaccccgtgttgtgcctggtctctaatccaagcttttaccagacccacgagaccatcctaattggattttaatttcataataatctttagcaacacattgagttcaattcattatagccctgagtagaaatgcaaatgaaatagagctccccatctttggccttgagaagctgccactgctgctgctttttaacttttaaaaggtataaaggaagtttcaaagaaatgtacagagagctcctgtgcaccttccaccctgccttttcccaatgttgacataatgcatagctatggtgcaatgttgaaaccaggaaatgtctacatccatagagaagcagcttcattttgtaagtttaagaagactcctcagggctggggatggtggtggtaggcaatattgtagtagtaatattaatcccatatattcacacaatgcttttgtactttttaaagctcttttatcccttcccatgaatgtaggggttctattagcaagttccacattcagccaagggttgctgacacctcagttttacttggtaattcaaaagccagaggttttattataaggggctgcttcccattttctcatggaaggacactaacatcaagttatcccatcaaaagatgacttagtaccctttgtcctgcactttctattgattgaaagaaatttctcctcttcagaggcagaagaggcatagtccttgcctctatgtagctgctcccttttctctgatatgccttcctttacccctacacctagtcttctagtctacccaatgcttcctcatcctctaagattaggtctaggtgttaactcttcttaagcaccatcctctttgtacttcctctctgtactgtgtgtaccaacacagttctttgttcatgccttaacaaacttactgtctattttcttgcctgtgtcccctaatcaacagggagtcctttgatggcaggaattatatgtttaaaccttaatttctatccccagcacttgctgtaaatggattaatagacagattcatggaataattctgtgtcaatctggaaaggtaggaaagctttaataaaaactgaataaaaggtataaaaataaataaattctagcttatcttctcttgaggtcttctgtacttctttgcagatgtcacaaggtttggggatatagaacatgtgatgatgacagagctgggtccatatgaacttttcaaatagactgatggcaagaaggcagccagattaaatagaattaaatataaattttgagttccttgttaaatgtgataaacacctgcctatatttttgttcccttccaaaactccactaaagtaacaattaaggaatttaaataggtaaataatctaaggtccaaaaagaagtcggtcaagacaacacatgtaagatatatgaacaaaactttggaagctggaatgctgatgattgattagaaaatgacacatcagagctgagaaagcagaaacccaagtacttacgggaatatgaagctaatgagatgtgcagaatcctggaaggacttgggtattaaaggccttgggtatctgaagacatgggtgtgaggaaggcctgaaaaaacaaagatgagttagaagttttaaaaggagcagctatagcttcaaattctctcttcgacctgccaatcattcccacccaaccaatgtttcctctttggaaagactgaacaagattgaacctgaggcatcagacatggacgatggtgggggtaaaatgctgcacagagaacacatatataaaagaaggtatttagtgaattgtgagacatacccccgcccccacccttgtctaagccccactcctcccttcactcccagaacctggtaaccaggcttttaacctgaaagaaatgatattaagagactctggggaaactgacttggcatagagatttataggtcctgatatttgagtgtctccaaaatgaacatgtcccctgtttaccactattcaacaatacctgcctgcacagagagcttccaatcagcattttagtgcctcatcattaatttggacttataagcaaggatcaccagacacctgagaacatccttaaaacaaaacggaatcacaaagaatccagagaatcaagaggtaatccacagaatggagggaaacatcaaaatacctcttattaatatacttaagaagatgagacacccattaattgagaacagtagcttttaaaaaggaacgtttagggaagaaagagcttttggacatttaaatgtattagatcacacctggaatatcatgttcagttctaggaggaccctcccccacccccatcttaagaggggcattgagaaagtagaggttgccccgaggaagtcagaacctggatgtattcattcatgcacatacatgtgcatatggcaaacatttgtcatttgccttcataagccatcagacacagttctaggagcgaaggaaccagaaaagatccagaggaggctgagtgctcaggagttgggaaaggatggagacagatgatacaaaataaagtacagtggtgagcagtgtgtgagaggagagaccaccaaaagtgtctacaaaaagccctaaggggagcagctgaaggatgtgaaggggaggtgtgttaccaaaagaacagaagaaattagagcttttccttccttctttccctttctctttccctccctcccttccttccttcctctctctctctctctctctgtttcatatctgaaagcctattaaatagagggagagaatttgttctatataggagataaaaaaggattcagatagtgactcaaaatgggaaacaaactaagctgtttgggcaaggaacactaaattcctactcaagactggcttttgtctgaaaggtgttcttttcacatcctcttgcgtccagataaatccaaaatgtgccaaatagaaacctgctgtttctgctatagttctccactgaaccgagctagcttgataagctcttgtgtatctgttagtttattctaaaatcaatcaaacataagtagattgtatcaaagaggataatttcttaaattgagttatagaaaccagctctgttttggttaaaataaataggaaaattgttgaaatgcgatgattcctggctcttggatttaaagcatgaataccattctcgagcaagtcccacaaaattcaggcacagactaaaggagatggagaataaattttccagcaaataacaatggaaaaaacttaccctgtaactgtgctgtaacaacccccagaatcgggcttcagtcatcctgcatctcccaaatttttagcctttcgttgtacaaactgcaaataattgacaccaggctctgagtcagctttctgatcctcaccctcatggttcaaattggagtctaattataggagctactcctacacctccataggcagcttgcttgggattttttcttaaattattaatcagaggaaagataaatttgcctgttttacttatacagggatgaactgtctcctagctgatttttatttatttatgcataaaagtctattttttatggttacttacttttattatttccttccctgagtctggaggatagaatggtcagattagtgtatgtttcatacaaccctatctgtcattgcagcacagccctcatctataaatattccttaggctctggtgtataaattgcttcaattgttaaagtgtataaattgcttcaactgttaaagatgtatcttcccatattcccagtcactggaattcagagagcttaggtcataatgatatccctttaaacccaatgtgtcccaacatggactcagtgtcattttcttttcttcctctcaatggcagctcctttctgttctcagtcagttgcccaagctgtaaacctgagggaaccttggacacttccactctttctcatgggccacactgaattaatcagcaaagactcttatttacacttaccaaatgtatgtcccttctccattcccatcttcttcaccatttctcacccaaccagtgaaagagatgcctaaatgacctccaggttttctatccactatccaggttttccatcataatactggggactaagtgacaaatataatatatcccttaaaaaaacactcaatggctttgtaatatctttgttttagaggtcaaatttataacaaatggtactatgcaatgaatggcatagggttacattttggcctcacttaagtgacaattccaaatccatgtacaaccagggagttcttcactttctcatagatcctttgccaaaaattaggggaacaattttttagaaaaaaattactgaaataagcaaaagaaatttcttttctgagtcatggaagtaactaaactgagcatgaaattgttaccataaattgcactgaggaatttctattcagctcctgtttatgagtttgggggctgtgggtaagttcccattatgtgatttttctggctgcataacacaaaatactcgcaatattaatatgataaataggaacacatttagcatctcaaggagtaaaaggtaatcttcagattgagggagaatctagctaggtgatttttaggattcagaaatagataattatgttgagaacgaagttatgagtataaacaattctctcaatccgtctctttgccgattcttcctttcacctcaattgaaaattgaaaattattttagtgggagggctatagaggagtagaacatatttatcgaattctccacattttgaaatggctggttcactttcttatcaggaagagggagagatggccacattagcagcctcactccatcagttagacatatgtcaggtacctgcaatgttcttcacagatactaagcaagtacttacagataaataaatagttgtatgtatgctgagtgctgcaaaagaaaagtatctgttgtatttgaaggaaagacctgtcgtatctcaaaatgatattttgagaagctttcatttgagcagtatattggggaactcaaacaaagccttttcattttgatcatgccaaatcacctatagaattcacttatagagatgtatctatagtcatatcagaaattggctgctaaatggttacttagggtaaccaaacaagtctgagacagccatggacatgttcatgtcaggaacaaaacagaaaagtagtcacttgtagaacaaagtctagaatcaatgtaggaaaaaaaaaaaactgaatgaaactaggactagaagatttgagtttgagtcccagctttgctgcgtggccttggataaattgactagcctctgtgagcctccatattcccttagtggtcttcccattgtggctctacttacctaggaatagtggtgtattagtttgttttcatgctgctgctgaagaagcaagtcacattttgcatggatggcgtcaggcaaagaggaaacttagatattattttagctcctggctccatgatttttatataaaagaacaagacaaattcagcgaagatttaatatttgagtttgccaaggaaggttttcttacctagtggatgcagtcttaggtactatgccttaaattagaaggcacagttcctagttcctccttctgatgcaccattagctataaatcacaccaattaaactacaatttgtgcatccacactctggcactttcactcaacctgccaataaaatcttgagagaatcaccattggcagctaggccctaataatatctgaagtttccattttcccccacagagtttcacatttactctctcatgcatgatgccctttgtggctttatttttacagctaagacaggaatctaattccacttttgagataaatctcagagagaggaagtagttgtgtaggcaggttgggatatttttaaaaaactgcattggtatgaattacttttgtcaccgctttctatttatactgtacaattcagtttaccaaacatttttatctgtttcttcatttgatcttcacagcagtcttgtaatgtaagcaggaaatcagtgatgtctccattttatagacagggaatataaagcttcaggagagcttcacggtttttttttattcatttattgaacacctagtctattcctaacaatggactatgccatttacaactgctgttgcatttacctttcaaaaaatctgatcaggtaactactttttttctattctgcatatgagaaagctgagtattctctaaattgagtatcttatgcaaaatccacactaaaaatcaataataaacttatgattcaaacatgaatcagatttatctcagagccttaaaaaataataatacatcagttactcctgtcagccaaagaaaacaagctttgccaacttcaggaagtttctgtgttgactccattttgcaataagtctgataatcagagaaaatctgcctttatgaatctataaaacaaagcatgcatgaagccaaattgaaatttgatgtatgtaattttcagagttatatgcatattatatgaaatagctagttagggattcagattgttatttgcctataaaacttactttatttcacacattaaagaattcatgagtgtttggctgaaacctctgtaaagtttctccatccaagctgcaagagattgttctagtcaaaacaaatgatcccaattctatctgaaaacagagaaggggtgaggaggaatggagaaagacataccttaattcagtgtgttattaaaaattattctaaaaggctgatctatttagtattagatctggtaagctaaaggatcatttctgtttatcagaactcttcatttaactcatccaattcagcaagcacttacgttagcatttattagctgataactgtgtgccacacgctatgccaggtgttaggatacagaagaaaacatgataacatccttgccctcatggtatccataactgagttattaatggtcagtagcaaagaagtacaagagataggtgcatacatcctcttcctttgtggagtgcagaaaagatagactctttatattgtctagaatttctggttaagttggattctgatgaatttagttcataatctatttgtctctctccatctctgtatctctctctctttttctatgtctctctctctctctcacacacacacaaacacacatacacacacacacacacacacacacacacactccctctctcttggatttgtaagccaaacatctgtaagtctttagcaatggaaaattccacgtcaccacttcaacacagaggcaggttggcaacttgagagatgagctaagtcgggttgaagtaaaagctagtaaaatccttaggcagtagcctggagagatccaccccaaatccttccagtcaccagagctcagcgctcttgacggaggtgagcattccagtgcgtatctgggaggggagccacgctcctcaaatagttcctaatgacgtccttcctgacaggatgacttgaaaagcagccagggtgagaaaagctctaagtgtacctctaaagcctaaagtaatgtgactgggccccttctgtgcatatctggctctgaaatcccaggaaaactagaaaaagaagaggtgatgaaatggcaaccgtctaatattttctgagctccaaataattaaaattatttttgtatcatcatatgaaagaatgttgacaaagcattgcttcttgaaattgaggtgtaaatagtgttctatggctaatcctcttatgtgtgactatttggttaagagtccggtggaaagagagcagtagtatatttgtttgggattttctagttttaaacattctgaattatcatatttcattgattataagacttacatcttcccctctctacaaaatacatttcagcttgtgaaatcagaagagtcttgtgtccaccctctccaagaaaaagatgcttttattcattgatggtgctttttaaaatcgatactgcttaaaaggatggaaataaattacactctcttggatattcagaacaacaatgtatgggggtagggatgatttctatattttacaaatgagaaaacagcatctctgagtgggtatggtattttcttaacatctctcagagccaggactcaaatccagaaactctgattccaaggtactgctttgaaccccaagttgctcttctcactctataagtaaccagatagttcacaaagatttaacctgccccaatttgtccattttaacatggaactgactgtattagcgtctttccatgatagaagggtttcttgatatcctgttaccatctaaaaagaacatgatactcctcaaatggagcagatatttaaataccaaatgctctttttgtattcacaagatgaaactagaaaattacaagtaactatgcactatcctgtgagcctcttgaggaaaaaaatctgttcagtggattcggtatccccagcaattaggattgtgcaaggcatgtaataaaccctgaagaaatatttactgaataaatgaaagaaggatgtttccgccaaagaaatggaaacatttataattgctcacagcatctcatccctggagcagtgattacatgctctgctaagaatagatgtaaaccatttctgcttcatccttaccatgtacccttcctaagcctcagtgacaatgagggtcacatccaggtaaacaatattgtgacccccaacagactacacaccattgacatttaccccagccatattggaagttgtcctaaagcacaaatttcctttattataagacaccaagagcttctagttcagatgtgtctatttaaagcatcgcgtgtgtacagcaggtggtctcttcaaactaattctcctgtagtgtggaaatggataactcagcaggaaagcagtctctgttgcttggatgtgcagagtcctgtttacagctcagtgatcttaccagttgttgttaaagctgcacacgtttataatgaacaaatagaaagagggtgccactgtcaccattagtaccactaagaactgcatatgtctttgtcctgacaggagtcaccaaagtaataacagcaacacctatcttatattttcagaacacttcagtcaaatctcattttgagtctcacaaccactttgtgatgtgaacctcacaatttgtagatgaacaaactgaggttcagtaacttcccaaggccccactagtaataaatgacaagattaagactaaaagctggccttctaacatagagttcctttttttttttaattttactcccagtaccttttttttttaattattatactttaagttttagggtacatgtgcataacatgcaggtttgttacatatgtatacatgtgccatgttggtgtgctgcacccattaactcgtcatttaacattaggtatatctcctaatgccatccctcccccatccccccaccccacaacaggccccggtatgtgatgttccccttcctctgtccatgtgttctcattgttcaattcccacctatgagtgagaacatgcggtgtttggttttttgtccttgcgatagtttgctgagaatgatggtttccagcttcatccatgtccctgcaaagaacatgaactcatcgttttttattattcacaatagcaaagacttggaaccaacccaaatgtccaacaatgataggctggattaagaaaatgtggcacatatacaccatggaatactatgcagccagccataacatagagtttctaaccctgttccctccgtttatggcttcctcttatctggcaatcatgagacccctggatgaggtcgtgactgatcgaggggcatgctgcccaccatctcacttgggaaagggggagggcaggccatggcctcatgctattgcctaacccactgagtgtattgttttcttatctcagaaccaaagtaagccacctgagtctcgaagacatgagcagctgggcagttttaatcaatgcagattaatcctactgcattaaacaatgccagccttctcacaggaggcaatgcctccttttctgtgtgaatggtagatttgcattctgagtcgccttacttacccttaacaaattgcaaacaagtgtatggcagagcccccctcactgtgtagtttgtggtgttcacacctatgaccttgctccatccaagtgtccatcagtagctcaaggccttgagataatactgatgaatgaaatcactgatattcctgaaaatagcagcagctttggaattggacattattctcctggactccaagtcactatgaacttatgagagtaccctgagtggttgcctagcagatgagaagttccacctgatggcaagtgtcccaaagtatggccatctgtggctcattcctatttgacctggtgaagacatcaattcataacaagtagagggaggccgtaacagggggctctaggagcagacacaggtttccattttactcagtacagaaaggggttacaattttcgcaagtgatgaacaagaataggtgatgaattacacacagaagtaatagaaagaattgacagtcattaccaagcgccaatcttttagatccatcagctctctcataatcttctcaacagatcttgaggtaggtccaattcttattcctattttacttgagaaaattaagcacagaaaggttaataactttcacagtaatgtatagctatttagtggcacaaccaggattttgactccatctacataacccaaatcttgtacactttttactattatcatccatcttgttcaagtgaatacaaatgccagaaccccaaattaaatgcacctagtcaggaacaactggctttacatactcaaaaatgtggaggagaaaatgggttatcatatatagaggtggagaaagaactagctgggggtaatgtttcatgaagctcctctaaaacgtttgcttaggagttgggtttcagtggtttgcttcttgttacagaagaaaatccccccaaaacataaaacaacttgtaatttaaaaagcatttaccaaacatctatttcatgcaaagcaagacagaagaaaatgctgcaattttaatattgttttatacctcggcatgatcatgcttaattttcctgtcaatgtcctgttctggaagcaaattctttcaggttctgacttgttcaaaactatgaaagtcctgtctatacagaaggtagaatgatagaccctgaggtttgggaatagagatgagtgaggcatcccaagtctccaagtagcttacagtttgatagagggaagaccagcatgcacctgactaacacaatagatgaagggaagaagagcaagatgtcaagaggggaagggtggagaattgaggaagccttgcattctaaacaagccttatattctaaacaattgtggtgttataaccaatgtcatgatgtcatggaaacaaaatggcttcacggcgatccagggttgaatcctagctccatgttcaatgagctctgttacctagtagctctatgacttttgtgaagtcagttaacctctctgaacctctgtttcctcatctgtaaaataatatatctacctcagaactttcttaggaaaaataatgtatttttaaaagtatgtagtacagatcctagctcattgcaggtgctcagtaaatgtgaattccacattggatgatataaaaattgaagcatttgaaaatttcattcaaatgttctcctgaggcttggaatcaagacagtgttatgaatttgactgaaaaatgttccaaagggacaggcatagatatgagtaaaacatttgaggaagagagaattaatatttaatggatatggtagtgttaggtttttctgttttaacttgttgaaaaatacaatttcaggacttctataaaacatacttatatttcacaatttgtgtagcaggtttcctgtttacttctagagcatttctaactatgaacttgtttatctccaagaagttggagacagagctctgccgccacagatgcaccatttatatttataaacccagatcttactagttttactatgtgaaatttcttgtgtttatgtttagttttcaaagaaaagtagcaaagagacagataagcacctctgacacaggatttacattgagatgactgtcaaagtaggaaagatgaaaacaggatagattccaattaaggcaaatgcagtataaatcattcattttggggaattttaacaccatagaatgtcatgcagtcaaaacatttcgaaagcatggcagaaaacattttgggtatctaataagccatactgtaaggcaaatataatttattattaaggcaagtattctattgtgttacaaaaaatgaggcagctacaagagcctaacaaagtgttgattgtatatagatgaagtgtcagagaattgtttccaatgtatgacatgattgagatggagagatcctggagaacaataaaaataacagaagaatttggaagtggtagttatttgacggaaataaagccttggaattagaatatttagttttgaaaaaagtagcactaggggagatgcatgttcatctttcttattgcaaaaacataaaaatgaaaatggacaatttcagtacctggagccattttataactgaattcatctaggtattctactccctcatttattttttattcactcaaaaaaaagtttattgagcatctcagacactatgttaggaaaaggaagttccaagaagaatgaaaaatatttcctgccctcagagggctcagtctaatggaagatgaacaactgtacaaataactgcaagttggtgtgatgaatgcaatgaagtagcaaagtgattaaatgagggttgggacttgcacagagttagatgtttaagaaggggcagctggaaggtgggatctcctgcttttatcatgggtagtaaagtcatcaaaggtataaaggagagtgtcccatctctccagatgggagatttagtggtacttagagatgacatgtagtatttatcaagtggcaatgtaaagcatggatcagaaaaagttaagagttcttgatctgtgttccagacaaggcccttttcttctctgggaaatgctattagaggctgtatgatttttgtgcaaaggtttgaccagtagtcccacttctggtgctctgctaacctgctgccaacattcacatatacaccaagatccctgtttgtgatagcaaaaagctggacaagcctaaatatctaatgataagggagttgttaaatacagtctaaactatggaatagactattaagagtattaagaaacatgatatttatgtatttggtagaaggcaggaaaatatccaaattacactattaaaaaggggggaaaagtcttaatacaataaatagctatggtcttgtttgtatggttatgtgtgtatgtacacacagctacccacaaacacacacatacatatccggcacacaaccatacatgtaccactagggtaagctgtagggaaagagagcagtgagagagaaggtaagggaaggcagaagagacgagagcctctcaatttttatcctgtgtttttctatatctttcaaaattttcaacatccatagacttcattttgtaatttaaaacagaaatgagataatgcccatgaagcattgagcatattgtctgccatgtggccagcaataaatgttaattgactcttccaaggtggcaagaaaatacgacttgctcaaaatgatttaaatctgcatacagtatcgtatctttatttttccttaattttaaataaagacagggtctcactttgtcacccaagctggtgtgcagtggtgagatcataagtcactaaaaccttgaaatcctgggctcaagtgattttcctgcctcggtctcccaaatagctgggactatatgtgtgtgtcaccacacctggcctgcatacagtatcatattgatgtttataaataaatgttttctcttgctagaaaatgaaatacattttcctaaattatagtcaatagatttttaccttaaatatgttgttaaatatgtgttctacttatttaatcatttaggacttatttattcaaagctaagcatgagcaggaagccttccaaatctggataataccagactttgcttatgcaccagaaatttccagccaactattatggctttatctgttgtgtactaaactttaaaaatatttaatattcagagtttattttcctgttatctatttattgctgaaaactaaggtcaaatcttttagaaaagctatccctacattaatcaatacatatccagtaagttgaaatgaaattacattttatagaactttttcttataaagaatttgaaacactctgtaagtagatcatcttttattgtatacattcatccttgttttattaaagttgtgaataaattgaattgaaaatcaaattgttttctgaaatatactgatatactctattaaaattcttcatggtgagtttctttgtaattaaaagaaccatttataattccaattaacatttttaagtttatttgtgggtaagttaagcctgctgaattttctaaagcaagacattgttttgccaaggaaatgatagaagtttctaggttgtgataaaaaatattgaaacatcaaaagccgtttctttttacatgttcattgtgttaataagtaccttagaaccgattctttctttatctttattgggttgacatgccaaaaatatttttttctgtgaaacaatagcaatgttataatatacagatttctttgatttttttatccccataacttttaatgtttgaaaatttctaaaatttggcatgtgggcaaagctataggacaaaattgaggtatgatcccaagtggtcaacttctagcagacccccaccccctaacaaaatttagttaaattaaatgaaatttcttacacaattcatcaccaaactcttgattgtcaggtctatcaggctgagagtaactagagtctctcctcaataccctattgagttgggattcccatggagtttttttttgttttttgttttttgttttttgctttttgctttttgtttttgaggtaattatagattcacatgcagctgtaagaaataactattttactcagtttctcccaatagtaacattttgcaaaactattgcatattatcacaactaggatattcacattgacacaattcatcgatattattcagattttccgcagttgtgtgtgtgtgtgtgtgtgtgtgtgtgtgtgtgtgtgtttagttctgtgtaattttatcacacgtgcagttaccaatatccaccgtgcaggcaagatagagaacatttccatcaccacaaggatactttacattgcctgtttataaccacatctacctccctgccttcccatgatcccccatcctccctctcccagcccccatggactttttacaagttgggaatttgatggtggtgtgttttccaggtacgttttgggaaataactgatttatcattttcctcttataaatgtctgtgaataaataataggaaacaggcatacccttgagttgcacatctccccattgtttggcaaaggaaccaacaacgtgggtgaggggctgcctgggctgtgcagcatttccaactcttgagggcacagagcaaaatttgctacctttgttttcattcccagattacgctcgatttgaggccaaaatccatgacctacgagagcagatgatgaaccacagcatgagctccgggtccggatccctgcgaaccaatcagaaacgctccctctacgtcaggtaggcaaaggagtatttctctatctgcactttgtgagcaattcaacttgagaaaacaaaggcaacaccatgtagcaacagaacatgtgtcccacttaacccactttcatcagtacactactgaaagaccttgtgtttaagcatttggaataaatgtttgaaatgttattagattaaattagttaaaggtgcctgcttttatcaagttattctttggcaaagttatgattcaggataaaatgctcagcataggttgcaataaaaataatgagaagaaacattttcatttctaataaatcttaaatggcatatgtggaccaaacccttggacatttacttaccatcagtgtgaaaagaaaatattcctgtattatctcctaacctgcctgatactgattgcattaactttagtgcatcagtttaaaatccacggcattcttctaaagagttatgtgcttttctctaacaagttttggcagaaagacttccttctgtgtcatctcgctaccagtttttttctcagaccatagaagttacttgttccttgtctgacaaaactcatcaatttaccagaaaaagataaatgattgattgaatgtgaaatgccttccagtctttcatcctagtagctacctcttgagtaagatccatcaacactcaactataacatgctcctcttccaagacaagcttcctgtattacttccaaacttcatcagtgctgactgtacttttaaaaatatataagtactaacaggcaaaaggaagaaagtgatgcctaattaacgggcaacatgaatctatgtaccatatggaagaaccatgcccattcttattgtattctccactccccactctggcctgaattcaatctgactccagcctgaggtcatatccttcttacctgaaattttaggcatgacgtatatgttatagatactaatttacatgcttgagttgaacttttgctgttggttccactttggctctaaagttaagttttgtatgtatttggtattcacagcagggctaagaagggagtgggattctggaaggcacaggttctcatagggcttaatttcccgactgaactgataagcctagagtcccttcttattccagggaagccctgagattaagaaaaacaagttattaaccctatgaatttggccaactccatttcaaaagattattttgatacccttaattgtaatctgtgactgttcagaaccaccctaaaacatgtcttgtagtgacattacaaatatgatggaaagttaacaagctccatttgtggttcttcttctctcttgtgttgtattgctggtctacatgctacaaagtatttttaaattttgaaatgttttagtccctggtagcaaattggaaaaagtcagctgggttaataggatagaactaaatcagttagtgtaactgaaatggttatatatataataaagctcggagggaaaattaccaagtgtcttattaagagatagaatgcataaattgttcagatactagaagaaatttgctgaaatatattgctaatagctattaagttttggaagattaagaaaattaaatgaagtgatatgatattatataaaactaatacacttatttgaaagagtagtaattagattcagatctttattctctaaaatcataaataaaagtataacgtacagaagagacaaagacttagagtaacaaagtaatggttggagattgtattgaaaggaggaacctctttttaatgagactcaaaaatacttgacatttcataagaaagtccccaaatgaaatctctgtaatatacaaatatggtatttagtttccaaatgttcaattattactacttattttgtacctagagggctgactttagcatctaaatgactctaagagacatgaaattaaaagaaatatgggccatgcgtatagtcatatcagcaaatcagaaagaaagaacttacaagagccccctggccttattctcatgaaaagtgataaaacagaccaaaaaaaaaaaaaaaaaaaagcaagaagcaaggcctaagtgaaattcttaccaaaaaggattcaacaagtttgtacctttgtacttcttgaatactaattttggctacaggattttcatacagatgcttgctttgtctagagtgcttgtataggaccacggtcagttgtgtttattttagaaagtcaactacttgctctctcagaataaattactagcagggtttctctgattatataaatataagaggatgatcatgtctcaaatctgagaataacatcctgaaaatggtgttattctcctcactttacttagctttatgtaattctagggctagaaggaaccttagctatcattgggccctctgcttaatttacagaagaggaaactgagacctgaggagaacagagacagagacttgcctgtgatcccacagctatctgtggcagaatcagctctcctacccccagtcccatacttctccccacatcactctgcctccctaagggcctagtttatgtggtgtcagctgttgaatacactttagctgtgattcccaatctgcttctgtcagcacagtgctggactctttgattaaggaataaggagaggagaaattctaacacaaatgtctttgaggtttttgcacaggataaactgtgctgtaggaatgtgggatttctttggtattatttatagttttctgtgaagccaaaacctaaatcagaaagcaagcaccttctttgttctgtgagaaacaatttagctgacttagtaaaatatttgcttgcaccaaaaaaccattcttccccttggatttacctcccataccctacacacacacacacgcatgctcacaagcatgctcccaactctagccctggtcctggtggtgtcagagagaatgtaccttcctggggtcttgcagaagctgccttcatttccccactagaaatgatcttcccaggtagtagcaatttgtttacctgaaattttgaagggagtggtaaccagcactctctgagccaggcagtattttaaatatgagccaaccctctctattttctaatctagttatactttttttcctttaatctttcgtgtgaagtgcttgaagtactttagtggtgctgtgcaagtggaactgattattgctaatgttaactgttcttgttctgtgggaatgatttgggtatgtttgatttaatatgctacttgtattgtgtatttcctgcattgtgaaacatatagcagtaaagcattgtgaaacatgtagttcatttaaaagtaaataaagttacaaatatgaataaaatgtttttcaaaatgctgcacaagtacattatcaattcttcaaacatagatgcatttaggctcctgagctactggaatatgaattttattgcgtgtattttgaggctctcgttcactgccttggaagagtgagtttatgagctcatgaagatctccctactctaaaatatccttttcccttcttatctactagctgataaaagctggtataataaagaaagaacaaggcttttcctgctactaacagggatgcaccttttgtataaatgctactaggagaagccaaagatatgggggttaaatttatacaaaagtgcagatttctaaagaacaatcctttgttttgataaaaggaaagctagagtacccaggatgctgggagaatggggagggcaaggaaaaaaagcaaatcattccaccaaggggaaggagaaaaaggtcacaggaaagaatgtaaaagaaaaactcagccctgttcacttgttaataaaacgtatcgattttcagagttcaagcaaataacctctgagttttgaatgtggatttaagaaacagttgctgtgatttattcagaccttcatcaaacattttttgagtgtatattatgtgccaggacctataatggacactgaggacgcagcagtaacagtcatgtttcctgtctgcaaaaaacttatgtctgctggggaagacagacgaagggaagataattaaatgcaatgtgaaatgaaaagatctgttagctctagaaaggcctggaatcttgattgcttccatggaaagatatctaagtaatttttgaagctctgatatgaggtaaccaagagcctttcaaatatttagaagcaaagtaagaagtacattatttatcctgacccagtaaatacatatacacataaaacagaaagaacatttttgttaaatagtaataacactttttgtatacagtgtactttgttattttccattctgtttctctcctttttaaaaaatggagatcatagctcattaacttgatttaataactcactaatgggtcatgatttacggcttacagatggaatagacaagagggaacatgccaggcagataacacggtacacagacaaacaaaagagagtgtctttactaccttatattaaacatatcgaggatccttagacccttggtgttgtagccagcttggaaggcagttatccctgatgcagatgaggaggtagaaatagagggaagtatttgtcagacattttctatgggtcaaccattattctattgttttacatgtattatcccatagaattctccccaaaacactatgattcaggggatattgcctccattttatagatgaagaaactgaaactcggagaagttaaatgattcccccacgatcccacagctagacaacatgagcatggacattcagatcctatttgtgagacattgtagagcagcatttaagcacacagttgctagcttctgccaggtagaaaaacatgtgaatcatggttctgccacatcctagctctgtgaccatggacgaatcagtttctctgggcttactttctttatctgtgaagatgagtatagtaataggataccataaagtggttgtggcaatggcaacaaaagccacaattgacaaatgggatctaattaaactaaagagcttctgcacagcaaaagaaactaccatcagagtgaacaggcaacctacagaatgagagaaaatttttgcaacctactcatctgacaaagggctaatatccagaatctacaatgaactcaaacaaatttacaagaaaaacacaaacaaccccatcaaaaagtgggcgaaggatatgaacagacacttctcaaaagaagacatttatgcagccaacagacacatgaaaaaatactcatcatcactggccatcagagaaatgcaaatcaaaaccacaataagataccatctcataccagttagaatggcgatcattaaaaactcaggaaacaacaggtgctggagaggatgtggagaaatatgaacacttttacactgttggtgggagtgtaaactagttcaaccattgtggaagtcagtgtggcgattcctcagggatctagaactagaaataccatttgacctagccatcccattactgggtatatacccaaaggattataaatcatgctgctataaagacacatgcacacgcatgtttattgcggcactattcacaatagcaaagacttggaaccaatccaaatgtccaccaacaatagactggattaagaaaaggtggcacatatacaccatggaatactatgcagccataagaaatgatgagttcatgtcctttgtagggacatggatgaagctggaaaccatcgttctgagcaaactgtcgcaaggacagaaaaccaaacaccgcatcttctcactcataggtgggaattgaacaatgagaacacatggacacaggaaggggaacatcacacaccagagactgttgtggggtggggtgggggaagaggggagggatagcattaggagatatacctaatgctaaatgacgagttaactgggtgcagcacaccaacatggcacatgtatacatatgtaacaaacctgcatgttgtgcacatgtaccctaaaagttaaagtataataataataaaataaaataaataaataaaaaataaataaaataaaataagtggttgtgagaattaaataaaatagtgaatttagatatctggcacatgggaagtcgttgataaatgttggtaatattcatcatttactatgaagccaccttttccctgtcagacagagagaccacagaattggttgtgactaagacgctgttttctcagcagtgagataagcctctctcatcccattgcttgccttcagcaaaggaagaaggatagactttctgatgacttttagatttttgctcctctggaccccatgaagcctgaaggagatggccagcattccatggctccagaatgctcagctctgtcaactcatcagcatttctcatccaaacaaggctctacccagaggcagaacctgaaaggaattcagtagaagccacatgatagaaagactcactgcatatacagtaggccattccaagtctccatatatgttatcagtcttcctaaccacatgatttcttctatttcccctcggcattcttcacccctttccagccctctgctcatagtttcgttctgaatttcaaagtcttatttcttttacagtagttctaagtctatatgttactcaaagttgctactacctgagacagtttttgcctcaaaggctatgtaatatgacaaacgcactcaggtcagcttcttgcccctcgtttaacttaaggcattcataaattgattccttcatgccttgattctttcattcaataaatatggtgtttgtacttacctgcaatgtaccagtctgtagtagatgttaagggcacagtgatgaataagaccacagaacccctttcctcaagtttctcacagtctagatctataggcaatccaaatagtatgcagaccatagaaatggtaattcatttcctgataccccatgtgttatgtgccttgcaattattatcctattttgatttttacaacatgcctattgactccctgaagtgaaatttgcccagaagaccactaatatttgaaactcacctgttaagatagtgactgctctggtccttgttaagcatttatgataaaatgttttgaaatgaatcagtattattcaatactggacctgcaaatcccagtaatgtcttgatgtttcatagctctagtgcattatgccacagtgcttggcataaagaattctccttaggaaacgtttgttaaatgaattaattccaagactatctttcctacacaaatgtgagagaaaatattaaaatataagccaaggtatttgaacaatcctatggaaatccagtaccagcttggctgacaccaagtgcatcgagtctggttgcatcctcaggatgcaggctctacctgctgctactgggatttccagaaaatatgtggtgctgcaaggcctttcaggctgtttcatttgtttgctaaactgtgtgacaaactctttaaattgggacctaatttaataatggatttagacaagcacgcacagcccataacctcttagtgagacaacttgaagtaagggaagggcccagggtgaacctcattctcaacacagttagtcgttctattcctgggaactaaggcttgaagttatgtcaagagcagtctcaagaaaacacattccatcctagacacttcgcctttgagcttttgttctgggggaagggtggtcccacctgattgattttggtgggagggaaaagctacatcatcatgcaggtaagacactctggtcatttatttttctctatagtagcaaacatgtcttttcactctacttcctgccccatttaactgctggttagtatcctggggatgataaagaagagtgtggaatggcaggattcttcactccagtggtacaagctgcttccagcttcacttggcgatggatttcttgagaacatttaaggcaaagccataaaatccgtggactgtgttataagtcacatttttgtcttcttcccctccaatcttggacccaacatgttggctgtttcccagagaacatgccacagttagctgtgtgcacccccctgcccagtacttggcacagggctagctgacagtggtatttttattgcacacattcatttcctcataattcttatttagcaagatcattagttattcacttagaaacatattgactatgatatgttgcagcagaataggaaatagaaacttcttgaattcagaattacttttctctcttaaaaacttagtgggggcaaaggtaactgggaggggaacatgatcaggtacctgaaacagtttaacaggatgaagcaggaagtctggacagagtctagacttgtcaaggcactggttaaattcctattgattatataacttctgttttatactttgtactgatttcctccaagtagatctggcttctcatccagaattcataacttatcgttatggataatgatagtcgtgcatagcttattgtttgctaaaacttgagtgtcacatttataaaatggacatagtacctagttcacaggcttgttgttaggatgacgttaaactgaatgtatgaaggaggctgctatatgggacttgttaggcaaaggggagttccttttattgcttcaagtacttagagcctgcctcctaaactggtgccttctttaaagcagaatagattttgattcttcatttatattttgagacccattagcataatgcttactctttcagggatttgcatttttagttgtatccttaattgtggaataaaaggctttgtctttaggcagctaattttatgccagaaatagaaagaaggaggagtcattgtggatctgggagtttcctctttcccctgcaatcataggctacctgattttaaaaggtttttaatttttatatttctgtaggaagaggaacaaaagtatcataagtgactcttccattgaccatcacgttttcctccattcttctacttcaaggtctagaatccagatctcattactgttaatggttggcctgtcattaattgattcatccagaaaacctcttctgagccacagacctctacctcacactctgctagactctggaaataaaaagattaataaaacttcttttctgccattaaggagcccacagatcattcctacaacctagattctgcttacctctccactaatcccatggtaatcatatttccagaaatctctcatctccgcaggaggtactttgcctcataacccaaaatgactactttctagaacaaactagacagctctagctaaaaaggagaacagaatagtaaaaagtaagacacagaatgctcacaggaggataggtgagaggggagggcatgaaaaaattgagggagcttccctcttccccctgcccaactgccaatcatgtaggttaggttagtttcaagggaacaaggaaatagacagaaatcacttgtccttaagtctcagtgtttgaacagtgtctgacacttctttaaattaactttaaatacttgtggaatgaactttttgattagcagttaaagatgatgattaaatagaaagtggtattaagagagccaccaatgattgctggagtcaagcacatgctcctctgttttcctgtggaccacacacagaacagctctcctccaggcttcacgtgctctttcctgtctgttgactcacctgctccctccattggactgtgagtatctcgaagatggagatttcatctccttaaattctgcttccggacagtctggcatatagtaactgctgaatcaattaaaatgaatggattacagatgtcaccaaattggagagagtttaactgtatttaatattttacctaattatgtcatggcttgcaaatggtttactgactaggctccttgccccttgttaatcaaattaatatggaaccctatttggtaatcatctcagattaaattttcaaaaattatttaaccagagtcactattcttatatcaaataaaatagactttaaaccaacaacagaaaaaaaaagataaagaaggatagtacacaatgattaagagttcaattcaacaagaagacttaactatcttaaatatatacacacccaacattggagcacccggactcataaaaccttctagacctatgaaaagacttagtcacgcaataatagttggagacttcaacaccccattgacagctttagatcatagacacagaaaaactaacaaagaaattctggacttaaatttgacttaaatttaattcttgacttcaatgtgactgaaccaattggacatctacagaatactccacccatcaaacacaggatatacattcttctgatatgcatatggaacatattataagattaaccacaagttcagccataaagtgattctcaataaattcaaaaaaaattgagatcttaccaaccatactttcagaccacagtggaataaaaatagtaattactaccaggaagatctctcaaaactacatgattacatggaaattaaacaacttgctcctgaatggcttttgggtaaacagcaaaattaaggcagaaataaaaaaatatttgaaataaatgaaatcagaaatacaatatacaaaaatctctgggatgcaacaaaagcagtgttaaaaggaaagtttatagcactaaatgcctacatcaaaaatttaaatgtcgaatggacagttgagtttgaagatgcccagagcatatggatttgtgattaaattgagagagtccctaatgagttgtgatcattacagttgtatgagccaggtccctgcctctcttgttccaggatagattctacagccagcatagctctatgcctatgaattcccacattaaagagcacagttgaagtgcctatcacacaatgggttgcccaggacctgctacataatttgcaggggcccggtgcaaaatgaaaatgctcaattcttgttcacaaattaatagcaaagccgggcatggtggctcacacctgtaatcgcagcactttgggaggctggggtgggcagataacttgaggtcaagagttcaagaccagcctgggcaacatggtgaaaccccatctctaccaaaaacaaaacaaaacaacacaaaaattagcctggcatggtggcaggcacctgtaatcccagctactcgggaggctaaggcaggagaatcgcttgagccatggaggtggaggttgcagtgagctgagatcttgccactgaactccagcctgggtgacagagcaagactctgtctcaatcaatcagtcaatcaaaataaaaaattagtagcaagacagtgagagcagagcataatgccaggtgtgggacgggggaacacaggtctcatacccatgaagccattcctgttgacccccgacttaggacatttaattcaaaactaaaagcatgattattttccttaatatgtagtatagtagaggtaagaaacacaaaatcagcactgggaacattttcaaggatccaggccttattctttttctaaaagagtattttttacaaattaagcatatgcctgcttttatgatatgtagaaacattttcttccagccatcttcctgcttgagaaactacattcccacttgccctaaactgtcaaggggccactttgagtcatctgtcttcactaaagcaaatctttcaaaagctaagtagcatcatttcacatttatttagcacctgcaggacactttggtcttcttgttctgcaaaagtttctgcctcttggcccttctcttcaggcctaagttttaaagaaaatgcataaaagtgcctcagatgactttgaaaaacagtgagaccggttggatgcttgtgtccttcccatatgtcattgccaaaattcagagggtgcaagatttgtaaattcccctgactggcaacattacaattaagaaaaaaaaaatcatggcgttgatagggaattgacaactaaattgcaccaagtaagaattctaaaaataataaacaaaaaggcaaattataatatatatttgaattggttgctctttaatattgccatcattttctagaagagagggcattttaatgccagaagaaacttatgaacataatctgagcatcagaaaaagtcctccaaatattataaatttgtagttttaaaacctcactagatagatctccatattttttctatccatataatcttaccttatagctaaaaaaattaaagtaagcatcatgatgactaagttgtttaattcttaatcttgagtattttggatctaaatcattctaagatccttaggaatgcatttttttttttttttttttttttttgagacggagtctcgctctgtcgcccaggctggagtgcagtggcgggatctcggctcactgcaagctccgcctcctgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggccttccaaagtgctgggattacaggaggaatgcatttttttaactttgtccttttcttgacaaagaaagacgtcttttagattttctttttctttgtgtacgtatgctttcttcatcttttatgccattttctcaataaataataagcccagacccatcttctgtgataagctgatgcttttcagtgatacttattaaaagataaaaaggaatctttcatcatcaaaattatttttcatttttaaagttgtcattctttctacattttaaaacagacccactttttgacagctttattgagatataattgatatgcaaaaagttacacgttttatacatacaattttgtgtgtttaaaaaaacagattttttttaaagatatcatcacattatagtatctttcattgtattttataacattgtatattctacattgtttcaaaccagattgcttacctcatgtactttttccccttaattgtcttaaaaggcagacatgtcctttcaaactcaggattccatacttttatatatatgaaaaaacatacaattatctgattccacaggtaacataatgagaaaatgtggtgtgaattgagtataagtttgcaacaaacagggtatttaatagcttctaatgccctctaacatgaaaatctaattctcatttaaattaactttgtagctcttactgtagacaaacctctttactagttccagtggcttctttggagccagtgtcatcttactttttctgttaatgagggttcctaggcaatcatcaggaaggggtctctgcttgtgtttctggttgctgtaaatccagatgagtggggagtttctccacctaaaaggcctatgctgaatgaacaccattgctggctgttcataagataacttttctcttttcctaaaattctgtgttcctgcccctttcctcataaatgggggcctccatgatacttccacctccacaacacactcaaatcctcttatgagcccttgattacatgatagattcaagtatcctgaggatgaggagctggcagtgaacatttaattctcacagtatctatgagggagcatcattactattcccattttacagttaatgaaaccaaggttagatagctgaagttatcacccatatttacacagcaaagaaggacaacatgataaaaactcaattctgtcctatgccaaataccggctcttaaccttaatttccatggcttctagaaataccacattttcttagatgtatttgatttcatatatgctctctcattcctgtaggtacttaaaattgttaaagcaagttctataagttttgggaaatatagtcatctaatatatagtgcaactccctcagtaataaatgaggacgttaaagatggtcagtgagtagatctttgacatgaagttatactagttcagatgtaaaccatgggatgcattcgttgatgatgcatccttagcaaagaggcatgaggtttcctgctacaggatgctacacagaggataagacgattgcaggatcttctgactgccttagagcaagtatgatggaatggatacgggtttaagtttttcttcagtgagtattaattataaaatactacataggatgctgtcaggggtaaaaagatgaatcagacatgtctttgaggatccagctgaagttagttgcaaaaaaacagaggaaaataataagctattattgtgaacacaaattctgctccaggatctgacacctatgcagagggtaggaaataggggagatttgagaagctaactatgatggagtctcttgtagtaggttccaaaagcaaagctgtatttttgttgttgttgttatctttggcagtatatttcccctccataggaggtatacactaccatagaatgaaatgataagtcctgtagaattctaactcaatcagccatgcatttatgagttcacagcagagtagagtaggccaaaagcttgggttctggagtcagaaatacctggccttaaatcctggcttggccacttagtacctttcttatgacctcagtaacataattcttctccctctaggcctccgctttttccataaaatgggtataatagaaatactcatttaaagtttatgaggaataacgtttgtaaatcacctagcgtcttatacaaactatttcagaaattagaaaagagagggtacttcctagctttttacaatgttaacatcaccgtgataccaaaacataacaaggtcattgtaagaaaggaaatttatactccaatctctctcataaacatcaaattaaacatatcaaatattagcaaaataaatctagtgatatatattttatatctagtgatatattttatatattagatgactgtatttcccaaaacagaaagaataatattatcatgacctgctggaatttattacagaaatgaaagaacgctttaacattagaaaatcacattaacagaataaaagataagattcagatgatcatctaaatattacaggaaaaccattcaataaaattcaaaactcatctgtgaacaaaagttcttagaaaacgtgaaaaataatgggcttcctaaatctaataaaaggcaaacattgtacttttttttgagacagagtctcactccatcacacagtctggaatgtagtgccaagatcttggctcactgcaacctctgcctcccctagtcaagtgattttcatgctttagcctcctgagtacctgggactatagccatgcaccaccatgcttggctaatttttgtatttttagtagagatggagtttcaccatgttggtcaggctgttctaactcctggccacaagtgatcctcccaaagtgctgggattacaggtgtgagccagggagccagcctaaacaccatacttagtaatgaaattttggaagctttttccctggaaacaggtatgagacaccttctatcactactctacccttctatcactactgctattaaggggaggtgcaagaaaaagtaagatgattggaaggaaaacaataaaatgatccttattttctggtaacataattctgtatgtttaaaattcaaaataactagatagactgctataattaaaaagtaactttagcaattttactaaataacaaggttaatatcaaagtaatcagttgtatttccatataacaatactaaacaataagaaaactaaacatatcattgacagtaggagtgaaaaacattaaagtcataggaatagaactgacaaaagagcaccactatacaaaaaagccacaaatgttattaaaggaagatgcataaatgtggggtataccttattcatgaataggaagatgcaatgtggcaaagatttcatttctcccaaactgatatattgattcactgcaattcctatcaacatctcagaagatattttttatttatttgttggtgatggtgatagattagacaaagtgattctaatattaatatggaaatataaaagaccaacaataggcaaaacacagaaaaatgaagtcagagaatttacattatatgatgttaggatttattatgaggttacataattacaggcagtatgaaattggtataagtgtagacaagtagaccaatggaataatatagagtgcagaaacaataacacacacatacaacctcttgattttatgacaaaagtaaaattgctctgaagtggaaaaggatgatctttttagtaaatgacactgcatcaattggatatccaacttttttaaaaatggctcttgacccaacctcacactatacacaaaaatctttctacatggattatagataaaaatataaaatgtaaaacaataaaagtctagaagataatattgaaaaataacttcctaagtgtgtgataggcaaagattaagtattaaacaggcacaaagcatactaatcacaaaggaaaatattgatgaactacattaaaatacaaacctctgttcatctaaagacaccatgaagagaatggggcaagacagagcacaggaaaagatatttgtaatccagacatctggaaaagaaatttatcttcagaatatgtaaagagcagctacaagtctttgagaaaaaaaaaacatttttttttaatggacaaaagacttgaacaggcatttcttaaaagaggatatgtaaaacggtcaattcacatgaaatggtggtactcccagaatggctaaaattaaagactgttcataccaagtgtttgtgaacatgtagagagtctcaaacattgctcatgggaagtaaaccaccacattggaagattttttgtcagtatctatcagagccaaacatataccctatgatctatccctaggtatatacccaatagtaatgagtacatgtgttcaacaaaaatatatacagggatgtgcatggcagcattgtttgtaatagcctaaacctgggaataaccaaatgtccatcaacaatagaataggtaaataaattatggcatatttgaacaaaaggataatatacaacaatgaaaatcaataatagcagataggaatcttgcaaatattatattaagtacaataagccagacacacacacacacatacacactactatatgcatattagttttctaggctgctgtagaaacaaatcaccacaaatttaatggcttaaaaaaacgtaattatcatcttacaattttgtatatcagatgtccactatgggtctcaccagattaaagtcaaggtatcagcaggctgtgtttctttctggaagtttatttgaattgttggctgaattcaattccacgcagttgtaagaccaaagtccctgttatcttgctcctgtcagcctagggccatcctcttctagaggctgctgcattccatggctcgtggcccccttcttccatcttcagaatcaacaattgcaagttgagtgcttctcatggcgtatctctctgacccacttgcaaaagatactctgcttttaaggattgatgtgattagattggatccacgaaggataatccaggataatctccacatttcaagtttcttaaccttaatcacatctgcaaagtctcttttgttatgtaagggaacatattacagattccagggattagggatgagggggtgttattctgcccaccacaatatgatttatataacattcaagaacaggcaaaatgaacccatgatgatggaagccaagagcgattatgacccttgggtcatgttgctagaataggaataacagtattcattttaataaagcgttgttgcaagtattatagccaacagtaatgtcaattgccttgtaaagtgcctgtcacaacatagccctgttatttgtcatttcctgtttccttcccttctcccaattccaccttcatcatttcacctgtaataatgctgcagtcaggacttcgatgcagaataagatattctgaagacttgcagaccctctgtaatggtgcttcctaaacttgcctggtaatgaatattcctcagaaatgaagatataagcaagaaccccaggtgctgcttaggtaaaaggaagtttgggaaacactgcttttagaaatttgcttacatgaaacgctgttgaaaacacaaagaaatgctgaatgatctgccctagctccatccagaataccacttgctaccctttttaagccacccaaagcaaatcagctgtgctatgccattgaaaaacaagtacttcttaaaatattggactaattagataggattctagaacttaatcttttgctggaagtatcagtctgtggttctaaggatctagcacagaacccaaacagaaagttgcataaatatttgttaagttcactgaaattaaagacggcatctggttggtttgttgttgttgttgagacagggtcttgctctgttgcccaggctggagtgcagtggtgtgatcacggctcactgcagcctcaacctccccaggctcaggtgatcttcccacctcagcctccctactagctgcaactacaggtatgcaccaccaggcttggctaatttttgtattttttgtagggatggagtttggccatgttgcccaggctggttgcaaattcctgggtgcaagcaatccacccacctccgcctcccaaagtgccgagattataggcatgatctatcgctcccagcttgtttattatttttttctattaaagcacgctgcagttgcccatgcgcatgacttcttgaatgtgctaagaaagaaatctggtaaaaattgagtctctgtaacattcatttcacatactcgacctcaaactttttcattcattcgttttacaaacaactgttgatatcccatattgcagacagttagacatgtccaaggaatacaaggataaaagtactcagtccttgctttagggtactcccagtgtagtggagggaccaataataaaagaacctccaactccacctccccaccctacactgaatttggaactcacattgatcaagagcagggagccactgccattgtaaatcaggtctcagcctctttcctacttcatcaagttcacactggctttctttccagggaggggccaaaaatcgccttgtttactagctgcctctctgctttatctcattgtatctcaaccttagctcgaggtaagaagcacctgtagagctcttcaaaaccttgatgtctcaccccagcccagacctactctaaatcagaatctctgggagtgggtccccaggcattagtgtttttaaagctttgctagtgatcccagtatgcagcaaatctgagaaccactattttatcttttctttctttttttggtttcttttctttttaaaaaaattacctttacttcctcagctcatgtttaagctgaaaataatcatttctttaaagtctcagatttcttgcatggaagtctagtgcaaacctgcagctagctaatgagaaggccagttcctaaaatgactttcaattttaatcacatttaacattagttgactcagaatttggaaaccaaccttgaatctgatgctacaatttgctaacactcagcaaaaatagaaccccctgtttcaaaaataaataactttgtaaaacagattgaaaaggttggtaagatttcttgaaaatcagagttctcacatttacattttgatttccagtgatgaaatgaactgattagaaattcttaattttcatgaggtccctttgaaaatgttcagagtgcagctgagcgccaaagaacatattaatagtttgagtgtgcgcatatgtgtgtgtgcacatgtgtatatagcaatgactgggcttgcagtaaattcaggtacaactaggtttacccaatcctcatttctggttctggttcttactgctccagtcttcccgactccatagtacactgctcctcactccccttgctgcctgcctccatagtttgaccctaaccctagcttttcccctctgtgttcttgtttacccatgccactcccctgacttaggcttagcctatcccaggcctctgcaattggttggcatggaaacattaggccagcctgcctggtgggagggatgttctgtttccacgtgaaaatggaaaagattcaagtgtcattcgcttccagccattttaacccttgagtttctccatctatttaaaacatacccactgctcttgatcaccaaataggtaaagaagactattttaacttggactctgcctacctctacaccctcctctgctgcttcccctaaaagccctggatggagcctcaggaagcactttgttccttcatttctcctttcctttgcacaggccctttcttcaatctgcatactgtctcttcctccttcccattcagtttatggggttcttaatggtttttcaagactccattcaggcaccatgccttcctagaggctttcacctctgcacctactctcatagcacttccgttataatggttgtagaaaattccaagattaagggactattttcctccctagatggtgagtttattaaaggagaggcatgctactgtgaggagtatgtttctcatactcctggggtgagatcttatctctgttcattactagaattaagatcttgcacaagtcacttatctttttaagcctcagttttctcatacctgaaatggaaatgatggtacctaatatgcctactatttatcagatgctgactatgttttaggcattttctcatttaaccttatttaatccctacaccaattcggtgagagataaaacattattgacctatttttacaattaggaaaatatggctcagagttgagaagcctgttctaaatcacacagctcttaggtggcaaagccaatagtcaagccaaaatctaactctgttactctgctctagtgcctgtatatgcaagtaaagcacctagccctgtgcctgcccttgaggagggggtggggacagataatggatggaagaattagtgataaattgccttggaaaaagtatgatcctaagcactccatggggatccaaatggaaaattaaactctttcctctagtctaggcctaatgtgcaccatttctccaagtgtgtggtaaaggtcaagtatataagacttctatcacccatgtttatacctgtgtgctacttcaaatgcatgcttccctcccgctcaaacagttgcccccccttcaaaagcagctaaaggtaaactggctcctggagaactgaaaagcagaaagaaatgatctttgaatagctattaaatcaccttgacagctgccacctggcaacaagccctcagtgtcccctgttcccgtccttcagttcagtatcagtcccttactgcttcagcggacaaagaagagaatagttaagtgagtcccatttaaggggacataattaacctttagaggtaatcattcagtaccattcagtgaatttctataattttcctttctaactggcaatttagcaaaagaaaaagatgtgctgttattgaaataatttccatttttatgtacagataagtgtaaaagtcttaattaaaggatcctgtgttagagctgagtgtatgtaaataatgcctggagtttcaaaagcaaaaaacaaagcttgtcagtttgtctagggccagtcatcacacgatgtttgttttctatagcatgcttcactaatggatttggttaccaagattactcattttaaaattatagttctgaaattatcgaacagcatggcctcctacagaatcctggaagcagtgaattgaattctgtcatattgcctctctctgtctctctctctctcccccttccccccttctcaatatacatgcattaaacatatttccttttacgttcaaaagggctatgcaattgttttcccatgttaatacacataatttttttaacaccacagacaataacagttctagatccagtgccaaaactgtgattcactccagcctgcaacatagattagacaattagactattctttgtaaaatactgacttttattttagatctgattttttttgtggaaaataaaagaccatgagtattgataaataatgtttttgtgttaatttttaagcaacctgtacttgagagccagaatagtgatccatttaaaagatgaggttctttgataaaatgatgcatttaaaagattaggttctttgataaaatgatgtgggttttaatttgtttcttctgtttaccggttgtgtgatctggaaaatgttgttttctctaagtctcagttttctcctctttctattgtggataacaagagtaccaacctcataatcatgttgtataaataaaatcagatactatttataatatgcttagcatagtgttcagtctatatgtaaaagatgctcaataaatggtagtcattatttattattattattattattacctcattgcatagttgtgaggattaaatgagatgatgcattaaattgcttgacacacttctaggcagattgaatgtgcttaataaatattacctccattatggttaccacagatctgttaccctgtctgttcgatagttggttgctatactgccagtccctaaagttcccttcttttccctctttgctttgtttacttctcgtcaaatcacagggttccacagatgtttaattagcttactgtttcccttttgctctgttttcaatcatgtctcacaagtcgaaacattcctttttcccacactgatacagattcgtgcagcaccatggacctagctttgagttgtggtgcccctcttgttagctgggcagccttgtgccaattacttccatttctggcttttagatgtttttcacgtaaaccacatagataggaagaggtaaactctgggatcccttcctgtccgacatccactgactctcacgctcggttttagtcatggtcttggggacgctgcatagtacaggagcccaggtcttagagacctagtatttgtagtaaatataaacactggacatgaaaaggggacattcttaccagtagcatttcaatatttttacctagtgtgatgtttgaggagtgttgagaccctggggttacactgtcaaaatttcatagtatgaaaataattctcagctttcccaaaaggacaagcatttaaatccaagtaccaagtatttaaaacttgaccacatgtcctacagagagagtgatatccaacctgtatctatgtggctgcctttgcccaagaaaggcaaattctattttacatgaggacataattctgaattaataagaaaaattcagtagaaaacgatagggctccaacatggctagtttaggagcaaacttttccagcagggttttttttgcttggaaatagaaagggattatatgtcatgaatttcaaatttcaggttatttcaactccaaggttggcagagagattaaggatgagagtggggagaagggaggatgcatgcaaagatcccacacatgcccttatacactcctaggttgttgtcaataatgggaaatacattttcgtttttgggtttaaaatcaattgttagataatctcgtaaaatcagattctcctactttgtgtacattgtaactaaaactcaagccagcttaatgggaaatttcaaaattctgtcatttccagctctcagggctcctccatctgccctagttgtgcttggagccagaaaggagcacagagccagatttctcattagcactaaacctgttggaccaagaatatgacagcatatgaagccctgctggggcaggttggctacaaggctggaaatggttatctcaggtctctgaagcctgtatgttggtatagaagggcatgtctagggttaaaagattgcctggcttaggaaatcttctaagtttatttcaatttgtaggccatttgtgcccataatgaaataagtcgaaccaagggaagtactcttcttcttgccatctcctttttggtcactttcatctctgatttaattcatcctatgatttgatgtaaatattaggttaaaccatatgaaactatcaaggtttcatatgattcagcctagtattttactttaaaggggggcttctgtttgaatgtgctgacggcttgctatcatttggttggctagaaaggttcttggacagcagagggttcaaaatggtggctgtgtaatagaaatccaccatagtttgttggattttaaattataatgatagagctaaaaatgaaataaagcagttcattcattagcctgctgccccaacaaatagcataatcaactctgcttttagcttttatattagaaccagctgtagtatctgaaggatctctctctctctttctctctctctctctctgtgtgtgtgcgtgtgtgtgtgtgtgtcctgatttatttatctgaagtataattatggattgctcctgatttatgatggcttgacataggatttttcaacttttcaatagtgcaaaaatgatacatgtttaccagaaattgtagtttaagtactcataaaaccattctgtttttcactttcagtacagtattcaacaaattacatgagataatcaacattttacaggttgagcatcccaaatctgaaaatccaaaatctgaaatgttccaaaatccaaaactttttgggtgctaacatgaaaagggaaatgctcattgtggagtaatttgaatttcagattttttaaagtacatatttcaaaatctaaaaaaaaaaaaaattgaaatctaaaacattactggccccaagcatttcagatgaggaatactcaacctatactataaatcaagcttcattgttagatgattttgcccactgtaggctaatttaagtacatttaatgtaggctaggctaagctatgatgtttggtacgttaggtgtattaaatgcatttttgacttactgatattttcaacttacagtgggtttatttggacacaatccatccaaaatcaaggagcatctgtatatacactgaaatgcatggatcaatggattttaataaaagcatgtatatgtagtcaccacccaggtcaagatacagaactttctaacaccccgtaagacgtcctcatgccccatttcagtcaatcctagaccttgtcccctaccctgagaaataactactattctgaattttataccatagattagccctggcctattcttaaactccatgtaaatttagacttgcagtctttgttctttcatgtctggcttccttggctcaacatgatatttataagagccatccatattgttttgtatttgagtagtctgctgctttttattactttatgtattattccattacatgaatataatacaatttgtttatccattcttctgttgaaggatacttggattatttccagtttgtggctcttatgaatagagttgctacagactttcttgaagaaatcttttttaaaagatgcattcatttgttttgggtatatccaggagtgaaattgttgggttataatcaaatactttaaataaattgctaaaccatttgctaatagtagttgtaggaaatgtagtaagtgtccatgtgccttgctaagactctgtcgtggatggacgggaggagtcctgttactaaaagagaacagcggggacagtgggtactgggagacaactaacagaccccaccatagtgcccatagacaatatttcatgaatacattaactgagacggttcttctgtgaattgagagtatgagatttaaacatgttaaattaagtttagcctacagctgcctccttacatattttaagtttggcctaaaggtttctctgtacatcgtgaactataacaagtggaggtgtaaacagaccatagcctacacttgtgccaatcatggagttttggccaatcaaatgcagccaactatccaaaccgtgttcaaataaagcaaacaccaactgtaaccaatccagctgttactgtacctcacttctgttttctgtatgtcactttccttttcctgtctgtaaatcttatgccaccatgtggctgcgctagagtctctgagcccgctgtgtctcaggaggctgcccgatttgcgaatcgttcattgctcaattaaactcctttaaatttaattcagctgaatttttttttctttttctttttctttttttgagacggagtctctctctgtcgcccaggctggagtgcagtggcgcgatctctgctcactgcaagctccgcctcccgggttcatgccattctcctgcctcagcctcctgagcagctgggaccacaggcgcccgccaccatgcccggttaattttttgtgtttttagtagagacggggtttcaatgtattagccaggatggtcttgatctcctgacctcgtgatccgcccgcctcagcctcccaaagtgctgggattacaggcgtgagctaccgcgcccggccttttttttttttaacaaacactaacgtatgttttcaagtagcagtagctctattcctttaaacagaggtcaactccgtgaagaccctgacaactgtatgggctgacgttcctaaagggaagcaaaattgttttttctgatttcaaagatgatgagaaatactagtggagatgttaaaggctttcagtacctctgatgcatctttcactatgataagattgtttttagcttctggctgcacccatctaaggtttcctcactcttaataaaacaataaatgcctacggatttagatacatagatacagattagctaattgtttttgttcattatgttgtgttttaaaatttctttactgactacaactatagtatatatacatatattctataaatgttagcatatattagcatatatgctagtatgtatagtagtgtatactgactaccttttaacctctggttcctaagagcttaaatcctctgtggatctcaagtttgtgtaaatcttttaagtatgaaaagataatttatgtttttaagtagcagctcctccctttcttgaaaaggagttaaacaccaaagaatcaccgatgactctgtggaatgagtctaaaaagtagcataacaactagtatagtgaagtcactcaacaaatgtatgttcccttctcctagtatctcaagtcacagataagtaaatcacagcgacagtttagagcggtaaatgctatgcattatgagatactaatgtttttattgctacctttcatggcttgatagcagaaaaatgctgactgctgactgccatgaaatggaagaagtatgaagttctcacatttgtggacaatagtggaacactgcaagtactcttgcatgtattgttctgtgttccattcacaaacctggcttttgcagtcctttagaacatagctgataatatagaaagtaagaactgcaggaagcagctgcacctttaacttgctgcatgaccttgaataagtttttaaactcttcgagtctcagttacttcatatttaaagtgagtataaaaccagttcttatcccatagggttcttatgaagattaactaagcttattctggtaaagctcttcagaatattatgtggcacttagtaatcaatcgttgttgctgttaccactgttgtctcttctggagttatttccctggtcccactgctttagaaattagttgggacatttatgtttatttctttgcttgcttgcttacgtgttttgtttttttctccacgttattaaataccattgccgagtgggtcgtaaaaagctcatttcccctgttagaaaacacaaaattttaaccaatttgatttaaagattgaattggctttcattcatgaatcaggcagcatctcatccaaagacttagataaggcactccagtgagctgaggagaggagattggctttataggcagaaaatggctcaagaaagcagaaatgggaaacaaaattgaattgggcattttaaagctgtcctcctcatagggttaaatcagaggaaacttccttatccttctggctctgttaaactgggccccttctgattggttgctgtgaatcaatcaatctctctctctctctctctctctctctctctgtctttgaaaactggtccatttcaaagtttgattatatggcacctaacattaatgactctattctgatttgctctggcctgttgggcctagtgcaggagcttagtccaaacaatagcctcccataaatttcatttaacaccctttgaatttaaaacaaaattttaaattagtttttgtcttatagattttctttttttaaagcagttttaggttcacagcaaaattgagaggaaggtacagagatttccatataccctgcccccacacatgtgtagccacccccattatcaaaattccacacctgagtggcacatgtgttacggttgatgaacctgcattgacacatcattatcacccaaagtctatggtttcacattaggtttttctcttggtattgaacaatacatggctttagacaaatgtataatgacatgtatccattattatagtatcgtatggagtactttcactaccctaaaaaaccctgaaatttgacaaagtgtatttttcagctcccagaaacacttgtttcagaaaaaagcaggtgaggatattcagttcctcaaaaacccaaagatgagttgaccaaaaatatgactccaagagaattgtattaaagaaaaatatattctcagaagttttattccaagaacacacttgaaattcaatcttaacttggtaacatttgcctgtgctggctggatgataaacacacttgaaataggtggaatctcttatgaataaaggaagcagtttgaagcattgtcattgtgaatatagtaaactgctgaagataaatttttctagtatatttggagtcttggcatgaaagccttcatcatcacagtgctgtctttttgtttttaatttagtttagtttagtttagtttaattagcttttcagcactttctgcaagcttgagcaaagatattcatgaatatatttctgctaaaccacagtaatgaattatttattttgaaatctatctatatttttagctactcataccagcagtttagagaaataaaaacctttgggatcttatatctgacttttctgaggtgaaatgtgacatgaattgaaaataaaagagaacagatatttgcaacttgcatagctggtaaaaaatcacttctagaatactatacatggagaactataaagcaatcagaaagattcaaacagccctatagaaaatgggtaaggacttttaaaacaaagaggaaaaaacacaaattacttattaacatatgaaaacatgcttaaaatcattgataatcaaggaattacaagttaaactgcaataaggcaccactcacatttactaaactgataaaaattatgaagtccagttgattcaagtgttagagaggatatgaaactgttagaattctcatccactgtgtcaactggaagaactactttggaaaacagtttaacattatttaataaaattaaaaatattactcagcgactcctttctttaagcatgtaccttagggaaaatttgtatacagggatagaagacatgtataacaatatatatactgatactgttaataaaatctaaagataacaatgtaagatggatgtatgagttatatttatacaatgaatataactgtgagaatgaatgaagaactgttatatacatcaacatggatgggccaaaaaaagaaagatagttagaggatgatttaccctaatttcaggagagttacttatggaagaagagtacttaggaaggaaattatataaaaaatggcatcctgagggaatctaagtcactgttaatattctttgtcgtggtgatcggtgtataatactattttatttttaaaaaattgtgcagagattttatatgatttattgaatatgcgatctatctctctcccactaccatcacttgtatgcattcattcacacacacacgaacacacatacacacacatacacacacatgcacacacatacacacacacacacagtcactgggttttatccctaaaacaaaaaaagatggtaaagcataggcctagactgagtgtatggatatagaaaatagaatcatgaaggaaaataataagaatgctctttaaaatgtgatcatattgcctcagtttgttctataaataggtgagactgaattataaataagtaaaattggaataaaaaatgataaactaattttgtcagcaatatcacatccttgtcaccatttcctgagcacttactatattcaggttctctcttcattttttctgttcttcactataccactatgaggcaggtaagaatgtatccaaatttacacagaggtgtgctgtgaatcaaaacagctaaaaaaaaattttgtccagttctaagactgaaacatggccaaggagctgctctgaaattcagattcagtctgccgggcccaggccccattctctccattctgccccaatctctttcttggtttaacgttttctcctgcagggaggcagtgttagagatgaatagactcctagtcaaagtcttaggacaaatgatgtccttattggacttccaaccaccctttctttgttgtaactctccacaagaataagaagttcatattttcacaatattaggtgccatccactgccggcatggtgctgtaatttgctggaaaataatgactcagatgactaatctgtatgaacgcacatgcattttgcaaagtgttgtgtcagagcacgggtcaaatcaattaagtgttttgtaaggacccaattttcatactggaacaagttaaataattgactgcaatgaaaaatgctagggagagtttgtaagaaaattaattgaaatcagaaagcagaaagactcgctcatttccagaagtgatatttgaaatccagaaacatgtggttcattcatttcctctgtccatgatttattcccactgcagcacattactctcttggttgctttgcaaaagtgctcaatcttcatccttcttcctgaggaagaggggtctgtggcaaagtgctttgggagctggagtctgattcaccaggacacagtctggtaggtctgtctctacaaagcagggttcgttctggtctcaataagcagaaaacactaagaacttggagaaccagaagcaaagatctgtgatcacagcaagttgttcttctccttaagaacttcattgacggctgagccctgtgcctcacgcctgtaaccccagcactttgggaggccgaggccggcagatcacttgagcccaggagttcgagatcagcccaggctgaaaccctatctctaccaaaaaaaaaaagaaagaaatatatacaaaaattagcttggcatgttggcatgtgcctgtagtcccagctacatgggaggccgaggtggaagaatggtttaagcctgggaggcagaggttgcattgagccgagatcgcaccactgcactccagcttgggcgacagagtgagaccttgtcaaaaaaaaaaaaaaaaaaaaagaacatcacatattactttgcagctgtaattctcatatttggctgattatacaagttgtttgagaagctaacaggtggttcaaacaaaaagagaatcgttggctccatccccacacttaccaacttaccaagtcagaacatcacagggtagctacatacatcacaggaattctacatacagaacaccttagggaattaaactaagtttggaaactactagcccatatagaataatgcccccaactcttcggcatggcattgaggacccttggcaaagtaatctcagtgtaccccacttcccctgattatgaggggaagaactctatttctcttccaacataaagccataggactttgcattcatttcttcagtaaacatttattgagcatctgctatgtgccagatttgacaggtattatagattgtatcttactctatcattgcatgctcttagttgagttcagaacttctacactaagtaatagcacagcctggcttatgctaaatgacaactgaaacttctaccaaggatagtaaatacctataggcaatgcttccctcaataccagaacagacattgtttatcattgcactcggcattcttcccactgagtccagagacaacttcagaagctttctcaacagcctctatcacaccatctgctttggcatgtgaggcaaagtctgtttgcagcctctgttatagcccatgtttgacaagactaaactaatacccttcctccctccttcactttcactgaggtgactgaacatgtgctcaggctttaggaaaggtaggagttttcagagatagtcattgcttctgagattggtgtgtgggcagtaatgcaccccagggcagaggccccagtctgcacatctctctgtacaggagggccgtgtatttgctattgctagactaagaacatggatgacttttggcactcagacactaccctctctctcttcctgtctgccttgactgtatgtagctacgatagtaatccacagcatcaaacaagttttctaaaagtcccattaaatacaggctgccaaattttgtgattcaattttttatattcaggaatggactttaagttgtgatagcagaaaaggagatgtataaaatttctcaagagaaacattgcattcttgtcttcacaggctggttccaataggaacaggaaagagtaaaatggagagctcagctggattcacacagacctggaattgaatgtcatacacacacacacacacacacacacacacacaccctatagctagctgtgtgaactcatcttttcctcatctttgaaaaaaataggatgtgtgtgtgaataatctctctatcatgagcttattttaactggcatagacgtatacatgagcctcttaaatgccttgttgaccatgcctttatgttctcagtttctggcccagaacctgggacattagggagggtttcaataaatgtcaatcacatcagattacactcagcttatctgtaggcaatttatctaacaatctcaaggatcaaaacactattaagaactaatcagtagccaaaataaatgttcctagaaatatagattttccaagctcatgaacttaattcaaagatatctctacagcccctcatgcaaaacctatttaacattagtttagttcttccaaactactaatactgcttttcaactcactgtaggttacagataggataatgagagcaagagagaaagagagaactagtaggactcaaaaagatactaaccagtgattatagagtgcctgccctgtggttggggcttgataaatgacacaggatcttgtcctcaaaaaacacaatgtctagtggcggtgggagttacacaggtaattccacagtattacgctgttatgaagagctattcagtgccccatggtgtcacaaagaaaggggtaagtggtcactcctagtcagggaattgacaaaggaagggcaagatgggtttcctaaaacctaagatgctttttggatcttttgaaggattggtaagtgtttattagaaaaccaatgatagggagggaggcgatagatagttgtccaatcagacgtaacagttttccaatcagaggaagctggataagcaaaagcaaggaggtgtgaaatagcctaaggccctcaggaatctatcatgcaagacctggttcagcatgacagaagcctactctcctctggaggggttaggcatgagggaaggggaagtccgagaggtgataaggtgagctcacagaggtatttacataccttccatgctgaatttggacttaaggctgtagttcatagagagccattgaaagaattgttttgtttattaagcaagcatgtcaagtactcagatgtggttttggaaaaactactcttgctaagtgccaaggaaggacttggggatgctgagaataggaataggaaataggggaacctgtttggctgctgcagcaatccaagctagaaattgtgaggccctaaactaggcctaagcaatgggactggagaatatggggcagatgaaagccagctggaggtaaggccgcaggatttaaatgtgtggcagatttagggcaggggcagacagctttatacacctcagtagccttgaagatactactgcatgatacacagtaccaaaaatgacatgttgaatgatagtcatgagacttcagaagaatttaaattatgttcagtatactctgtttgctaaagcagtgaagcgtaacatctattttagagaaagttctgcctgaataattcatttacatttaatatatgactcccaaagatcctaataatgagctttagtgtatatgaagatctaaagtttattaagtagctagtattaaagggtctctatcagtatattacctcatttagcctcaaaataacctgctgggaaagtactcttgaatccaaatgcagatgagcaaccctaaagctgggacagaggaaatcaatgtttgaagatcacacggccagcagtattagaaccattttgacttaaaaatccagactctttctactacactgtcattagcctaaacttttccaataagcagccatattctgactgaaatgagaagctattaaatattgtaaaactgaaatatgtgcttggggtttgttgtcccatctttcactttaagatggtgctcaggagtttctgaaacgttttgctgggaatgagtagacgatgataacttctctgaaagaacagccaaagaggacagacagaacatgcgtggagctgagaaaagtattccagtaacagttgatctcattttttttcccttctcggaaatgcagaattaaacctgtgccatcttgcccatgcaaaacacatatcctctgaaatgattttgagatgtaaattaattcccaccccggagcaaatagcaaatcaaccaggcaacctagtcctgtagactaaaatagggagcatcagaccatgactctctcttgcctgactttgggatcctaaacaagccacttaattgtcctatgcctcagtctcttcagatgcaaaaggaagatgataatattggccttcttaagatgttgtaaagataggcataagaatgtcagtattttgaaaggtcaaatattcttacaattgtagagtttatttttattctataagccagttttggtttttgtgtttgtttgtttgtttgtttgtttgtttgttttgagacagggagctcactctgtcttccaggtgggagtgcaatggtgcagcctcagctcactgcagcctccgcctccaaggctcaagtgatcctcccacctcagcctcctgagtagctaggactaaggaacacaccaccatgtctggctaattttttttttttggggtagagatggggttttgcctcagcctcctgagtagctggggcgactataggcacacactaccatgactggataattttgtttatttatttatttaattttggtagagacggggttttgccatattgccctggtctcaaacttttgggctaaagagatcctgccacctcggcctcccaaagtactgggattacaggcatgagccactgtgtctgaccaagttttactctatgtttcctagattaaaaagtagaaaattttatctcattctttttattttcttcaccaaatattctttgagcacataccatgtgtgggtacagtggaggcacagagttgaattagagatatatcccactctcagatagctcatgatcctgctacttaattttgatgtctcttgatcccgctcatgagacatgttgatcatgctgtcactgatgttacctaatttaatctttattttatcttttgaagtaggtatctatccatccctattttatagatacaactgttgagccttggcaatgactgaactggaactaaccccagttattctgactccctaaactcagatctcctttgatcatcacagaattgcttcactgtctcagtgaagaaaacaagtatattcataatgagctccggtaaaaatctgatgacagtgaggaatctaaggtaggaactaaaagctatgagaactgagagaggagaacaattaattttagattaggtcgattctcagaatgtattttcataagaagaaacatttgaaatagattaggaagaataaccagaaaaaaaacagaaaaagaaaaaatgataagcaggaggagcatgtacaaaagtgtggagatgaacaggtaaatgttatgtttgggaacaatgaacataatgggattaaaacgtggaaactgcagactgaatttttttaagatagattaggttcaggtgaatggaatcttgaatatcatgtaaagtaacttgggactctaaatagtaaggattttgagcagaggagtgatgtagacatattggtgatttagaaattatcccaatggcgatgggaaggatggatcataggcggctgagaccagaggttggtaaaccagttggggattattataataacataggcaaggataaagaaggacctggattaaagcacaggcaatgggaataaatgaagaggagcaaggcaacattctaaattatattcaatagtgatagcaatgttagatttgaaggaaagggagaagtcaatgatgagcctgaggtttctggcttgggtggttggatacacggctatgtcattaactaggaaaggaaacacaggagaagaagccagtgttatgggaggaaaattattttttattatgtcaactttaagggagggaagaatggacatcctccccttacatcagatcattgaagccaactttgatgatttgatgtgatgacagtcatagtcatagttaaatcttaatcttaaatcttgttgtttttgtgcatattttatttgattcagttatattgtttgagctaattttagggttaaaataaggtccactgtgctgtgagacttttatgttcagatcatgttcttgccaatatgcaaaacaaaggaataaatgcattttaagggttgtataagtttcttgccttaatatctgcaaatttatttgcatctgggtaacattttgatatattgtcttataatgcacctattacgacatcatctctacctaatcaagggcatagttatgagattaagggccagtaaattgataatggcagacttttgtttgtttttgaaactcttgtcatccattctttttgttcattacgttcttctataaattgtttgcaatgtgatactttacatgttaaaatgaacttgcatttcggttagatggtgtctccaaaaggctggagaatcaaagactgaaaaaaataggagtaattcagtttgctgaggatcagcctgagaccgcatcagtaacagcatttttagttccgtacaaagtaatttggttgtggagaagtcctacagcaaatcagcctgaattgttcagtttaattgtggtcacagagccacttgtgcagtaacattaattacaatgaatgttttagccattaaagcctgccattaatttggttccttagatggattcttaatggtaagaaaaatgaggaggatgccctgtttatctcatttaatgcctggaacacagtaagttatcaacagtttgtcctcagtttcctcaactgcaaaatgcaaatgataatagtccttacacagctggattttgagaattgtaagagaaaagacttaatacattatctagcataaaagcacttaatgccttcattaatagttgaaaccccagtgcagcaatgctttatttaatacccaagagctgggagaaaactcacctcacattttatttacatttgagaaacaaagggcctagaaagaagtggtttttttttcccataaatagatttattgcttgtaaagattttttgctctgagataatttaaataacttctgtagtcagaatgagcttttataccatatgcattgataaaagaatatgtctaaatatctgtataatgtgaaaagctgagaaactcattaccaccatgacataaagccattaggaatttcattaattgctgtggtacagaaagtggaagatctaccttttagttcaaactcagctcagctgtatggagcctaagcctattctatttcttcctaaaatctggaccatctttaaagtagggacgagtgggagcccacttgcttttgctgagaaattccatacaaaccttccaagaccaagtattgcaactctcctgggaatggacatttcacaattcccatggcagctcaagaattagaagcaacccaaagccacctcttctagtcctacccttccttcccatccaatttataaatcctcttctaagtatcctttatacatggcttctcttcaacaacctctattcttagatagttttccctgtatttaatataaaccttgattgcttcaatgtacgacaatacagcctctaattttatgctttttggaccaaatgaatgttctttaagcatgttgtcagtttaaacaagatcatgcatctgaaatgtctgtgtaaattatacagtgctgtataaaattactcaagactgtattaacaaagctaagacaggcaatgatgcaacatatttcttaaatgcaacaatccttaaattagcttcacacataaaagtttatttctcatccacagtacataccaatcagggcttgaggaagggctctgctccacacagtcactcagtactcacaatgatggaggggccacaatcttagagctgcaccattagaaatcagttccttgatagccaaggcagaagagaaagggttgcatcctgacacacttgctcatagaccattgactgaaacatgccacagggccctgcctaaagggtccaggaaatacagggaacagatcagtatttggcaagccataattgtctctttcccagtatttctgtcaaggctaagcaaatctaagggccttgtatttttttacttcccattttaaccttttatttgctattacacttacctaggtttacttttggtttacgatatatatagccattttttaagtagtctcaataaggacttattcaatgctatatggagaaaaggaattattgcatgctgtttaatctgtcaaatgacagcactattttatctttttttttcaagcagtgagaatattgtgacttggagaatattataattttatccttatcagctaggcaattttatgttcgtgtttttacaaatatcaacttcatacttgccaggactggatttccacatgatttttatagagagaaatgatctctctatataaattctttttttttcttttttttttaatatatttcttttttttattatactttaagttttagggtacatgtgcacattgtgcaggttagttacatatgtatacatgtgccatgctggtgcactgcacccactaactcgtcatctagcattaggtatatctcccaatgctatccctcccccctccgccaaccccaccacagtccccagagtgtgatattccccttcctgtgtccatgtgatctcattgttcaattcccacctgtgagtgagaatatgcggtgtttggttttttgttcttgcgatagtttactgagaatgatgatttccaatttcatccatgtccctacaaaggacatgaactaatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcaagatttatagtcctttgggtatatacccagtaatgggatggctgggtcaaatggtatttctagttctagatccctgaggactcgccacactgacttccacaatggttgaactagtttacagtcccaccaacagtgtaaaagtgttcctatttctccacatcctctccagcacctgttgtttcctgactttttaatgattgccattctaactggtgtgaggtggtatctcattgtggttttgatttgcatttctctgatggccagtgatgatgagcattttttcatgtgttttttggctgcataaatgtcttcttttgagaagtgtctgttcatgtccttggcccactttttgatggggttgtttgtttttttcttgtaaatttgtttgagttcattgtagattctggatattagccctttgtcagatgagtaggttgcgaaaattttctcccattttgtaggctgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtgatgcctaggtttttttctagggtttttatggttttaggtctaacgtttaagtctttaatccatcttgaattgatttttgtgtaaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctcagggctctgttctgttccattgatctatatctctgttttggtaccagtaccatgctgttttgattactgtagccttgtagtatagtttgaagtcaggtagtgtgatgcctccagctttgttcttttggcttaggattgccttggcgatgcgggctcttttttggttccatatgaactttaaagtagttttttccaattctgtgaagaaagtcattggtagcttgatagggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttaccagcttaaggaggttttgggctgagacaatggagttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatagtggataagctttttgatgtgctgctggattcgttttgccagtattttattgaggatttttgcatcaatgttcatcaaggatattggtctaaaattctcttttttggttgtgtctctgcctggctttggtatcaggatgatgctggcctcataaaatgagttagggaggattccctctttttctattgattggaatagtttcagaaggaatggtaccagctcctccttgtacctctgatagaattcggctgtgaatccatctggtcctggactcttttgggttggtaaactattgattattgccacaatttcagctcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgagatcggtggtgatatcccctttatcattttttattgtgtctatttgattcttgtctctttttttctttattagtcttgctagcggtctatcaattttgttgatcctttcaaaaaaccagctcctggattcattaattttttgaagggtttttggtgtctctattaccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgctgtgtctttgttctcattggtttcaaagaacatctttatttctgccttcatttcgttatgtatccagtagtcattcaggagcaggttgttcagtttccatgtagttgagcggttttgagtgagattcttcatcctgagttctagtttgattgcagtgtggtctgagagactgtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattgctgggtatccttgttgacttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttactattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgctgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagtggctggttccggttgttcctttccatgtttagtgcttccttcaggagctcttttagggcaggcctgctggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacccgacctttctctctggctgcccttaacattttttcctttttttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccatcactttcaggtacaccagtcagacgtagatttggtcttttcacatagtcccatatttcttggaggctttgctcatttctttttattcttttttctctaaacttcccttctcacttcatttcattcatttcatcttccatcactgataccctttcttccagttgatcgcatcggctcctgacgcttctgcattcttcatgtagatctcgagccttggttttcagctccatcagctcctttaagcacttctctgtattggttattctagttatacattcttctaaatttttttcaaagttttcaacttctttgcatttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgctttttagagtttccagtttttctgttctgttttttccccatcgttgtggttttatctacttttggtctttgatgatggtgatggtgatgtacagatgggtttttggtgtggatgtcctttctgtttgttagttttccttctaacagagaggaccctcagctgcaggtctgttggaataccctgctgtgtgaggtgtcagtgtgcccctgctggggggtgcctcccagttaggctgctcgggggtcaggggtcagagacccacttgaggaggcagtctgcccgttctcagatctccagctgcgtgctgggagaactactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccagctgctttgtttacctaatcaagcctgggcaatggcgggcgcccctcccctagcctcgctgccgccttgcagtttgatctcagactgctgtgctaggcgactccgtgggcttaggagcctctgagccaggtgcgggatataatctcgtggtgcgccattttttaagcccatgggaaaagctcagtattcaggtgggagtgacctgattttccaggtgccgtccgtcacccctttccttgactcagaaagggaactccctgaccccttgcacttcccaagtgaggcaatgcctcgccctgcttcggctcgcgcacggtgcgcgcacccactgacctgcgcccactgtctggcacttcctagtgagatgaacccggtacctcagatggaaatgcagaaatcacccgtcttctgcgtagctcacgctgggagctgtagaccggagctgttcctattcctctctatataaattctatagatacatagagtgattatagagagaaactctctctatatataaattctaattcactatctcctaaaagtagcacatttgcctataatcccagcactttggtagaccaaggagaacagattgtttgagctcaggagttcgagatctgcctgggcaacatggcaatatcttatctctgttaaaaatataaaaaaatagctgggcatggtggtatgcacctgtggtcccagctacttgggaggctgaggtgggaggatcacttgagcatggaaggtgaggttgcagtgagctgagattgcaccattgtactctagcctgtgtgacagagcaagaccctgtctcaaattaaaaaaaaaaaaagtagcaaattcaatgttagatgggagaaactggagctgatatggctgcttatagccaaacattaaaagataatttaaaaaaaactataagcagcagatgtgttgttttcttttttaatccaaagcataacaataataggaactacattctggaatggctgctctgtgttaggcactttacaaagatcatttcatgtaatcatcacaacaccctttgtgaacaggtataacttattcatagccacataactagaagaagaggagtcaggatttaaagtcagattgtttttctttgaaagcctcatttactagtgtcaaggaaaatagcttctgtggccattgctctgctaccaacttcgattttcacaaccctggtgtgaattcatgataacaatacctgctgtgggttagagaaaacattacaaggcagtagttaagagcaccagctttggtgctaggttccctgatgttgtaaaactgagtcctggctctgagatttcctagctgtgaaaacttacgcaagctggtttttaacttctcagtgcctctgtattctctctcaaaaaatgttaataaaatagtatctaccctatagagctgctatgcagattaagtagttactataagtaacaaacttagaacagtatgtggcactcaataaatactggctattaattttgagttctgaccctgtacctcagggatataggtaaaaagcaggaagaaaatgatagttttaaagaacctaatacgctgatattttatagacacagttatttcattcaacctcacaacagcctcattaagtgggttattctcataagagaagtgaaagctgaggcacagagaagcaaaataattgacccagtcacctagctggtaagtggcaaaaccaggaatttatcccacatctgtctgtgctataacagaaatgttgaagtatatttactgttgtgtttttaatagaacacaaaaagattctccctatgttggtaaacatagtgggcacagaatgacacttaagtttactccacacaaatgccaaaaggctggcaaagcccttttttctggctcctgacctgggcaatgcccatgccccactcctgaatgatgctgagggcttgcatccatccagattctctagctgtcctgaagcacctgtttttgtctgttcttctacctaatgctcagcacttgcacactgcctttggctaaatgtcatgcccactctcaaaatcttatttcttgaagagtcctttctggtttcactaggagaaggttggcttttatttgccctagtttctctctttgtctcttgacattttctcatttcttctatctcttctcttttttcttcaggcattgtcaggtttcccaagccccatcctcatggcacataattataccatggtaatgatataccttgttctcgtgtattttcagccttgaatgttgacttttctgtttcctccagtgtgctctgataggaatactcaaagcttcagaattttttaaacatgtctagtaataaatgcttagaaattctctttgagaaggtagaatgtcaccattttcatttgcaaacttcagtagaaaaatactattcaagtaatgttttcaatcagaaaaatatccaaatgttgttcatgtgttaattcttgtttcagtccaagttttagttattcatccttgagtcccaaatcctacgtcacaagagatgattattaaatgaaatgaacaataataaatagaagctattattttgtactacatcataggatgacaccagtataagtagttgaggtgtgtagggggaaaatctcagaaagtttaagtatggctgtatctaggggcacctatagagaagctacacaagctatctctttataaacgggccaaaagtagcagagagggttgtgggttgttgtgattgtatggtacattccctggccttggttactggttgttagttatgcccagatcaatgtctccatcctgttggggaactgatcttaaccactactattttaaaaacttatttcaacatttatattatcatttaaagatcttacttgattctttactaccactgttattatcacagtgatagtagaagaatcttaattatttccatgtaatattttatgattacaaaatgttattttgtaataacattacaaatatttgcaataatgctaccattttatcttcaaactctactgaggtagggaggtcactttacagatgaaaaatttaaagcacagaagcagttacatgatgtcctttttatttcagtcctaaaaagtagaggagtaatttcactataaactacttgaaggcaggaatcatgtcttatgcacatttcatattttacaatgcccagttctgtgcccagcacctacagttgactgagtaaaggaatgaatgatttttaacttagggtttgcctaaattactgattttgacactacaatctgctttatgcctccattctcaccttgtccccttctccattctcacccttctccatcagctgctggcccaggacagaacacattctgtggaatggcaatggctcagcgtattgctcaaaaatcctctatctttagagtttcatttctattatctctaatttttgcttccatttacagccaggatctaaaactattttatatgacactctattattcatcacacaatcctcatttcactgagaacattattccagtttgatggttcttcttcaaccaactaatattccagtacatgacctgattattgacccaacttcagtaacttcattctcagacttggcacatagaccttaagttattcatttttggtgaagcgtattctgattgagttcatgacatttagagtaatccctcacttatgctagccgtattgttatatggaactgggctatcaactcctttacatcataacaaacattaccgaacatattttcgtaagtgtattgacaagacgaatgttttaaacactactacatgcttagcactgtgttagatgctaggaataaatgagtaagatagtgtcttccaccatagacccttagtgactcattgtgactctaatactcagacaagtgactcagtacaaaagtctataataggaaacagagacctggtttgctttgtgttttgtttctcagaagcacatataagtatcttgatgttgtcctttacaagtgttccacaaaattaatgtgaatcagaagactaagcctggcctttcattggatacactttctgacactgagttaattatagaaaaaaaatacagatttctttttcatgattcaatggagcctgaccagtcagccaaaattctgtcattcttgggctagattaagaaatagatgtgtcaaaacatctgatacactacaaacatatttctgttgaattttgcattttgaatcttacctattttctttcagtatataaagtgttcattcattactttattaatgaaacatatcaattgaacaacaattaaataataggtattttgcaaggtgatgtgagagaatagttaaaggttcttgttctcaagaaacttatcgtccagaagaagaactgaggcttgtctttgaaatccctatggtaaaactgtatcagttgactcatttaagaccacttttaacccaaaaaggaagccctgacattttgcaactgcaagttaccttagagataaaccactccaaatcttccatattatggataaagaagctgagagtcagttgaagaattaataccaggccccagagaataaaaggaagaggtgggtctagaatccatttctcagattcatagttggtgttcttagccaccatgccacactgcccctaataatggactcaaccaaaagtacagtgaagggcaatgcccgggcttgcaggctttcggtaatatgttcatgagcatgtgtgaggggcagtgcaaagagggcagccttctctggaggagacctgctctgtctgacatgattaaagattacagaggaaatttctgactttcccctttgaatatttagcattcaaagaatattttttgtcttttgccaaataaaggctgaacaaatggtagttgaacagaattaagtatttcttcttatttaactagtgcacttttactaaaatgaaactctcaagtgagagattatgcaaattagcttctgcactgatccaatagcattggggtgaaaagagcaagagctttagagccagacaccctcaggctggtaccctgctcttatacattttatctgtgagatttagataagtcactttgccgctttgaatcttcatttcttcctctattaaatggaaataatacctatctctcctgctgggttgttatactttttagcaacaatgataataatgcatctctgtgccaatctctaagctagatgttttctatacattatttctctgtaactatacagtataagtaaaacatatagtagaatgcttgtcgctgaaagatatttgtatgcttcctgttactacttatctaatcttcccttgaagaactatcattattaatacattttgtttgaaaatcagaatcttatctactaaggcctatagcagacttatatatcccacaaatacaaccaatccattaataatattgctggggaatggggatggcctatgcaggaatgactagtgctaagtatgaaccagtttatgattttgctgatgagctgtgggcattcctccttttcttgtgaggatactgagaatgtcttaattcataattgcatccccagcatcaagcactatgcctgggacatgatcagcattcagtaaatgtacacagacctgaggtgaaaagtgtctttttggttattggatccccatccttgaattggaaaagtctagagtctgactgtaatattccagtaactttggcctggacagtcttggaaccaaagcactattaccaggggcagtaattcctgtggtcaccatggcaaagattccaaagtcagccggggaggtggctcatgcctataatcccagcactttgggaggccaaggtgggcagatcatctgaggtcgggagtttgagaccagcctggccaacatggagaaaccccgcctctactaaaaatacaaaattagccgggtgtgatggcgcttgcctgtaatcccagctacttgggaggctgaggcaggagaatcgcttgaatctgtgaggcggaggttgcagtgagctgagattgagccattgcactccagcctgcgcaaccagagtgaaactccatctcaaaaaaaaaaaaaaaaaaaaaaaaagagtccaaactcagaattctaaattcaagaacatcaaaatgaaaagtagaaggaaatatgggaacctagtatgtaattctccctaaactcagtttcacttactgttctcttaggatttttatgtggttccatgctaggaccaataaaatggaatgtttgaaaagaaacagtaggtatttcctcaaatctcctttagctctgattaatgcactcttactctttacattgaggcacactccagattcaatgttatatcgtttcaaaacttccacataggatctttttaatttttatttaaatttgggacaagtcttgctggggaaaaacaaaaagttcctctgtagaatcatatctattttcacctgtggtaaaccaagtcaaaattatttgataaatgaacaccataattcaagtgtatgacagctcttatgtcttcttgcaagaatgtatttttttttgagctgaaataatgttatttcctcttgacatgtattttagggtaattctttaacataaaacagagcatcttgcttatagaattattactaagctctttgattaacagtgtaattctgtgttctgtttcttgaatctgagactttccagagaagaataattatttttaaggcagcagttcccaactggactgtctcaatacactggtttatgtcaataattttattccaggtgattttaaaaagaaaatgacaagcttaagcaaaatgggagtaatatgtctccatggaatggacagaagggcaggattagagttgtgtgtcaccaacacatattgggcataggagtgccatcaagactctctcagccttcgaactcaccctcttcatttggaggtttgagatctgtaactgtggacaagtttgttcatgaattcgcaaacttgtctctcagagtgcctaattagtacatgttgaactttctgctacaagagaaagattgccaaaatgaaagaaggatgagagagaagaatgtagggaggaatggagaaaggaagggaggaatgagggagggaaaggggaggggaggggaggggaagggaggggagaggaggggagagaagggtggaggaagtaaggggaaggggagaatgggggaggggggaagggaggaagcctggcggggcaggggagggagggagggccagtttttgcttctcctggcctgtattaagtgctctcccacagaaaccagggtgcaggtttatgtaagaacacagcaattcctgtgagaatttttatgttgaaagttggagataggagtgggtagtggtactaagtagacaaatatatcacccaatgtaatgtgttactattaatgaagtaagtaagttttgcaaattactttctttataaattgggtcagatttaaaataactcttttatggacagccctttcaattgcttgcattccagtatatctttccttggtaggagagaaaaggaaacttatagacatcatggcagaactttattgaactagcccctaatttcacgtgggcagaacccatatctatctttgttagccctagtgcctagcagagagtagtgctcaataaatgtttttttttttcctaaaagttgtggcatctatggttttagggatggcaaattatgatttttatggtaactgtcttttaaattttaaccatgggcatatattttaataaggaaggaaccaaagtagaggaaaaatgggaagagtccaattccatttacactgtacatgagtacaatgatgttgcaaatatttctattagtaatggcacaaaaaagatcaatgaataaagttgtatgatgatacaaatgaaatttgtaggaatgataccattaaaattaacaacaaacattggaagttctatatattgtgactttaaaagtgtataagttgtagctgtttctccctcagtgtcacatactgaccaaatttattatttattatttatttatttatttatttattttgagatagagtctcgctctgtcacccaggctggagtgcagtggcgagatctcggctcactgcaccctccacctcccaggttcaagccattctcctgcctcagcctcccgagtagctgggaccataggcacatgccaccatgcctggctcattttttgtatttttagtggagacggggtttcaccttgttagccaggatggtctcgatctcctgacctcatgatccgcctgcctcagcctcccaaagtgctgggattacaggtgtgagccaccacacctggcccaaatttacttatttattttatttattttttttcaaattcatttttttaagcattttattgtttcttgtaaaatggccagtttttttcaatcttaaaatgtctactttcactttagacatgcttattaaagagctttaaggcataataccacaagtaaaataaacgtctataaaatctgcacataatttgcattaattttgtctttagtttttggtcaaaatctagatacagtcacaggaatgtggcgatatccattatgctggtttggccagaaacaaaattgccatagctacgtagtctaaggcatggaccacgtgagaaagaggtagttttttaaacatcaaatagcaaataagaacagctgagaaaatagagcataatatgatataattgcatcagcttctggagtggagttattttcatacttgaaattaatgtgtagaataaatgcaacattttatttgcctagatatttactctctcaaagtccaaatatcttacattaagaattttgcttaccacaacacattgcttcagttgactgattgtgaagaaagtgtttattcctggagttttgtggaagaggttagtggaagcctcttccctaccagggagctgttattgttgaggcaaggaaagaagcccagagccacatatatcagagaaaaatccaaacacatgtaaagcaacaaggaggaaaacacagtggggaagcaaatattctatactaggcaggtcttgaatgctcaattctatcactcactgtctgtgtggtctgagaacattctttgtatgacttgaatccttaagacttgttttatgacccagaaatataataatctttgttggtaaatgtttcatacgcacttgaaaagaatatattgttgatgggtagtctataaatgctaattaagtcaagttgctaatgttcacatttttgtttcatgtattttgaagctgttattacatgaataaagatttaggctttttatatcctctggataaatttggggcttcatcattgctcataatattctttgctctgaaatctgctttttttatatattaatgcagtcattccaactttcttttgactagtgtcaatatggtatatattttttccatctctttaattttaacctagttgtacctttgaatttaaagtgtatttcttataaacactatatagttggatctttcttttttatccggtctaacaaacagttgctgccttttaattgaagtgccttgaactttttacagttgacatgattgttggtgtcattaggtttaagtctaatcatcttggtactgttctctattctctttttttctctttgcatgtctgtttggaggtttactggataattgttataactccattttatctcatttgttgatttattagctataactctccagatgttgttgttatattagtggttgctttagggtttgtagtgtacatgtttaacttatcccattctagcattactatcaatattataatacttcatgtaccgcattagaaccttacaaagtatagttttctttcttctggtttttgtggtattgtcacatattttatatgatacagtgtgtgtgtgtgtgtatacatatatatatgtatacacacacacacacaaaataaaccccatgacacattgttagtattttgggttaagtagatgtattatatatatttatttatatatttatatataatataaatacaaaatattaaatatatattatatattataaatatatataattatacatatataaacttccatttatatatttatattatatatatttataatataattatatatttataattatataatatatatttaatattttgtatttatatataaaatataaatatataaaatataatatatttaatatttttaatttaataattatatatttataatatcctatttataggataatttaataattatatatttataatatcctatttattataggatataaataggatatatttataatattatatattataaatatatcctattataaataacatatatatgttataatatatatcctattataaataggatatatatatatatatatatatatatattctattaattctgtccctctagggaaccctgactaatacatatatatataatatatcctattatatatatatataatatatcctattttatatatatatatcctattagttcctatataaactattatatatctatcctattagaactaataagatatatatctcctattagaactaataagatacatatatctcctattagaactaataagatatatatatctcctattagaactaataagatatatatatattctattgtttattaagtattaacttagactatcacaaggtcccacaatagggtgtctgcaagctgaggagcaaggagagccagtccaagtcccaaaactgaagaacttggagtccgatgttcgagggcaggaagcatccagcatgggagaaagatgtaggctgggaggctaggccagtctgtccttttcacgtttttctgcctgctttatattcgctggcagctgattagattgtgcctaccagattaagggtggatctgccttccccagcccactgactcaaatgttaatctcctttggcagcaccttcaaagacatacccagtatcaatactttgtatccttcaatccaatcaagttgacactcagtattaaccatcacagtggacaattgttttaaagaagtttaaataacaaggaaaaggcttaggtattcatccacatagttaccattcccagggtacttcctttatatatatccagacttccattaggtgtcatttcacttctgcctggagtacttccttcactacttctttaagtgcacatctgctactaaggaattctttcagcattttatgtttgaaaaaagtctttattttgcctttatttttgaaagatattttatctggatatagaattttaagttgacccttacagtgcaggtaactttaaagatgttgccttcactgttttcttacccatgttgtttctgatgagaagcctcttgtcatccttgtcttccttattctctttgcatgaagcatgtttctttttcctggcataaataaattttttctttttattagtgctactaagctgtttgattatgatgtatcttggtgtgtttctctttatgtttcttgtgcttctgtggtattaagcttcttggattaaaatattcatagttttcaataaaatttggaaaattattggtcatgattccttcaaatatttttcctttccttctcactcttcctacactttggaaactccaattagaggtctattagtctacttgagggtgtctcacagttggttgatactcttgtcattctttagaattattttttcacggttagtttggttagttggttagtaactaacttggttagtttccattgctatgtattttatgttcattaatattttaggcattgtttaatttgcctttaattctattcagcatatttttcattttcaacattgtagtttttatgcctacaagtttaatttggattttttttatatgtttcatgtccctatttaacttgttgaccatctgcaatacaattataaaattgttttaatgttcttttctgccacttctaacatttgtgtcagttatgggttcgttttgattggttatttttttctcccattgtcagtcatattgttctacttctttttatgcctggtaatatttgactaaatgccagacatggtgaattttactttattggggccagatatttttgcatttctgtaaatattgaaatgtatcatggaactgatcttttcaagttttgctgatctcttcaagttttgcttttaaatttttttagatgggagggcagcatttaggggtaattatgttttactactgaagcaagatttttctgagcatactacttaatgccccatgaattgtgaagttttctagtttagctggtgagaaccagcactgatctcagccctttacaaatgccaagtattgatcctactcatccttcaaaatggttctttctctggcctcttgtagtttcttcatgcacacagatgccaatcagtactctgctaaatactcaagagtggttctcagcatatttccagaattttctttctgtgcagctctcttctgatactcttttctgcaaactctagccatgttgatctcttcagattctcagttccatgtcttcaactaagagagtctgccaggcttctcctgggttctttgtccctgcttgatggcctcgagactctgtcaaggcagaaagctggggcagttacctcatttgtttcccatctactaaagattcttgtccttcattgtctgatgtctggtgtctgggaaatcattattccctatagtttgtctgattttatttacttttggttgtttgaagcaggaggttaaagctgatttctctcattccatcttgcatagaaattgaagttccttcttacatctttaaagatgaaagctgctcactacctatctcatatacccttgcagatgccatgtctctaggttatcagatataatttagattcagctaatcaaacttacttaggcaagtcttagaatatggaaatgagttagaaattgtacttccttttcatctgctacttttttctggcatacacagtggttgtaagatgtgttgggtttttctgagctgtgctatcagaatctccattctttagtcaataatttcacaagtgccaagtggttgtgcctagggcatcttctttttagctgtgctgacataggaactgtatcatgtccctggatccaatcgttttagacaacctcctgatccctgtagcttagctaaaaagtacattcttggaaacaacagttctgatgggaggttcttgattactcatcttctagttatggcagaggtagcagctcatcctgcagctttggaatcacaagagtttggttcagctcaggatacagtgaacctataatactttaattgttctgcttgttcaggtcagaatgacaatgtatagaggccgtcagaaaacaggcacttacaaaggtgacttgagaaatgatcagatcacagcacataaaaattttaaaaggctttttaaatcagaaaatgactatattgtatatccttatacatttatttccaaccttaaaaaatactgtcttatatgcaatatttgtatttttgtagttttatttatcaaatatacttgggataagtttagtccctacatatatatcttttatactcccctgtattaaccataaaggaaatttaaattgattgaagtatgtctacatcatctttaaaatcagtacatgctgatataacagctatttctgcaaaagacagacactgtcatttgagcttcacttttggcttcaagggaccctccacctttctccaactccagtttcataactttgtgcctgcaaaagaatgtggtgaggggagggcttctctaggattaattacagagtttagaataagaaaattaacatgtctaacatgcttattatgtgccaggctctgaaaaatgcttttatatattaccccatttaatcattacaacaaccacatgagaaggttttaactattttacatgtgaaaaacatgagactcaaaagttcaccaactcaatacagaagaaagctagaattcaatccaaatctatccatatcaaaagcttgctctttccaatgtgttatactgcctcgaagcactgttgtaaattgtgcttctccaggactgaaccacatgtagttatcctgtattgggggacaaacttatctgttgttcattcaaatgcacccagtgatacataataccagggctcagtttgcttagtataaataaaagtttcctacattttagcaaaaggtgatgctaaaatgaaaataaataataaaatgcccaatttttgacaattatctactcttctcaataaaatgttacctttattaggttagattttccttaggcttccaaagtttatattcctagaaatgaaggtaatgatttttgtgtttttctgggacgggcagtgtattgttagtctgttctataaaagaataaggttgcattattcatcagaatcattttagtagtaaatagactttgatatgagaaagaagagagttctgaacagtctctgaattgtatttatgccaaatatgtaattatattactctgcaaatgaactcagtactaagacacttatagccacatctcttatattagtgataatttaggcatttgtttgcctaactgatgacatagagatgactaagaccgaaatctgacttcagttggagactataatcaccatttggaattgctctttcgtaatcattttaataggataaatcacatgttacataacttcataatttatttagtcataaattgattctaatcatgtgaatcgggcatattttttactcctaaagtaaataaaccaaaagatttattaattaggttagaccaacatatcaattagttggggaaaaaaggagtaaaaaagcatattgttttcaaatcataaaaagctactaaaaaactaaatggcacatgaaacatttaatctggcagaataattccaattaaccagaaagccttaatgatgctgtaaagtgatggggcaggggtagtcttttgaaattagaagagtcaggttcaagtccttagtgtcactatcattatttagatggttatcaggcagaagagggagtggacttattctctgtaacgaattaaggagttcattcagagtaagaaaggactcttgtataaccaagagacccatccaacaaagagtgagttgcctcactaaggagtgagctgcctctccacctcagcagatgctccagcagaagctgcatagctggccattatgcatggtaaaaggcattccttcagtggttgagtgtgagactagagttttccatagaccttctgattttggatggccttaaatcctcactgcgcatgtagctttctgggattctgtactgagtattcaattgccttgaatagggggagataggtctgctacctgtctgtatcatcttacttttttcttagaagctcctaggttttatcactgacctcgaaaggtaagatatttggtcttgttttctagctttgtgattttctgtcaatttccaaccttccttttctcaaaatttaagagttacacagctggtcagattatgtctcttatcactgactcatactcctaatcttcccacctgtatcttctcacattcccgtttctatttgccataccccacaaagtccttaatacttgtctgtaatagatgacttcaagcccaaagggtgtatgcttttcaaatataaaacaaaaatataaaataatgaattatagtaagttggagtgaaggttctaagattctttattttaaatatttttaacattaaaaaatgtttactatataaaattaggaggatacagaaaaatataaagccaaagataacccactcataattccaccactgcaaaggaaacattattcttttagtatatatgctttgtatctttatatataatatgtaaaacaaaattagaatcacaccatacagagagttctgtcttcttttacttagcattatattgtgatcatttctccatattattatatatactttagaaatatgattttttaaatgagtgcttgatatcaataaaagataaacatgaaatatgaatatattaagatcaacacatcagacaatgatgttgacattagccattaaaattcacctttgatcccataccaatctctggcatctttctgactataatcagctttccatttagaatttcctacagagagaatatgcaatgaacagtttcagtccgctcatcagtaatatttctcactatatataacaaactatcatcgtgcttattaatgcacatgcctctcttctgctgaataacagtacttttttttttttttttttgagacggagtctcgctcgaataacagtacttttatttgcatagtcattatttaatttaatccttacaaattccttgtgagtaagcagagtgggtgatgcaatctctcttttaatgaggaaaaagaggctcagaaagtcatgtaaagtgttcaaggtcatcttaacagcgatggacaacgtttgctagaaaaaaaagatttgaaagttcataagtggaggaggtagaattcaggccagattttttttttaatttttaacttccagtgttcttaatatattattctttggcctcttgcatggtatcttgatttaataaacatttgttaaattgcttgagttaaagtacttgaataaacaaaacaaatgtatttcaaaaagaaaaaaacccatatttatttaaatatagtaaatagccaggtttggtggctcacgcctataagcccagcactttgggaggccaaggtgggtggatcacctgaagtcaggagttcaagaccaccctgaccaacatggtgaaaccctgtctctactaaaaatacaaaattagccgggcgtggtggtgcatgcctgtaatcccggctacttgggaggctgagacagaagaattgcttgaacccaggagttggaagttgtagtgagctgagattgggccactgcactccagcctgggcaacaagagcaaaactccatttcaataaataaataaataactatagtaactcatctgtcatttaacctgagcatagatccctatacccttttcctcctttactatttacctgaagttcttcagattttattcttttcaagcttcttggactcctgtatcatctgtcaccactgaccattatcacattatgaatcttcctcctcccctgcattctgtgacattttcctctggttgtcttcatgtatctgcccactctcatccatagttctttggatgactcttccctcttcatctaaaatgttgttattctcttgggttttacattcagcttttttccttactttaattttacttttatttaccttcctttacttttattctgaagtgcttcagaataaaatgataaaggaaattgatctaaactattaagaaaagtgttttgatgagaatatgtgttttcctgagtattctaaaaatagccataaccagtaatagtagtaatagtaatgatattccttcacatttggatagtcatttgcagtttacagggtgcttacattatttctttaaattcatcacatggatcctgggaactaagaagaattttcatctctattctgtacgttaataatattctgtacgttaatacacatcacaggtctcagagttttacctgtgaactttggttgcagagttttgatgccccccagtagactcttgtaatcggcatatgagtttgagggggtacatgtttaaggtgctagactgatgggacccataactagtgtgcttgatagtgatagatatttagaataatagtaacaactggatatgaagtagataccatgtcccagacactgctaagtgcatgaagtgaccagccataggtttaacttcttttttacagacaaggcagataagcttagctcattctctcttttcatgggggagtgtgatggaaagtctgactctcattcaacatgtcctcatgaagctagtcccatggagctgtcctgtttaaacggatgtcccagttctgctgcagcttgaagaatttttcagatgggatgaatttttctgactggcttgctgagtctctccacatggcccctgccatggcagagatcttcctaataccctgctttgttaaccagccccctgtctaggcagtgttttcatctttgttgtgtgacatgtcctctattaactcaaaatcccctttctctcctcttcactgcctgacttacaaggataagagaaactatccctgggtttgactctctctgcctcctacattggcatcatatcctggaacaatcattacataacagtcctgggtttgcatcccagatcagcttcttagccagaggcttttgtataacctaaagtctcttcaccactctgatctgcaatttcctcatctgtaaaatgaggattaaaatgttgaagagaaaaaaggatataatatatgtaaaggacttgacatatagcaaaaaattcaataagatggctgctattattaagatttttattctgatacttgatctgtactgtttccatttttctgtgccattctgcctgtcatatgcctcctgacatgagcttactgacataattgtcagaaagaaatagcactgtgatttataatggccttcagagactgtcttaagaatttagatgtatttcattgttaaacgaatcaaattcagaattaaaaaaaacagcataaagctttcaatagcaacctacttttctgtacttaaaacagattttttaaatgaatttattaatgatatttcaggaatactaccacccaaagaaggaaaaatctgtacttcagatctctgaatgactctgatggtatacctgaaactgggatgttgtgaaaaccaacattattcctttgagacagtgataagtaatttaactctttctgatttgatttctcattaataaatcgaagaaacaggaaagtaaatgattatggaagtagggcttcggcttaaacatcttaagtcctctgatagcgcagcactgtggataggtcaacagacaagaaataataatgaatcacagatgtgaatgcgattttacaaagccttttccttccatgatcttttctgaactcatgacaacctgggaggggatgagagatagaattatctattggacatttttcaagcttcttggactcctgtatcatctgtcaccactgaccattatcacattatgaatcttcctcctcccctgcattctgtgacattttcctctggttgtcttcatgtgtctgcccactctcatccatagttctttggatgactcttccctcttcctctaaaatgttgttattctcttgggttttaccttcagcttttttccttactttaatctctaagggcaatctcagttcactgaatgatttccattagctttaatttcgacctaatttggtagttgcagcccaaatctctctcctgagctcctgatatccatcccactgttactggacttcttaatttgtatgcccctaggtacctcatgctcaccctttgcaaatttctcccagccaagtttctatatcactttgtctggagggatgacaacactttccatccattaccttagcccaaatcctcaacatcatccctgatacttccctttctcttcctatcctcattcaataattcacttaactctgttgactctgcctccttaaaagctctcaaatactcatccccatggctactaccttagctcggacactcatcattacttgcgtcctcttgcaacagcatcctaatagtttttcttgcttttgttctctgccacctgccaagccaatcatactgcagtcagaatgatccttgaaaatgcttacctgtctgtgtccttacagacaccttatttacatatataagatcatacgccttatttacatatatatgcatatggagagaaagagtccctcatttcctgtagcaggatacacaaaatactctctaatctagcttttactgcttctcttcaattcttcagtttttgacattctcaaatctattgctttgtatgatccttatctagccatatctagctggactgaattccttgcagtttctacatttgtcaaggtggtctcaggtctctataccttgtaatgcaactcactctgcatgcagctgccatcttcactatacttatgacagcctacccagacagactgtgctccaggtcctgaaggaggtttcccctgaactctttcttcttgggattaagtcctctgttgcaatctacgcctttagcactagttgctgaattacaattatcaaattaattttctttcctactagactctgccttacttaccttttttatgtccagcaccccaccacctaaaacagtaaatacttagcacatataaaatacttaatgttctttggataaaataacattttatagttgggaaaacgaagatagagaaaggccaacatcttcccatgagtacatggtagaggcaaaaccaggttcccaatcttccaattctttctccaacttttttattctattgctatttctgtaaaacagtagccttaaacatagactaaaaaggggcttttataaacagtttagttttaagtccatgaagcctttgcaaagaaaacatgacttggctaagtcaagaaaatattatagcttgggatctgcttagatatgactcattcttgtgccacccttctgaggttgagaatgctgagctttgtcatccctgattactccaggctttcaacgagtcacccgaaacttaagaattagatggctccttcctgtttatgtctctgtttccatttctaggaggtgatgattttcaactggattaaccgttcctgtgcaaaaatcattaccccatgagacggagtcaagatgggataaatagctcatcccaagtattatcacagcactaaaataaatttgtgtactttctagtgatcataatagcacttactagttgtttaggcactgttttcagaaatttgcatacagtattttatttactctcatataagctttatcataaaataaattgcaaacacctactgtgagatgttctgctactgtgaggcatttaacagattgtttttgaatgaaagaatgtttctagcattgtgaggatacacacacacacacacacacacacacacacacacacacacaccatgccctctgcccttagcttttatctaattgggcaaattggtctactatataaacaacaattagagagaaagagaattatttctttaacacttttgtgctagacactatgttaaatactatatataaatgtgtggtaggtgtatttaaatctttacaggaactctatgaggttttctaggtggtcaagtgtaggcagagccagaatttaagtctagcctacttggctcttccaattccatcacatgatatttagaccaaatgagatcacaaaggaatgcagagggcaggggaaaaggaatgaaattgctggaaaagacttagtcggtccagtgtgaaaatgtgattgggattagatgggcagaattcgggaattcagtgggagcacaggcttcaggacaggcacccacagatagaacataaagttgctgacctattaggaaaatggatctcattcctctatgtccagtatctatcatcatcactgggcctgtggtttttccaccagctgctcccgtgtaataactgagcagttatccttcaacttttatacaatgactaaaaggtgaattttaagccacacatttcttgtgtacccttcttctgggaaattatatttctaggaaagtcattttgtactagaaatcaaaaatatcttagtgggtgcaacccactgccctgaaaatgccattatttattaatccaaccagtaggacttcatgaaacagaagggatgatgttgctattgcagaaactctctcattggcaagtaggggcctgcaatatggcatacagaaaacaggtacactcttctggactgggaaccagactacctaaattcagtcctggctttgtactaagtacagttattgaaatattcttgaataagtgtctttaccttgcagaaccattcaatagttctcctacctgtgaaatgtccaagttggagtaactcagagtatcctaagatgtcctcttcaaaatcatttgttacagtgtttgtgaaacaactgcatatcatatacccttcttgtagattgacagtgcattgaaatctctgatggccctgtagaaaacaaaccaattcaacagtgattaatccaacatttaaataattatttgacaagacatactctgggaaaaatttcactgtgtactctgcactgaatagaaatttctggcagttctgagaaaattcagtttgctttcaaatatgatttgtaagttgcctctaccatgttctcaattcaagttactgacgttttaaaactgcacaagggcttaataaagatactgttatattatcctggctgcctttttctctttccccagtgttctggtgcaaattaaagtgttttacataactctaaaggtagtgaagtaggaagaagagaagatatattgtttttgctttgtttgctgagtgaacagtttgagatgtgagttaaggatgcagatatccacccttctgggagcttcagattgcagttggaactgattctccagcacaatggtcatattataatctcagtactcagtaacagagtactgaggtggcctttggatttgtagtcttaaagtcaaattatagaaatacaattatcttatcatgagggattgtaccaggaactatgctagtgaatggcaacatgatagtcattaagataggcgcctgccctcaaggagatcatagtccagtgagggaaacagataaagaactgcatgattgattataatacagttatgtaaactgtttggattaggtaatgcataaagtgcaatggcaacttggaatgaagttctttgactagaagatatttgcaaatccccttccttgatccaatcagtgcagaaaaaaaaagaaattcttcttatgtttgtttgtggctgattaactttttgtcttgaccagcataatgatcatgatgatgacgaatggggaggcattataagacattatgagagatggaatggttttatttaatccttgttgcaagattatcaatcttctctaaacaagtagataacccaccaataataaatgcaaacaatcattcactcatgtaactttcttaaaagaattttatcagtggatggagggttagatccctcagtaaaccccaaaaacatagatgccagaattttttcctttgcatccccatatgttacctgccaaagcagcagaatttcccctaatgaattttgggttattatgaacagctaaacagaaaatgaaacttagatcctggagtgaaatatccaatttacaggtagcaaccttgtgaagcaatgaggggatgagtgtcttaagcaaggccacgagctagtcagggacagaggcaagactgagatctagggctcctgaccccccccattccagtgcactgtatcgtgctcctgtctatggtatcttaggacacttgtgaatattttcaattttcatctaatgaatttaacatttttctaaaataagtaattgggtggaagttaaaaaagaatccctaactaataccttaccttgtcacaagaggatattcatatgtttcaaatttattatatccaacataaacattcccaccaatgattttatcatagaaaacaaaaaaaaaaacacatgaaaaattaggtttatattactgatttccaataatatgttggaacaggcccatggtgagcaattgaaaaattctggccaacagtctaattatctgctatttgataaaaaataaatcaaaacaatggataatatcactgtcagttttctctcagacagaagtatttcaagaacccaaatgctacgaagacagtgaagtgcttgagactaatatgaaagagacattgaaataagatgaacataatttaaacagcaaccctataccatgccaaacatttggtaaataaatacagtttcatttagtcctcacaatgactctgtaagataagctctcatttttaattagatgaatcttggctaacacctatctaggctttaatttcctcatctataaaataaggatgtttttcaccctactcccttgtaggattcttgaattctctcttgagaactcgagataatgcctgtgaagtacttagcagaggacccagcacctagtagttgctatataaaagtagcttttaacacgattgtactcttcagtcccatcattaagttttacagaaagttgtgttttcgaatttacttctgcaacttttagaatatagagagcaggtaaggtgaagcatgagcttccaaaaccctcacctgcagctacgttaacacttccaatgacttttctttattaagaaaccatgtcagaaccatcccaaagtcctgtggattttatttacaagacccttcactacttcagtaaggggatgatcaaagaacgtttaatttagaagtttcagagttaaagccagtagtaaagaattagggaggctgggcacagtggctcatgcctgtaatcccagcactttgggaggccgaggcgggcggatcatgaggtcaggagatcgcgaccatcctggctaacatggtgaaaccctgtctctactaaaaaaatacaaaaaaattagctgggcgtggtggcaggcacctgtagtcccagctacttgggaggctgaggcaggagaatggcatgaacccaggaggtggagcttgcagtgagcaaagatcgagccactgcactccagcctgggcaactgagcgagactctgtctcaaaaaaaaaaaaaaaaaaaaaaaaaagaattagggaaacaaaaacagaaacattactgccaactccccatgtgcagagaacaacctactagggaaatcttaaagaccagatgcagattggtaaggcgctcaagaaatgtaaagaagtggagtttgccatccagatttgttccatattagtttatccttgatttctaattagaataaaaagtaacatgaaagaacaacaaaattttatagaaaaaacctacttcaacctcactaagttatcatattttccttagctatgtattttttcaatatactgaaaacacagattgtactgatatgtacctatttgcttagaaacaatataaattctattggcataataataaaaataaactaataaaatccaaccattttccctgttctttattcttctcattattcaaataaaagccttaataatgattatcaattatagccttgtatttctatctcagagttctttccagagtctcagtgaactgagtgcctgtactaggatcatcaccatctaacaactccccagggtggtcaggggtaaatggtacccccccacccagggcatcacagggtcagttatgacatttatgcgaatcaaaatgttgcaaggggtgagtctcagtgcaccacagatgctcccttagtgtcatgttcaattaatgtaaagcttgtgttgattctaagagttaaagcgtcactttaactatataagagtgtatataaagagtcactttaagtcttacaatcacagttttattatctacagaataggaatactaaggccaggcacggtggctcacgcatgtaatcccagcactttgggaggctgaggcaggcggatcacgaggtcaagagatcgacaccaacctggccaacatggtgaaaccctgtctctactaaaaatacaaaaattagctgggcgtggtgctgggcacctgtaatcccagctactcgggaggctgaagcaggagaattgcttgaacccgggaggtgaaggttgcagtaagccaagattacaccactgcactccagcctggtgacagagcaagactccatctcaaaaaaaaaaaaaaaaaaaaaaaagaaagaaatactaagtcaaactttgcaggattattgtttatgttagaaaaatattatgttcctactgccctacctggtacttattagtaattcagtaaatgatagctatttatattattatctttgtaatctaccttctcttcatcatcttctttaggtctcagtgtaaatcaaagggaataacattgcttattccaaaggattaccacaaggactaaataacacaggtgaaggtgctttgtcaacaactctcagcactgtatgtgattcttaaaaagaataattaacaaacagactggagcctctggaaaactctttccactaagctacagtacaaataatagagtctatgatctttaaggaaaaccaaaattactcttcacttgcagaacttacagagactctttacttgcagtctccttacaaatgactgtcagtgccaggatctgaaggtccatgggatgcagcatgcacaggtagagcacaagagacagggagcaggcactaaatagctcaccactaacccctctgagtcctggatgggtgggttttgtcctccaaatagcctctgctagaacaaaaaaggggtattcatatatggtgtcagatgcagagtgatatggtttggctctatgtccccacccaaatctcatgttgaattggaacccccaatgttggaggtggggcccggtaggaggtgactggatcatgggggcgatttcttgtgaatggtttagcacaatgctcttggtgctgttctcatagagttatcacaagatctggttatttaaaagtgtgtggcaccttccccaacgccttgctcctgctctggccttgtaagatgagcctgcttcccattctccttctgccatggttgtaagtttcctgaggtttccctagaagctgagcagatgccagcatcatgctttctctactgcctgtggagctgtgagccaattaattctcttttcttaataaattacccagtctcagatatttccttatagcaatgtgagaatggactaatacacagggggaaaatgatttacggaggacttattcttaagtatagttacaatcgaggaccctgttttattggtgggaaatagttttttccccctcttgactttaccttccctgtggaagaaaatccctgatcattctacgtcagcaatggaatgaattaacagattggaaagttaaggtgcagaaattggacatatataacctaatcctctgtcttgggagtagcctggatcactccagtttttagtggctccttaatcagccctttatttcttattttgagaaacagacattttagactgaatagaatttccaccaccatccccaacccactcctccaacacaagctcacattaacatccacctttaatctagctttgactctcaactctccatgttcttgtacttttcctccaaatgtaggcactcttcaaagttcaggtcagctgcggtggctcacacctataatcccagcactttgggaggctgaggtgggtggatcacctgaggttgggagtttgagaccagcctggccaacatggtgaaaccccatctctactaaaaatacaaaaattagctgggcatggtggtgcacagctgtaatcccagctattccagaggctgaggcaagagaattacttgaacccagaaggcagaggttgcagtgagccaagatcctgccactgctctccagcctgggcaacagtgagactccgtctcaagaagaaaaaaaaaaaaagcaaagttcagcccccatccttcccctctctttcattatactctcttgaaaatttcttctaatttcaccatgtatcagtaatgattaagtttgactacatataaaaagcccagaaataccaaaatagcagtgacttacacaagaagttactttctttcttatatataagaagcatcagggtaggctcttcagggtgagtatggcagctctacctacagatttaccaaggacctccaggttccttccagtacccttatctgccattcttagggtttggtctttgtctttagcatccaatttggctgctggagtgccaggcatcatgtcctttgctaaaagcaaacagcttggaagataaatatgacctcttcctttgaagaagactttctggaagtaccatatacccctactgcttacatttgatgtgtcagactataggctcatggatatagctagatgcaaagaaatatagtattttaggtacatggcaacgtacctggttaaaacttggaattctgttaatttgagagagaaggataaatggccaaacatggcttccgtgatcaactgtggaccaataacttaaatctgtctctagccacaacctgatcctaagtgtaaattctcatttccagccacctgcttgatttctccactaacaccatatccaaaacaaagtaccttcattgaatctcatgcataaaggaataaaaagctcctatttacctgaaggctgttgatacacacaacaggaacaacaagattatgcgagtaattctcccttcacatggagaatgacaaatttgaaagccctgatcaggcctccatctacttttccaggcagatttcccccctgcacacccaagcaaacccactagactccagagattctgtacaatacataatttcctaaaccaagtgcattcttttgtaagtcgatgcctttgttcattctgtttcctcaacctctaatgcttttattttcatctttctttggccaacttgtattcattcttctaggcttgcaacaaatactacctattccatgaagccttgtctggttccccatgattggaattcatgttacttcttcttcaatttattcagcagcatgttgttcatcattcccttatgcatcttttacagtatgtcttgccctgtatttatgcacatctcatctgccatgctagatgagaatctcgttgatggagggggccagattttactcatacacacacacacacacacacacacacacacacacacacacgacatctagcactgttttttaccgggagtaggtagttaattcatgtatgctgggtaaatggaaattaacatgaaagtagaagctttaattagtcagtcaacctctgagggctaatgatgtgatcctcctctctgggagaaaagatgccctccagaggtagagatacagtggcaagtccagacacatatcacaaacagatctgggttgaattcctaactttcccacttacatgctaggtgaaattgatgtctgtgaaccttgtacgatagagagaatggtaacaaatttacagtgctcttattattcagtgccaaggtatataaagtgcctactgtagcggttaaccaatagcaggcattcaataacagttagtttccttcctcactttctattcctcttgaacaccatactaacagataacaggtagactaaggcatctttgcctgaaaaaaatacataacatgtattttcatgttgtatgtctataaagattgacagaagataataagataaaagttttttaaataaaaaattttttaaatttctgacagttttatcaaaacaacactaaggaattatttaaagccaataagaagatgtattaaatgtatgagattctgaaagcaaaagttgagaggaatgaaagagacagaacagcaaagaaacataaaatcccagtgggaggttttggactaagtaagggactacaactagagccagtttggagaaattatgaactatatgactttatcaagaaattacagaaacccacatgtctgtggattatcaaacaaattacttcacttgaatacatatttctctgcctattttatagattccatattgtcctcctgcttggagttggtaactccatcttctctaactgattaaataaaattgaaaaaggccccttgtggatattccttcctgccagaattgatctaaatctgtcctaggcaatgagcctcttccttgacaaacagtctgccttgattaacttcacaacaagttagttcccttagagcgctcacccatctgtaaaacaggaaatcctcctccccaccaccccagattaccaatctgtagggcatttcttcaaaactcaatacctgctttctttttggcagatttgataggaatcaagtattcattttacttaattatttcactgccaattgcggttatgcctaaaactcaaagatgaaacacctacaagcaacataagcctgtttgcaggtttcatttatctatgatttctaacctttgattcaagacaggaagcacactggccaagtgtattgccatgatgcagagcctagaggattaataattctttgcagtttgtgtcaaatatccctgctaaaattggaggtaacgagaaattcctaaagacagatgagatctcaactttaaagttatcactccaaacttaggttacagaacattttcccttcgctctgtggttaactcttagtaccatcaaaagcagcctggggtcttgcagaacaggaacctgtcatctcatcacctcatcattcagagtagactgtccttgtttttctctacagattgtacatgcttttattgttgcatttaacaaacaaaccaaatagaaagaatttgcttacagtacttttttgcctattagtctcataaattgtgtgaaggcagagataccatcttgttcatcttttgccttcagcactgaacacactatttggagttcttaagaaacacctaagaaatactgggacccaggtaagaagagaaaacagagaacaaataaagggacataggccagtttcaaggtggtccccagacaattgtaatcatggttgttgagattgtgggatggaaaaacacagtcatggcttcatattatgggctgataattagagttctggatcttgctggtttgaagtaccactggccaggggtcagttagacagcctgaatgccttttacctctggttccttgtctagtcatcttccccgcatcatcccagcttgccttccactggatgctgacttttgtagcaataattaatgtggctgagtttctcatgcttttctgcccaatttatacacttctatcagagctgactggccaacttcaggtttcccaattacttccttatcaaagcccagcttttgctaacatgcaaaaaatggtatcgggctgggtgcagtggctcatgcctgtaatcccagcactttgggaggctgagacaggagcatcacttgagtctaaaagttctagactagcctgggcaacatggcaaaactgcatctctacaaaaaagacaaaaattagctggcagtttggcgcacgcctgtggtcccagctacacaggaggctgagatgggaggatcacttgaacccgggaggtggaggttgcagtgagtcacgatcgcgccactgcactccagcctgggtgacagagtgaaaccccatctcaaaaaaaaaaaagaaagaaaaaggacaaaactgaaaatatgtatatatcaaatagaaatctctctttctttttttcttctcagtagaaacgtttccctgcctgtcaaattgccctcagtccatacgcatgtttcgctggatgtgctattgacttcctcctgggaactttctcttgttttctatgaatgtgtcaaacttcgaacgagatttctcttcttccaaggaaccaccttctgcttattaatataaacagcctctgagcagaaagaagtcttctcctcaaaacacgtgccataaatagctactgaattctgttgagtggctgtggttactcctgtgaggactaatcacagtttcatcctgcagagttcctgtaattagagttcgggacaccctggtgttactctagtaatctcaaggagacttgttatatttgctaaaaatgctccaaggagaattgccatcaagctttcattttggaaacaaatagatgtctgtgagattggaaatggctgtgagattggaaacaggtttagagatgtcatgatatcaataaaagaagagaagattttcttcatttacagtgtttgggaactaagtactagattgaagattttcaagctctgatttaagtagacccaaaattcttcttagggacctgaggtatgctctgcagttggagtggaagagaaaccagaaattctgtttcccctgtctgcaatcaaatgttttatttttatatttctagaagtttccttttgaagaaaaaaaaatgatatattctggtaataaaattttgaaaacattgcccatagattttggtgagagaaacagacagactgacaaacagataggtattggccaaagtaaatatctgagacctctgtccatcctattgccaccactgtacccaaaccatcatcatttggattactacctttccccactacctgggatctcaacatcctgtcttgcccaatctatggttctccaatccattctccaccctaaagccagaaagatctgttttcgatgtaaatctgatcatctcacatctgtttaaaatccccaaaggcttcccattactctaaaaagagaaagtatccttcataagatctacaggattctccatgacctggcctctccttccctctggtctcatcttagactatcccagacattgatcttctttcaggtttgctgcctgctgtttcccactgcagagcctctgcctgtgcagctccctctgcccaccctgctgctcctgctgtgctcagattagacagcagctcctcttggaagccttcccaacctggtccctccagaatagtttccatttctctccactgtatactctcatggattacttgcccatctgctttttatgatgtgttgtactggtaattatttcttctacatctgttttgtctctaaattccaaaagtgccttgtttctgttattcacactgtatccccaaatacctaacataatgcatggcacataatgagcatttattgaatatgactgaagccatgattgcatggtttcaggcatctaaaagttacactgtattgactattttcagagcagtcctacagcctctgattgctttaccaactggaaagatagtactgtggagtagagcaaggcccattgcccagtcagtccagcccaatggaacatcttctgctccaagctcccatagtatttattgccaatagaaccactagtcccagatctggcactgaggaaggacgaggtaaatattgttagatagatcaatattaaaataaatgcaaatttgtactaaatcattattgcatcccttaaaagttgagttgaaacataggtttctgtgctgatacatattattattgcaattttttcatgtatctgtataccagcctccctgatataggagttttacatatgttacctcaatgaattcaaacaatatctattcaggcaggattagtctttaatttacagagtaggaaacagaatttaagaaccttatctatagccacagagcaagtaaacagcaaaacaagtgttcccaagtcttacaaacattttccattatcctgttgccaaacatgttgtcaatgttcagtaaattaatgagtggatgtatggatgacttacactaggtgcatggaaaaatgtcccagcttgaaaacctaagtgctaaagtttaaagactataggcctggcatggtggttcattcctgtaatcccagcactttgggagaccaaggcaggaggattgcttgaacccagggcctcaagaccaacctgggccaacaaagcaagacctagcctctacaaaacatgaaaacattagcccgacatggttactactcagctactcaggaagctaaggcaaagatcccttgagccccagagttcaagtttgtagtgagctatgattgcgccactgcactctagcttgggtgactgagcgagactatcccacaaaaaaaaaaaaaagaaaaaaaaagaaaagattgtgctattggaataaaatactaataatattcacataaactataaatactaaaagtataaacataatgtactggatctctttaggttttttcctctaaatttctgaactattggcaaatgctagggacattttctacagacattttattcagttaaatagagctactgaacagaaccttactgggtgaaagtcagactgcagcacagtgtttcagctatcagcaatttttgaacagtcactgaggaaagagtactaaaagtgtttgcaaaaatgtgtacaagaagagaagagaatgatgaggtgattccaagtgacttacaatatgtaatagcacaacagcagcagcagcaaacacacacacacacacacacacacacacacacacacacacacacacggtgcttacttcttactttgtgccaggtactgatctgagggcttttcatctataattcattaatcttcacaacaacttgtgagatagtttctaccatgttttattgaatctaggttgtccttgattttaagatgtaccctatgtgttaccaaaaaaggaaaaattctgccaattcaattatgagatggcattgatagtggaaaaacatcttgattttagacataaaaattttaaaaaatcttagagttgatgtcatacaatattttaatcccattttacagatggggaaacttcaagagaccaaacaagatgaggcaattttctgaagttcagacagtttgtgttctgaatttagttcagttcagtttagcctggttttgtgagcaccttttcctctttgcaaggggcacagagataagtaagacttcacctaactctcatgagtcaagaagtctagaaggaaagatacacctacagataaatcaactgaaatgtagcctgctaagcataagaataagaccacatacaaggttacaatgtggcacagagagtggaagaaatagccttctcttgatagattcaggaaggattcccagagaaagtcatggttttcaaaaaatgaaagttgcagaattttttatattgatcaatacttctactttcataacaatgttagaaaaaattcttggccaaagaatttgatttgcactttataaattgtggtcatgtgtgtctacaagaagaaaagctgttcagtggtccagctcatgtgcatgtttccaatgagacttaggaagggggagaggctgaaggaaggaagctgagccctcaagaatatgagattactatattacagaggcggcttccactaagaaaatgcctaaagatcaggctgcttagtaggtaggggtgggcagatgtgctaccacccctctgctagtaaatctggatgaatcatctccccattcaccaacttctttatgagcacctgatgaggcttcctaggagctctacaatcccagagcagcaccctatactaattcctaacatagcacatatgagactcaactgtaactgtatttacaggctttgcacttgttgttccctctgagatcactctttcctcagatgcctgtatatctaactccctcacctccttcaagccttgcctcaaacatctctttttcagcgagtcctaccttaaaaaacaccccatttgaaaatgcagccttcactgtcaccatagccctactctattccagaatcctgatcccccttaccgtgctctatttttaactttttccatagcaacaatcaactcctaacctatcatactatttgcctatttattatgtttattgttttttgccaatctcgttttactagaatgtaaaatccatgaaggcaggaatttttatctgtttttattcactgatagatcccaagctcctagaaccatcactgacatacagtaaatgctcaaaagtatttgctgaatgaaaatgagtaagtggccaaatgaatgtaccttcttacccatattcccaaccaaacatcaagctgtacaactgtaggaagaaagcctttgctgagtcccaacaaactatagagtgcctggcacatagtagagactatgaaaataatatcacatttaatatttaaatgaatattatctcatttccatctgtgggaatttgattacattctgaactcaatgcttttgcctgggtgagtaaggaaccatatgtcctctctatctctagtcaacaggtgataatgggaaactttacgggcatatgagatttagaagggtaagttccctaatttcaggtcttctcctgctacagtacagcctgtagtttccatccagttttctgaaaaatcataggcaaagtaacaaactcagtattggggcaggcaaagtgattgcccaactgtctgatattgtggtgtgtaaatgtcattacttaccctgatgagctgctatgatggtactaaggatttggaggagtcatttcagatgctcttgaatgtctttctcccgtttttcatatactcatgagtaaaacgagttttatccagcacctctgctgagctagggaccgtactagctttatcatttgtcagtccataaacacttaaaagagtgctactggatagcagaggtaggcttaagttgtttatattccagtgagtaacagtagaaccagggtatagaatttacaggggaaaaaatttagatttttttagactcaattaacaaatattgagtacctactggattctaaaagctctcatgtgtaattcttataaggaccctgtcggacagggattcttgcccctcatttttcatatacagaagcccaggtacaaagatatgaagtaatttgctgaaaatcatactgcagcttaaaatagtgagctaatatttgaatccaggactatctgagtttaccatctcatgatcttcacgagtcatgcatatataaacttaaatgtttgaatgataatcgactattagcaataataaaattccatgccaggttatttcttctttttcccaccccaagcttactaattaatggcagtaaaatactgaaaggtgaatatcaaagcttgatctacatttttagcccaattcagaaataaaagactgtaatcagggctgtgtcagcttctctgaaatatctcagttaacatatctcaattgccttatacacagacccagaacataagagctcttgaaagtgtcataaaacctgggctgttcatccaagcagtcttcctcttacccacatttaatttttgagtagcaagctgatggcatttgggggaaaggaaaatgattttaagatgattaatctttgcagcttcacccagccctgaaacctgaaatgccattcactgtggtccagtgagttctggctctgcgcaggttcagatttgcctctgtttccctcagataagagacttatgagtcaacattggagctcagccaatctgacagactgccaggacagcctgaaagagaaggtgggctcaaatgggccccgtccctggagactctgatgacttgtccaaaatgatcaacatgcaagcccccggacatgtgaaatctgctcataccacatctcttggtgaattgggagcactgaggacttaagagagagaaagagaaagttgttccccctggaagttatgcttcttccctgattatactctaaaagctatagctgcagggaggcccaacctgtaagggcttctggttggtgtccaattagttctatctgcagtcatgacagtgattgcctgattttttaggaacaatagaaatggacatttgccaacaccctcaaaacatagaagcagtctgttgtaatacgaagagtatctttaaataataccaatctgctttataaggttgattaagtggtataacccatgtcatacaatccacagaacataataaatcttcccttcgataaaatgagaataatgcctacattttgggagctatcttttgggtcacagttgaatacatcctagagaaatgcagttggtctattaattattatagaagctgaagcccatagaggttaagtaccttactcaagatcacatagtgaattatgttgaagccaggactagaaatctgcactcctaactccatctaagcttctttttacttccagggtgcctcctctgttttcaagacaaatatgcactaaatgcacgagtggacgaatgattgtttttaagaagataatacaaatagaaaattgtgatttttataaaataagagcaactaaagtttagatctctctgctcccagcatcctttcccatacccctctagtgagaaaatgttttgaagaagtttactacatatgcatttttatgtcacatttgtaaaaacaccatccttatttcatctcccttccagtacttgtgggacacttgctcatctttagagtagagaagaggtgaagtaaaggaacttttgttttgccagttattatgtgaaatgctcttcctttatcatctcattgaatctctgcaaatatgtgagatgtaggaatgacaaacctcattttatagataaaactgaagctcagattactccacttattttctcagtgacaatcagctagaaagagtggactgacttaaccgtgtgtttcttcattccaacatctatgcttcttgcactattcatatgtgcttaccttgacaatgtgaaaatgggtcatatgtgtccaagccaggcacagtgggatggagcagagagcagactttattttccgttgctagtgttctttctcttgctgcatagaaaggtgaggaccaggtctcctctaatcaagcagaggcctcaacttcaagaaatgaaggaaattgagtcaaagcactctgttccttgcatcttaatgttgtcaggaaagcaaaggcctccctagaccaaacaagttcacagcacagaagggagtaatttgctgattcacttgttcatttataaatccatctgtgaaaactctgtgctgagacttggtctgggagctcctgatgttgtttctgatgtagtaaaggagataagacatattcccactcaagactagaagctgtaggcttcccagagaggtaaaagagcagagtgatttgcaattttagagaaggaaaggctgcttcttctgtatctcagcttctttatcttaaaatacggaaaattatatttatcacataaggtttttgtgagaattagaattaaaaccttagttcttaacttctttatctacaaaatagaaataatcatacctatatctcaaactgtttacagggattcaatgagatggaattacataaatgtactttgcacacaacctggccaataacaggcactcagtgggttgttgttgttgttgttgctgagtagttgttttattccaaagaatctttgacagaatcctcaaactggtggcccttgtcttctacctgccctctattaaagcatgttgtttcttgtcctctgttttagctttacattactgccgtgacaaatttgcttcctccattttcaaatcttagcaatggcactcaagtccttttcatgttccatctctattctgcctttctcttctagttttaaggactcatgtgattagactgggcccacccacataatctaggatagtctccccatctcaagacccttgaccttaatcacatccacaagtttcctttgccacataaggctctagagattcaggcgtgaacatctttggagaaccattattcttcctaccacagtctgccctctggcccccaaagattcttcttttcacataactacagggcgtaattctactaagctttccaccactgtgtaaccaggatccctttcctacagtttccaatgacatgcttctcatttccatttgagctgtcaccctcagcattctccaagtccagatttccataagaagtatttaaagcttcactggaaatatccttaaagtctgtatttctgcaatctcttcttagaagcaatctaggttttcttctatcatgttcctcaacattcttctagcctctgtccacttcccaattcaaaagccatttctacacttttaggtatttgttacatagcacctcacttccagtaccaaagttgatattagttttctattgctaccataacaaattatcacagaactaatgacttaaaacaacacaaatttattatcttatagttctgtaggtctggtacagatctcaccagactaaaataaagctttcagcagtctgtaacccttctagaggctcaataggagaattgttttctgctcattcaggtcatcatatggttgtaggactaaggtgcctgttttcttgatggctgtaacctaataaccattcccagtttgtaaaaggccaccattttccttggcttgtggtcctcttcctctaactttgaagccagcagtggtgggtcaagtccttcccaagtcatatctctctgatccattcttttgtcttcctcttccacttctaaggattcatgtaattagattgtgtccacccggataatccaggataatctccccttctcaagatccttaaccttaatcacatctccaagtcccttttgctatataagataacatattcatagactctgagaattaaagtgtggacattttgggggagtgagttaaggatattatttctcctatcatatccttgttaactatgaaacacatcaaataatttttcctattcttagtgatactgtctttccatcctcatcattcgctgctatcctagctttaaagtggtatagccaaaactaaattccctggtctacatagtaaacaccaatacttttaaggtccatgattgttaaatattacctcagtctaagccaagtggagagtgtgagtgttttgagctggaaagagttgcttgcaaaagagcatagaggttggtatcgtaggaaattcataggtcttagaagcagacaggctttgagtcctgccccatcacttgatagatggcatgacattgaacatgttgtttaaattatccaaatctgtatttcctcttctataatacaaggctaatatatgcactgcaggatagctgtgagaattgaatgtgtcctctaaaaactactcatgcatcttttttgcaggctagtccatagtatcactataagtgttatcatcaaatcatgaaatccttaggtataagatctaagtacaacatttcttatcaggaattccaagaattctaagattaggaacatgagcttttgagtgagacacatctacctatactttaatcctggttctgctacttagtatcttattttcatttcagctctttatatctcattttctttatgagaccaaaaatgcttacatggcagaattgttgtcagaaataataacaaagaggaactcacctgtgttgggtactttacatgtgtcatcccattgtcgtatctccgcagcacccttttgcgttagtgccattactatctgaatttcctaaataagagaatggccatctatggtaaagtggttatctaagaggttaagtaacatgcccaaattatacagttaagaatggcagaactgggacataaacccagctctcctctgtcttggaagcctggcatataacccatatgctatgttgcctacccaataaattgagtgagacaatgaatataaaatgcttactacattgtgcgacacctaaaaagcactattttgttagggtacccaggtatctcacagccatgttgcatagtcatgaggatgagcagctgcttcactcttcccttactagacttccccagttggcaaggggccaccacacattgaaattcaggaggggtaggagggatgggagagttgttacattattcatgtccaattctatttgtctaatggccttgctaaaagcaccctggatggaaagtgtgagtcttaatggcattttataaaagttgctgtgatgaattaacacataaagcaaattaaaaacagcttatcgcttgttaaattaggtgatggggcactgtagcatttttcccagatgtgaggatccattaatatccaaaggagccagaagctgctgaaatgtgtcagctgcttggttttagggacctgacaagtctgaataaatgtaatcctagaggggcagattgtccaagatcaatagagctcgtggaaagaacctgttgctgagctcctcaggaaggacacctgcagctaacagcaggagtgggaaagttccccttaaggactcttgggaatagaagaacacaggcgagtgaatgtctgacctggtagggacctccaggaatagtcccacccccacttcaaatgggaatgcagagacatgaaagaagacgggctttcaaaagtcacctgaaacattttcacagacctgtattgagggtctactttgggtccggcacactaccaggtcctgaggatacagagatattttagatgtctttcacatagtccagaaaacagcttttaagtggcacaattggcacacagatcccctgattcaaattctaatatatttttcagaataacagttattataataatatcttacatttattgagccctcactagtgccaggctagtgttacaatactttacatatattatttcatttaatcctcaccataactcttttgagatagatggtgttatgatttatgccagttttacagttaagaaaatctgaggcccagaggggttaagtaacttgcctaagatcacatagttaaaaaactgcaaacctaggcagtctggctccagagcctgcctccttggctactacttgttagcctttctgatggtttctctacctcaactccccatagtttacatccagaaggagcctggagtcaggccagcagttcaaggactttggggataagaaatacttggacaaggactgagcagtaagggagtttcaggaatttagggaagaagcagttgtcagccctgaagggaaggttaaaagtctttggcactgctagatcgtgagcatggccagagggcaacaagtggggaaattgagccacataataaaatggctaaggaagcagattttggagtcagatacacctcattttatattcaacctccaccacatgtgtatgtgtgacctgggccaggctccttaacttcctgagcctccttccctcatctataaagtggggatactaatttttacctttagggttgctgtgacatcaaataagacgatgactatgaagtgccagaccacctaataagggcgtaagtagtagtagccatcatggttatcatcttcaacaccttatcatcaccacctcccaggatgaatgagggggcaaggtgaagagcactgaactagacttggatctggagacccaagttctggtcctaggttgctgccactaagctatatattctggagttagtcagtgggccccactagatctgtccctcatcttttaacaacaacaaaaaaaagtggggaggatagtactatgtctgtcataccttcttcacagcaactgattgagtcacaataaggtaacttttgtgaaaatgctttgcaatctatagagagtgtgttggggttccccaagacaactcccaggttgatgactcactaggatagttcacaggactcagcatgatcatgctcatgattatgatttattaccacaaaaagatatgaaactgtcagataagggagcaggaccataggacaaagtctggaaaaaattagctgcaagtttccgagagtcctctctcagtagtgtcacacaggaagtgcctaattcttccagcaacaaattgcgacaacaggtgcgaaatgttatctaccagggaatcttattagagactcaatgtccaggtttactgggggctggtcatgtaggcagcctctgcctagcacataccagaatatcagactcccagaaagaaagcaggtgttcagtataaatgatattgtttgtacaaacagtttaggcacagtaagccattcttatgagaaaatggtgggaaccctcccaaaatctaactttccagatgtcagccaagggccacccttacaagcaagaacagcagtctcaggcctgctacattaactcctttttgcacagagtagaatctatagaaaagatttgtattagcctctacccaaaaggaaaaagggagataataataataacattagttcatacttactatttgtcactgtgtgccaggtccatttgtacatgctttatatatattaccttatgtaacattttacccatacagcaactccataatggaggtattgctatcatcattgtcatcattatcactatgttgtatatgaggaaactgaagcctgaaagagactaagtaacttgcccagctgactagctgtaagactaagacatagtaggagcaggacatggacccagtagtccatattcataaccacactgtaatacactagactgcacatactataggcttaatgctgcatatgtgttatttcattaaggatcacagtaaatctaggtgaatgttgttactagactaattttgcatcaaaaaacctgtggctcaagaatgttaactaatatatgtcacatcacaggatcaaagaagtgatagcttcaggagtgggcattggcctttccccagctccctgttcctgactggtactttgtctgagcctttggcaggggtggtcaaggtgaaaatgattcattccgggagcttggaccaagaaaccctctccaaattccatctctgggagacagtgttaatgaaagaagggactacgttgcaattaattatacttttcctgctgtgtttgagagctctagatgctgtcttcagctctttcttgttgccatggcagcagatgtgacatttctttgatgggcaaaaaaaagaagaagaaaccacacttggtcctcagtgtggaaaaatctaaaataaaacaaattttttagaaaaatctgttccccagatcttgctagttttgcatacatagtggttatactctaaggaaattcttagaatgaaatcaaaggggaatagatagacaggtagtgaaatctgcttctctgggaaagtcatatgctgtatgtgtggggtggtgatttttgaaaatgggatatacagcaggatgtggacaatataggagtggtggcaaatgttcacctcttaatgatgacagctagtttctaaggtctggttcatcattttgattctgattccacctccctcatgctgccactcatacatattacagtgcattggccttaacaaatgcttagcaaatgctttttagtgggggcagcatgatacagaaagcaattgtaattcacagataagtgccatgatgaggtaagctaggcatcgtatggaagcacaaatatttgtcgtgttgtttatatgatttttgtctatccatacacacacatacgcatagattttttaatttactgcattttaagcatgtattcaggtgattacattaacctcttcatccagttgcagtggtggtccaatatttcattgagtggaggaatcaccgcctactatgggtggacatttgttaccattttttcccattataaaagaaacagttctacaggctgatacatctgagatgatttgtttacagtacaaaatgcttcatttagaaatatagccatgtttctctttattattttactttttttagtaattttaaaaatttgattgtaatgggaggggaaaaaaatctcaactaggtagtaaagtacctttcttatcttctattatcaccttctaacatctgatggtctccaagaaaagaagcagatctcagtttgggggaatctataggccacccctgtaacctccaagaagaagcaagaactaactttagtgtgttgccaaagcagtgagagtgtggactgtgatccagggaatcattccgggagttgatatcaagtgatgataggttctcagagcaagagcaaacatttgaaaccataaatcctaaatctgtgctgccagagattcctaacaatgtcctcttttgtcctttcctccagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggaggtaagaatgccttttgtactagaatatttgcttgtcagctatccagcgagtggagatgagggaagaagaaggtgggagaaactgttcacaaaattaaatttatttaaatgggatagtcaatctgcaggaaaattgtcagtggtgacaggtgacatgaattaaaaatcctctttttcctatattagggttttaccaaaattggtgactgtgacaagaaataaaggaagaaagaggatcagcttacactgtgttcctaaaacttttaccagtgtgtgcatgtgcaaacttgtgcttatcagctcatatgccgacttacaaattcagtccatttatttccagagtttcaacatttaccaatgaatgttatagaaaggccaagtcgaaggcaaatgaagtaggcaatttactaggctaaggtcctggctgtgtgatatctccaaatattagtagaaaaaaatggaaaaccttcatctcaaattcaggtgcttgggatgtgagctgtcaaacatctggtgaggtctaaggactgggtttacaattttttttctttttttactgttttctttactcttgttccccacctcacaacttccaatagccaccaagatatttagttctgtgtaagtgtttcctaaatcaagagtatcatgctttctcttccaagcatttcttcagctctgcttttgaaaagcagaaatgtgcttcagaacagccaactccttaatctgtcccagcagatccatcaccagacaggaactttccttctcacaaatgtccctttggcaccaagatgtccaagaaacagaaattggctgtatcccagagactagatatagtacaaaatcagtcaggaattatgcttaataaaagcaggcactagcttttctcaagctgcagatttctcaaagggctttgatcctcatctccaaacacccaaaatgcctttgtaaaatattcccagtgaagctgggcattcaagtgctactacacatcaagtgattgagctagtacaaaccataatggggagatggaacttaaacctcagaataactctgtggggtatttgtgctcccgagacaactgatcctctcttctctctgcctgtggtcgcacagcctgggaaagaatgggacatggaaagcagagggctcactggtcctcagctgttctcttacctttagccaggaggagtcacagtgaaggtgccgaaattccagggagcctctccctcccccatgccagtgcctatagatctcccaccagcagagttctctgggtttctttaagcctcttggctcctggataattgcctaacattgcttttccagggcattctgactgtagaatggctgtgtgtgttttctgaaaggttacatgtttaaagcattgactcagcactggcttgtttatattccgggtctctccatttccatttacttcaaataaaatgtcaagacaacgtgcattttggtttgctttgatttaattattttgagctgtctgaagagctgttctctagaagaaagagccatcttgttgaattatggccccaaagatagtaatggggtggaggaaggaaagctatgcggaaatagatgtcaggtcattttaaagaaatcctctcactagttggagctgcctaaagatggcatggactatctgggaagatagaaaagggattcaaattttggatacaggggttgaactatacagttttctgactctttccaaccctgaggttctatgattctaaccaatcttatcaagtcatttgtttgttcaattagctcatcatttttctccagaagaacattctcaatgctattcctcctgaataattttccacctgctggtaatcattcttgaattagctatttctctcttattttggaagagaaccatcttaacaaccagagtatagctgacctggaaaataagtttgattagtgactgcaaggttgatatttatttacattctactttttatgaagggtgcagtagctccacctcatatatataatatatattatatacatataatgtatagctgtaaatacatttctgccaaattttctttttaggattttaattattttcaaaatagttacttttattcctttaagtatttgtaaaagtaataccttttattgtagaaaggtgggaacatttagaaaaacataaaaatcacttacaattctaccccacaaagagtacccatgtacttattttaatgtaatttaaaaacgtacatttattaggttgatgttatttttcaatcattaatttctttctagcctgtttcttgagtataatttacctagtagtgctgatctggaaaattttttaaatcttataatggataacatcagtgtatgactttatatccttttcaaaaatgtttctctattgataatgtcatttaatcatcccaaatgaaaccatgagatgaagagtatgaatattatcaccttccccctccttttttctgaagatggtgaataaattttattgaacaaaacattcctgttgcacgctagacactgttgtaagccctttacaattattaatttatttaaacctcattagaaccctatgagtaagttgctgttattatccttattttacaaatgaggagattgaggcacagagaggttcattaatgtgcctgaaattgcccgtgtagtaagtggcagaactggaatttgaatccaggctacagaattgcacttaagacatatgaaatcttgccccctacagatacaaaaataagagctagcaaaattcaattcagcaagcattgcttgggcagcatctgagtgccacgtactattgttggttcactacctggagcccatcacttgtgggaccaacatgtaactgtggcacagctactctgcgattagggcaatgcaggctatattgtaaaggccaggaaagtgaaacggcagcagacagagagtgaattccatctgataacagcactgatcatgtattgcaccaggtgctttcaaatacatcatttcaatttaatctacacaaaaacctcataaggaaactgaggatcagagaagtcgagtaacttacccaaaaatacacagccagccactgaccaaacaccagtctctttgatagcaaagccaggtggctttacactacaccaggaacaaactaccctaggagcatatgccaaggaaggaaatagaaagtcagataattcaagtagcttgccaaaattacagtggcagcagagggctaagcctagattcaaacacatgcctttctgatgtctctatgagcaactgcaaaggtttggggctcttcttggccctacagctctcaagtctggtggcagggtcttttaagagagaaaaatggaagtccatgtcttgctcccacctagcataaagggactgacttggcagtgagcacctgaagtagggtacctgtattacttcctttttacaagtaaggaaactgggaccagtaatgagaagtgacattatgggcagcgttatcataatcatctttgtagcagccttttgtatagtgagttattactatagatcagacattgtgctaaacaattttcttgtattatctcatttaacattcattataaatttttgaagtctgcgctactattctaattgtatcaacacaaaatctgaaatcctaagaggttgaggaccaccctaaattatagacctagtaagtggaagaggcagaattcaaacccaggcttgtgtgactttaaaatctggactcttagcatagaatcacttttctgagattatgtagtgtataagaggccaagctgggttttgttccatggtatctctctctctcttttttttttttttttttttttttttttgagacagagtctcactttcgttgcctaggccggagtacaatcccaactcactgcaacctccacctcccgggttcaagctatcctcctgcctcagcctcctgagtagctgggattacagatgcccaccaccatgcctggctaatttttgtatttttaggagagacgagatttcaccacattggccaggctggtctcaaactcttgatctctggtgatctgcccgcctcggcctcccaaaatgctgggattacaggcataagccaccgcgcctggctgtcccatgctctcttaagccaaagagattattcattgttccctagtgactggtcacttgggctctcagatggcagcatatggctggcattatataagagtttactcacctagctgtcacagcaagcctgtggccactaatgtgggtgacattctaattctccctccaacaggacctgtggagcatagggataggaactccgaaggacaaatgatgttcccactgtccaatgctccaagcctgacccaattatgggtttggccagaacctaaaaataccagatgggagagagggagaggaagacagttgggcttattaaagcatggccatttggtgctctctagagatgtgaaatgtcagaattgattgctcaaattttgccattccatttatgtttttggtattttggtcagtgatgagacttggacagggaggattatttctgctcaaacaatctaattaattgcttgagtctaagtgtgagtggggaaggaaggcagttgttgtcattgagatttggtctgtctcttcaggtggtccacaatttctttaggtgaaagcctttggaccttaatatttactagccaaagaagtcttactcagtaaaacaataagaaaaagtgatgctagacttttacctagattcttaccgggaaagtaagttgtgaaatggcaaatcactttttatgggaaaaactggttgttcagcaattcacttaaactccctgacctgattgttttcacaattaggtaaagaactagtagcccccttgagagtttatttatttactcattcaacaaagtctcattaagcatctactatgtacccagctcatgtcaacccctggattatagctattataggtgaagtgcttagcacagtttctaaaacttagtgtacattccaataatagctgttttccatttttcaaaatttgagctttagttgccagaaaaaaaaaaaaaaacaccacgttatttagacccctattttccagacttaactctcatttcaacagtaaatcattcacatgcatcccagaaagagctaggagagaggaaagggctgaggcagatgaggaagctaagccacagacatagcctccctctcaaggaaagaggtttgcagagaaccccaagaagcagtactgcaagcctctgtgatgggaatgcactattagggttgctggtgtgctgaggagatggatcaactcaaatagggatttaactaagcagatttccatgtttaaagtaaatttattctgaattttgaggtcaacttcttgtggtatgctactaactcgattgtatgcttaaatttggttgtggtttatttaataattaataatattcatagcattcaggacattagggagatggggatgcaagggtacattggttatcatttgtgaaaacctcagcctagacttctaaggatatgtatgtgccttcatactgtggaagctgctccaaaaatctcacgtttgttgagaatttggataatgcaggcttgggaggtacctgaatgctgtttcccaaactgagtggctgtggacagacactgaagttagctgtcagagaatgtatgttcaggctctgtttctaccagtttctgatctggcaagcttcaagtctcagtttcttcagttataaaatgagattgataatacctaaatccttaggttgttgtggggaccaaatgagatgatgtaaatgtgaaggaactttattaataattatatgttgcaacttcagcagccacttatattattattaatgaaactttcaacccaaataggaagcaaagcttttcaacttccttcatgggtgaactggaagtatgtgacctccatatggcttcaattttttttttttactttctctattacccatttgaagattaataataaactatagcaaatggtaggtgagtgtatgtgtgtgtgtctgtgtgtgtgtctggctgacttaatattctttgcaaccattttaagatttaagggatgaaccattaaaatcttcctaacagagacatttctcaagaaaattgaaaaggataaacatagaaatggggttggggtgcagggcaggggacagtattagaatgctctgtccaaacagttctgagagttgaatactgagttcctcctgacattctgtatgtttggaacctgtgtgagttctgtgggtttatgcagaatttatttgcataccctgatcaaataaccatgtattctctgcatactacagccattttggcatcattgaatgatgccaaagcattgactatagcccagttaatgcaaagaagctgaaataaagttagggctgtaacaacagttttagaagaatacaaagagatcaatataaattatcatttgcccttggattaaaatcgagaaaaggtgatgaagtgatgaagctcaaaggaggcattttatcagtgagcattttccacttggcagcttatcttatctgaaatctgtcttgctttctccccaactgttgtatgcctggtgcaagtagaaactcttggtggaacacattgttttacttattatttatttatttatatttatttacttttgggggagacgaagtctcgctgtgtcacccaggctagagtgcaatagcatgatctaggctcactgcaacctccacctcccgggttcaagtgactctcctgcctcagcctcccgcgtagctgggattacaggtgtccgccaacacacccggttaatttttgtttttgtatttttagtagaaacagggtttcaccctgttggccaggcgggtctcgaactcctgacctcaggtgatacacacctgcctcagcctcctaaagtgctgggattacaggcgtgagccaccgcacccggccttacattgttttaatatattacgttagagttgaaaaattttgttcagctgtttccactcagatattctactctcacactgaaataaatatattctgcaattccattctgtaactatagaaaccctgatcttcactgtgtttcagttgggaacacaaaagagctctcagttagaaaggagtgtgctgttaattattgatctatgaatagcttagactccataaactattaagtttctgtaggttcgggttttttctttctcttttttcccccacatctttaaatttaaagctagcaatatttaaacaagaagtcatgttaaaacaatgcaatgaatattatttttgctggacaattatttattgaggacttgctataaaacaccatcaagtgataagtgggcttttaccttaaggtacatacaaccctgtatatgcagtgcaaatgtaagtaaacacaaggaaatcaagaggtagtgctgacatggagactgttccagttacaaaggagcaatcatgtctgactggaggggctcagaagaatcaaggaaatatttagattattttccactttttcaaccctggccttcaaacaggcgggagtccacccaattttattttcctaatatttctcaagcctttccctcttctccaccccactatcatttctcattatttctcacctggactatggcaacagcttctaaataggcccccagcttccttctgctccttccctccttcagtctatcttccacctcgaccagggttgtttatttaaatgctgatctgattttatcacttcactgcttcatatcctctaagagcttatgatgattcccaaggaaaaaaactcaagtccttaatgtggatgaatacccattataaggagtctgtcacctcgctagcctcactgccctatcctatatatcccctatgtaccctgtactagaatctttctgcaatcttgtagctcactcatatcttcaggttgaggaatgtgttgttccttctgtgaaaaatccccctgaaatttccctactgacaaactctttctaatccttcaatctcagatacattgatatttcctccaagaagcccatcctaatgctttctactcctcctttgcaccctcccagtgagataggtgctcccacattgatatcagccatcttgttctacagcattttctgtgtttgtttacaccactgttcttgccaaattcattcttgctaagaattcattgcagtcatgcttttagaatattttttctttgtcccccagctccttgcttgatacatggtaggcagtcactaagtgtttaatgaataaatgaggtagcaggaaaacaatgaatctgcagagatgacagaaggacattggggaaaaggaaagctcaagattatatataacatgtttggttaaaaagtgaagctaaatacactagtgttcttaaggggaagagaaggaaaaacaaagaagaaaaagggaggagagaagaggagaggggaggagaaacttgtttagtctccaatataggtgttcatctttatgaactgagatttgaaatagattttgatttaattatttaagcatttaaatagcaaatattatttttttctacctctctgttgcttacaaataccatgacgtgactctcagtatacgtatcggagtaatttcaagggacatgttagaaacttagagactttgtaccaagattttttatatggaacaaaggaagagaaatattttagaacacattttatttgagcttcaaggataggaggaaaaaatgttcttcacttaatatggaacttagtcataaatgccttgtcacgtgagagactctttattctcaatttgctttagggtggaaagaaaggaacgtgcccgattgaagacagtgaagtttaatgccaaacctggagtgattgattcgaaaggggtaggtacaaaatgatggaaacatcaagttctctcagttgccatggatttaactataattaacacatttaggctttcagtagcaaacaaattatgaaggtaccagacagtagagcactgttataaatatattgctgaagttaataatgtgatttctgatgaaatggatttatggtaaatatatttaaacactgggagtaaagctgcaagtggttagcagaagcagtgtgttgatgaaggtgatgtaatgactacaatgaagaagaacaagatagtttaggtggtttttgtttctttaagttttttccttttaaattaatgttctaaaatgatggattttataaaaagtatctgctcatcagaaaatatatctagtctgtttcacattatgaagctaagacagtagtcatagaaacatggattatctaatgaatacacggattgttgtgacagacatagaagagaattaatgactaaaatttagccatcaaaattagaatatttactcacatatacatgtgtacatgtttttaaaataatagctttataagataaaatttgcatacaatgtaactcaaccacttaaaaaatacaatccagtggtttttagtatatttagaattattcaaccatcaccacaatcaattttagagcatttcatcactccataaagaaaccctatatgcattgacagtcacctcccatttccccaccctcccaccccaacataggcaaccactaatctactttttgtccctatggatttgcctatcctggttattttatataaatgaaattatacaccatgtggtcttttgtggctgcttttttcacttacattgttttcaagacgtgtttgtgttgtagaatgtgtaagtacttcatttcttcttattgccaaataatattccattatatggatatgccacatttaatctgttcatttatcagttgatggacatttcaattgtttccaatttttagttattatggataatgctgctgtgagcatttgtgtacaaacttttctgtgacatatatttttatttccattggctgtatgcctaggagtgagattgttgggtcatatagtaactctatgcttaacattttgaggaactgacaggctgttttccaaagtggttgcaccattttacatttccacaacaatgcatgagggtcccaatttctccatatccttgttattatatgtctttctgattacagccatcttagttggtacgaagtggtatctcatgctggttttgattttcatttccttaatgactgttgatattgagcatattttcatgtgcttattggccatttgtatatattatttggagaaatgtttattgagatcctttgcccatttttaaattgggttgtcttgttattgttgagttgcagaagttctttatatagttgggttattaaacctttatgagatatatatgctttgcaatattttgtcccactctgtgggttgtcttcattttcttgatagtgttctttggtacacaaaaggttctaattttggtgaagtctaatgtgtgtattttttcttttgttatttttgcttttggtgtcatatctaagaaaccattgcctaatgaaagtcatgaagatttatatcatattttcttctaagagttttataattttagctcttacatttaggtggttgatccatgttgagttagtatttgtacgttgtatgagttagggttctgatttcattcttttgcatatgaattgtcttcttaatttcatttttggattgttcattgcaaatgtacataaatataattatttatagaccaatcttatatcctgcaaccttgctaaagccacagttttctagtgaattcctcagagttttctatatacaagatatacatgcaaaaagagagagttttgcttctttccttcaaatatggatgccttttttccttgcttaattgcaccagctagaaccttcagtataatgttagaaatggcaagagcagacatttttgtcttgttcctgacattaacagaaatgcattcggtctttcgccatgaagtgtgatgttagctgtggcttgtatagattttttaaatctattctttgaagagataatactgtatcttattgctgtgttgtaaaataactttcccatcttctctcttcccgttctctttttcttcatatcctttctttcgtctttctatcctagcaattgtagcttgtgaatatcatacagaatcacaagttatggtcaattgctgtcaccatgaaaaacaagaaaaaaaaaagctataatttctcagggattttgaggcccgaatcatagcactgccctttctatttctagaatcataagggagcccagtcattgacataataatttaccctcccctaaaatattcaaatgaaatgaaaatttattgaaacataggatgtcattctacatagaagtgagggtatgtgacatcatgacataaagtcctttcaaacaaatactacttgtatacaagaggtaggttttttttccatgattcctggtgagaatttaaggatagacctcttatttgtttgagatagatggatagatagatagatagatagacagacagacagacagatagagttggatatatgtgagaggatttttactgaatacctaccatgtgccagaaacaggactagaactttagaaggacacaaagtctaacatgggcccttttccccaagagctcctaacatcagtgagaggccagatgtcttttcagtaaggctgaaatatatatgatgtgctttctaattatacatgttaaacaccattaggtatttgccaatgaataggttgtaaattataggacttcgctattgaaagaaaggagtaatcatctgggaagggaagccctgaatggaaaatcaggagggtcagtaacctgggttctggtttcagctcactactaagtcactgttgttctttgggccttattaccaaaataaaacctttaaactacatcagggatgtcaaacaagtttcatctcctgtgtagactaatggattgatagtttatatctggagtattgttttgaaaaaggattctgaggccataaatgatttcagaaaaaaaaaaagagtgccatgattgagtcatctctagcacaacattgggaattattctctatttgcagttactggattcaatgattttttaaggtgccttacgttagtaactctccataagatttactcatgcattaattggtaataaatcaaagtttttcaaatctttatgagaaaatacgtcaataagaagacttgtccagaagtagaaagcaaagaaccattagcaagagataaaatgcactgaggaaaggagagaacaactatgtggagagttgggaaagctgggtcaggagatgccactcactttgaattaaaggcaaggactacaggaataagtcattgatgcaggggcctcattctctgggaccttgggataaattcagcataaagtgaggaggaaaattgtctggaatgagaaggataatagggtgttttaaataaccttatcattagctggcattttcagagcattgtgaaatgtcctgaggagcccagagtgaaagccaaggttactgccctggaggagcttagattaaattagtatctgtgaaagcaggctgtgacaagagccttattagtagtatgtacacgagctataagaatttaaattaaaggttgcaggaataaccagagagcactttatagatgaacttggactttaatgtgactgtcagtgcttgagttacttttccagaactcttcattgattgcaataacaccgagtgctgcaaaacaccaggcaggctcaaaaagagaaatataagcaggcaaacaatgataatacagcatcactaatgttttccatcaatttagggaatgaacagtctttattttaaaaatcaggagcctgagcctcaggaggattaactagcttgcctaagatcacacagttagtaggtgcaagcatcaggttgagatcattttgacaacagaagcctgccctttccattactctacactatacatgattctgttgaagccagaggaagtaaagcattacaaatatgccttaggtaaaagagaaggcttcaaagaggcaatatttgaatgagatcttaaattttcagtaggagtttgccacatacataggaaaaagcatgaacacgatagtggaaattgcagacatgttggaatagggttaagcaagtcaaggacaccagtgtgcaaaggtcatggtgggaattgtagcaaatgaggttgacaaagaaggtcagaaaggccagaaagcttgtatggaaggcctggctatcaggttagaagcttattggattttgaaagtatacatgaagaaatctgaggttcttcatttgaaagtgctcatctgctacaaatgaaatacccaggatttctatccactctgtgtgcctttacaaagtctatgtctacacatgcaaagaaaagtgggctattgtgtcagtagcctagataagtccaacctatgcagatccctaaacttcaaacagccatctatttggataggtctccctaagacccatctcagtgccccagatagcaatgcagtcaagctcccctgggaatgtctattaaatttctaatgagtctctagtcaaaccagcctctggtgaaaacttaagcaccccttaatttcttttattgtccttctacctttttttaaatcaatttcaccgttaaccagccattctgttacttattgagaggtttaggaaattgcataatcttcagagtcaagctgttctgcactgaaaaatcaatgactatttagtgatttatgccaaacttcttttttaagtctataatttaagaaagggaaatatatgtaagagagagtatgagagagctatcagtatccttactatatgtcagcaacgtgcaatgtgtgtctcttttatgttgtaaaccctttctaaagtaaggtatggtataaacaaataaatcatcctatttatccttgggctgggacagaacagagatgatagttgttatttgaagtaatatgagtagccattataaaaacccagacagtttacatacacctctcttttaaaaaaaaaattgtagagacaaggtctctctctgttgcccaggctggtctcaaactcttgggctcaaggaatcctcctgccttggcctcccaaagtgctggaatcccacaatgcccggcatacatacatctcttaatcaccacaagacttcaaaggaaatcatttatttcctctttatagatttaaagaaactgaggcttagagaggtgaagaaaaattcatgtctgactgattccaaagttcacaatctgcttactatagcatgctttcttttttattgacatcatgtaacacttgtgcaatttaagaaaaataaagaagtaaattgaactgggtttagctttgtcaaaacctaacttgggcataaacttaaatcctgaggagaagctggttttcctagatgatgcacatctttctgaaggagaacattctaaagtgagctcagatatacacactttctcactgtggcctgctaaaataaaatgagggaacaagtcttgctgaatgacttcattcatttatttaataaacctttattagatccaatacaaggcagcttgataagtaatgtggaggtgtaaagacaaataaatcatggtcactttcctgacggagcaggtcttctgggggacagaatgagtgtctacagggaggaagtgattaataccaaaggagaagggcagaaaacacgttttcagtgcagaaaaggagattccagcttgaattagggggcgttgaaggattaggaaaatagggactggggttaggagtaagatacagaataagtatgaaataaaacatggttcactttcattacagggaacaatttgtgaaggagaatgaaaagaatcagaactggaaagttagactcaagtcagttttgatgcctaaaattttccaggaaacttatactttatcctgtaagcaataaagaattttaagggttgtgaccaaccagaccaggttgattttctctgggctaatgccctgaaggtacctatatcactgcctatacaggctgcattatgaggtccttctaggcaaagatctgaatctactcatctgtatgccccagcacctagcacgatgtctaccttaaacatactagctactcaacacatagagcaaagggaatggaatgttcagaagtgggtttctgagagatcagtctggcagctgtgggaaggaaaggttggaggagagagactggcaataggaaatgtttgagaaagctattacagtattctgggtgtaagattctgaaaacctgaactcaaaagtggcaataggaaagcaaaataggaaaccatttctaaagagatcagagaggactatcatccttggacatttgtcccgactgttcctagtaatattctatttccttttccaaagccttacgctccctttaagagcagatgttgattatgagagaggggatggggcagaagctacagggataggttgatagcaaactcccaaaatcaaactgcagctggcattgagaaatctcatttctatttcatagattcttagaactttccatatggccattgacttaatttacaaatgaagaaactgagactcatttctctaggacacacaaagagctggtagcagagcctactattgtgtcacttatcaaaaaatcaatgtgacagtcagtatttcgttagcaagatgggaattttatttgcttcaccagagtgagttatagggattgattttgtcacagcttcaaagtgacattttgacaaaagaaatgtcattactgccctcgaaagaaagctctttaatggagccggtcttggaatggccagagccaggcaaagatctcaaatgtccagaggtgatctacagatccatggaggagaggtggaaggagagccatactgctgcactccagggggcatcaggaaggcaggctttgccctcaaggtgaataaactcagaagaggctactctttgatgtctttgttattacttttcttattccaagccttctaacaccttcctcactggtcttcctggctcacctttcctctcggattctttccctatactgcatgcagtgtggttttaactggtcttatatttttatgtataaagaacaaagataggcatatgtccagggaattttgcagcttcaatagcccaacgtggagacactttataacttgttatgttttcttttgaatgtgataatcacatctatccaaaccttgagttcccttgtccactgagaaccacctgagccagcacacagataactgtctgatcaagatgtgctagtggcttttctgaaaatggttctcagaggaaaccccagtcaagtctccatgtctgagacatgttaaggtgtgtcctatgtaaaccctgaaagccgatggaactcaaggaacattttgggatgaaaaagttcatattattttatgtattcctcatagtctatttgtctcaagttgctgatgacgaaactgctattctgtggaatggcgtggagaataaactacattccttatgtatttttgtgcacaggcatttctgccacttgggtccacaaagcactgccattgaaactgtcaagttaatctgcaaccttatatacaaaatgtattataatttataactgaaaaatctgttcacagtgcacacacacacatactcatgtttacaatatatttcagtttctaaaagagatatcgttcaaaatgagccttgaagaatcagtaaaatctaatcaggtgtaaaaagatgaaaagagtgttgttggcagaaatcaggaaacagcccggtgtgctcagggaagccaaggaagcttaatattacgtaagtgcaaagcataagtacaaagcttcaagtgtccagagataacgcagagaagttggaaaccaggtcatgaaggtcctccatcttgagggcagtggaaagccttgggaggaattcagcagaggttagattagaatttagcagatcattttgctgtggtgtgaaataaatttccagagggaggcagccccagagggcagggatccatttcagtaattcaggtaagacatggaaaagacctgacccaggaccatagagtagctgtggagagaagaaaccagaaaattttcagcaggaaaaaaaaaaagtgtatcctgcagcatctacatcagaatcagctgaggtgcttattaaaaatggaggtgagcaggctcaacccctgtcctgcaggatcagaatctctggagatgggggcaggaaagctgcattttaacaagctccccagagattttgttaggcatgctactaatttgagatacacaggcacagtggaaaagtttggaatcagacagaataaccaactcctatcaattatcataacttatctaagcctaatatgtgaaaatagaaatcatattaaaagatacaatatatgtaaagtactaagaaatattagtctatcttttgcccacccctacccacaagcacatacctcttaaactctcacccttataaggctagaatgagcaacttcctaacactactcttttctttagattccaaatctccttttgcacagaggaagaagggagagttgccaaaactgccctgtgtgcatttgcatacggtgtttttgaccttgtgcttgtttagttggggagagaagttaccactggctgactctaatgggcaggaagatggagcttggcagcaggactgattctaaaccccgccccctgcccctgccattggctgcaaatccagatggtttctgagttctctgctatcttgtgtagctacctacaggaatttctagaagaacacacttgatcagtgcttactgctttggagaaccattgcatctcatttaggataccagttattctgaacatctgtagatttgttattttctacatattatttttataaccattgctcatttgctcctaacagtaaccctgtgaggtaaatattataaatatgcccgttttgcagatgagaaaactgaagttaagaaaggatagataaattacccaagctcctacagctagtaagtggcagagctgggccctgcattacatattgttattgtgcaagcaaatcaaaataattgattctttagaagatttttacatatgaactaattccagatgttagtagcatagctaattctatccattcaagtactgatggtaagactaaagtaatataaataggagttgtataatatgtggttatgtaatataaataacaagtatagttttatcagataacactgagcttttgttaaatcttcttttcatcattaattcaaggtaagtattattcagaaaatttagctcaacccatttctactttgggaattattaaagaataaattctgattcactataggacttcctttcatctgactctgtagtaataggcctacagtcataccgttgagcttgcaggtttcactttgcaaaagtttttaactatctcaaagctaaaacatcaacactgaaagataaagatgcagaagtgaatgtccagtcatctgacttgctcactatggtaattattgccagactcttagcaagtaaaaagagtatatcttgcctcttaactatacattgtgtttatatgtgggtaaaaaggtttttttaaaaaataatagcacgtgtaatatctgaaaagagtttcagcaacagcttccaatatgttcttaatatttataaaaatacctaattaccttgcattttgattaaaaaaaaaagggggggggggctctaaaattagactatcctattcttaacttttctgactacatgacctggagcaaatagcttctctttctgagatgtgatttttcaactataataataaactctggagaatagatagcaagttccttgaaggccaggactatgaattatttagggcctaaaatagttcatggcactcaaccaataagtattgaattaaataatgtgagaagaaagaacatggtgtattaggagaaaaatcatgtaaattagaaggcacagatcactttttttttttctataggttgtgaatgcagaaccaaataatttattgttgcctttagaggaaggttctcttgatctgagtgttacttccttttatttcaataaataggttttgagtttcctgtatgcactggataccgctctggccactgggtggagacgtagatgaataagaccccacctctgccatcccaagactttcttttggtacacaccacacacatacatatacacacagctatagcataaggcaaaaaagtttagcaaaacatgaatagagtcttaacaggtattcaaatgggcgggagagcctactccatgtgagagcaattaagaaagggtccgaagaaaaggtagcattttagctaactctgtgaggagtaagtgcactttaacacttagaaaacagcaggagcaaaagtaaacgaatagagggtatctggtgaccagcgagtattccattcaatgggcacacacaatggggcagtggtaaggttgtaaacatagcttgaggcccagtaacagagggcattaagtattcctttaaaatttttgaagaggctcttctttgggtactggggagcccttcaaggttattggatggaggagtgacaggctgtgtttgtaaataaagaggttgactcttgctgggaggatggatggtggggacttgggagggactggagtagggagacacctagggaaggacggtgggatgactcaggggagaaatcatagagcctacatcctaggaattgaagggagcccacagatggcaatggcatgtaggggagactgttaaaaatgtcattcatgaacatgtgggggaccctgaatagaattggtagagaaggggtaaaaggcgaatggtgcaaagtaactgcccactaggaggacagtggaagggaaataaacttggcagagtccagaccggaaattaaaattgtatgtatgcttttaaatctatcctctagcaggcatctcaccaacacctcactccaacacatttgccttacctggtaaatcaagtctgcagcattaagtaattgctacgtgttatcagaaatcaatggcagtttatacatgatactggaataaccaccaaattaaactgaaaaccaacccaggtcagaataaaaaaaattgtcactaaagtaaactttttaaaattgaaactaattttagattgattgccaggttaaaaccagaaagctggctgtgataaatccacttctcccccaggactaaaattctttgtggatactggaaaataagtccttgtatttgcaaagcacttttgtaccttacccatttgataaataaagaggcagggtcagaggaaataagtgacctgtgtgcagtcacacagccagacactgttctttggaggtccatgaatatttatttagtatacagttccatttaatttgtgaaggtttacaagacgtctttcatgttcagcactgttctagggcctgggggaaaacaaggacgcctgagcctttgcccatgctcttggcaaacattaaatggtctggcaaacatttggatttcctttgaagttggcagtctcgatacatgatctattcttcttaggcagtcaacaaacttagtactgccatcccagctatgccactggctgtgtcatctgagacagaccagttactcctatgtaaagtgggacatgtaagagggttaaacttacctcattaagatgcgagctacacaagagtcatagcatgaaggctattgagtcaaatcaaaagtatacctctcaagaaaaacatccatgtgtagcccactctatctatctatctatctatctatctatctatctatctatctacctacctacttacctgtctgtctttctttctatctatctatctatctatctatctacctacctacctatctacctacctgtctgtctgtctttctatctatctacctgcctacctacttacctacctagctagttagctatctttctatctatgacaacgcagtaagcaccatgaacctgccacctaatgtgaaagcatgagcaatgaaaggtatatcatgactaaggattatgatttttccctttctgtgcacttgaaatccctgtaagagaaaaagagaaaaataatttccatgactccagggctattggtatacataggcaacaatggggaagctatgagaaacatcttttatttgttagtagtgataaccgtaatgcagtttccattcattcacagagttctgagaaatctgagtgacacaactacaaagtgagaacttttccaattactgtctcaaatttattacaagcacttgtcaatataagtgaaagcctatctcacttgaaaagaagtaaaaagtttgcagatatgccattcgccttttatgttttgacaacttcatgaacatttgtaaagattttactaacacgtcctgtttgaacactcttgatgtggtggtttttcctggaaggccctaagaagccaccattttgctctgtaattgacttgtgctcacctgcccaaagaattaataccataatgaatttggggcatgaggtaaatgtgaatgacaaacctggtcactccttattcatagagaaggattctgtgaacacctcccaagtctaatggctctaggtgaagtggagtctaagcccaaatgacagtcagaaaaagacagatatgaatctacgattgccaatggatggaatgattgctttgttgcaggtaaaagctccccatcacccagctcatcccatgagctgcctgaacttctgtgtttatgcccttcgcagtaataggcaaagctcacatttggcaaataaagaatttgactttgattagtattttttaaatgtgataacaatacaattgatgttttttgaagattacatataagccaggtgtttttgctaaatagaacaatttttctcattaaatcttcacaagaatcccatgaggtgaagaatatagggtccccttttaaagaaaataatatttctgggcacccatgcccccaagtgttgactaaatctttttataatgatgttacctaaatacataaaaaacacaaaattaggggcaaataccttatagctcttatatcatctatcatgttcaaataaatttacaaattaaacaccatatatgtaatagtggtatattgtaacaataaaattcaaaattacagcattaatgtgattagtgatactttagtaaaactaaatcttcttccacaatgtaatcgtggttgtggctgctgtgtggaaattttggagttgcacctgctgagtgctagggaagactcagttctctcaccactgtttctctacagtacaccccgctgcagaaccactgcaaaggccccatctgggtcttactccataccatttacccagcccctagtactgagactgacaccttggagtcattaaatgaataattatggacctcagttatactacagacaccctctgtggctgctctctctgcactgtgttttaagttcctgacccccacacttgatgggttttcttgcctagttgcacagtgctcagctgtactctcttggcactgtcagcagatagctgtatggagcagcccctcagtccagccccctcccacactgaatttgctattttaaatctacgagctgagaaaccccaggaacaaacttcttttttttatttatttatcgttaattctcatttttaccatttttaatttcatctcacatcatagtaagtacaaatatatacatatatatatgctaagactctgatgggtagattttgtgacttttctgtcaactgtgcagctctgcttctttgggatatataattcagacacttaaagttgctggttagaagatggccgaataggaacagctccagtctacagctcccagcatgagcaacacagaagacaaatcacttctgcatttccaactgaggtactgggttcatctcactggggattgtcggatagcgggtgcagtgcaccgagcatgagccgaagcagggtgaggcatcgctgaagcagggtgaggcattgcctcacccgggaagcacaagaggtcagggaattccctttcccagccaagaaaaggggtgacagatggcacctggaaaatcaggtcactcccaccctaatactgcgcttttccaatggtcttagcaaacgtcacaccaggagattatatcccgcgcctggcttggagggttctacgcccatggagcctcactctttgctagcacagcagtctgagatcaaactgcaaggtggcagcaaggctgggggaggggctcccgccattgccaaggcttgagtaggtaaacaaagcagctgggaagctcaaactgggtggagcccaccacagctcaaggaggcctgcctgcctctgtagactccacctctgggggcagggcatagccaaacaaaaggcaccagaaacctctgcagacttaaatgttcctgtctgacagctttgaagagagtagtggttctcccagcatgcaccttgagatctgagaacagacagactgcctcctcaagtgggtccctgacccccgagtagcctaactgggagtcaccccccagtaagggcagactgacacctcacatggccgagtactcctctgagacaacactgccagaggaacgatcaggcagcaacatttgctgttcaccaatatccgctgttctgcagcctctgctgctgatacccaggcaaacagggtctggagtggacctccggcaaactccaacagacctgcagctgagggtactgactgttagaaggaaaactaacaaacagaaaggacatccacaccaaaaccccatctgtacgtcaccatcatcaaagaccaaaggtagataaaaccacaaagatggggaaaaaacagagcagaaaaactgaaaattctaagaatcagatcacctctcctcctccaaaggaacgcagctcctcaccagcaatggaacaaagctggacagagactgacttcgatgagttgagagaagaaggcttcagaagatcaaactactccgagctaaagaaggaagtttgaacccatggcaaagaagttaaaaaccttgaagaaagattagacgaatggctagctagaataaccaatgcagagaagtccataaaggacctgacggagctgaaaaccacagcatgagaactacgtgacgaatgcacaagcctcagtagccaattcgatcaactagaagaaagggtatcagtgatggaagatcaaatgaatgaaatgaagcaagcagagtttagagaaaaaagaataaaaagaaatgcacaaagcctccaagaaatatgggactatgtgaaaagaccaaatctacatctgattggtgtacctgaaagtgacggggagaatggaaccaagttgaaaaacactctgcaggatattatccaggagaacttccccaatctagcaaggcaggccaacattcagattcaggaaatacagagaatgccacaaagatactccttgagaagagcaactccaagacacataattgtcagattcaccaaagttgtaatgaagaaaaaaatgttaagggcagccagagagaaaggtcaggttacccaaaagggaagcccatcagactaacagcggatctctcggcagaaactctacaagccagaagagagacgggcccaatattcaacattattaaagaaaagaattttcaacccagaatttcatatccagccaaactaagcttcataagtgaaggagaaataaaatactttacagacaagcaaatgctgagagattttgtcaccaccaggcctgccctacaagagctcctgaaggaagcactaaacatggaaatgaacaaccggtaccagccactgcaaaatcatgccaaattgtaaagaccgttgaggctaagaggaaactgcatcaactaacgagcaaaagaaccagctaacatcataatgacaggatcaaattcacacataacaatactaaccttaaatgtaaatgggctaaatgctccaattaaaaggcacagactggcaaattggataaacagtcaagacccaccagtgtgctgtattcaggaaacccatcttatgtgcagagacacacataggctcaaaataaagggatggaggaagatctaccaagcaagtggaaaacaaaaaaactaggggtttcaatcctagtctctgataaaacagacattaaaccaacaaagatcaaaacagacaaagaaggccattacataatggtaaagggatcaattcaacaagaagagctaactatcctaaatatatatgcacccaatacaggagcacccagattcataaagcaagtccttagagacctacaaagagacttacactcccacagaataataatggaagactttaacactccactgacaacattagacagatcaaagggacagaaaattaacaaggatatccaggaattgaactcagctctgcaccaagcagacctaatagacatctacagaactctccaccccaaatcaacagaatatacattcttttcagcaccacaccacacctattccaaaattgaccacacagttggaagtaaagcactcctcagcaaatgtaaaagaacagaaattataacaaactgtccctcagaccacagtgcaattaaactagaactcaggattaagaaactcactcaaaaatcgctcaactacatggaaactgaacaacctgctcctgaatgactactaggtacataacgaaatgaaggcagaaataaagatgttctttgaaaccaaccagaacaaagacacaacataccagaatctctgggacacattcaaagcagtgtgtagagggaaatttataccactaaatgcccacaacagaaagcaggaaagatctaaaattgacaccctaacatcacaattaaaagaactagagaagcaagagcaaacacattcaaaagttatcagaaggtgagaaataactaagatcagagcagaactgaaggaaatagagacacaaaaaacccttcaaaaaatcaatgaatccaggagcttgttttttgaaaagatcaacaaaatcgatagaccactagcaaaactaataagaaaagagagaagaatcaaatagacgcaataaaaaatgataaaggggatatcaccaccgatcccacagaaacacaaactaccatcagagaatactataaacacctctacgcaaatagactagaaaatctagaagaaatggataaattcctggacacatacaccctcccaagactaaaccaggaagaagttgaatctctaaatagacgaataacagaatctgatattgaggcaataattaatagcttaccaaccaaaaaaagtccaggaccagatggattcacagccgaattctaccagaggtacaaggaggagctggtaccattccttctgaaactattccaatcaatagaaaaagagggaatcctccctaactcattttatgaggccagcatcatcctgataccaaagctgggcagagacacaacaaaaaaagagaattttagaccaatatccctgatgaacatcgatgcaaaaatcctcaataaaatactagcaaaccgaatccagcagcacatcaaaaagcatatccacggtcaagtgggcttcatccctgggatgcaaggttggttcaacatacgcaaatcaataaacgtaatccagcatataaacagaaccaatgacaaaaaccacatgattgtctcaatagatgcagaaaaggcctttgacaaaattcaacaacccttcatgctaaaaactctcaataaattaggtattgatgggccgtatctcaaaataataagagctatctatgacaaactcacagccaatatcatactgaatgggcaaaaactggaagcattccctttgaaaactggcacaagacagggatgtcttctctcaccactcctattcaacatagtgttggaagttctggccagggcaatcaggcaggagaaggaaataaagggtattcaattaggaaaagaggaagtcaaattgtgcctgtttgcagatgacatgattgtatatctagaaaaccccatcgtctcagcccaaaatctccttaagctcataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaggagatgtgaaggatttcttcaaggagaactacaaaccactgctcaatgaaataaaagaggatacagacaaatggaagaacattccatgctcacgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggtatcacgctacctgacttcaaactatactacaaggctacagtaaccaaaacagcgtggtactggtatcaaaacagagatatagaccaatggaacagaacagagccctcagaaataatgccacatatctacaactatctgatctttgacaaacctgacaaaaacaagaaatggggaaaggattccctatttaataaatggtgctgagacaactggctagccatatgtagaaagctgaaactggatcccttccttacacctcatacaaaaatgaattcaagatggattaaagacttaaatgttagatctaaaaccataaaaaccctagaagaaaacctaggcaataccattcaggacataggcatgggcaaggacttcatgtgtaaaccactaaaagcaatagcaacaaaagccaaaattgacaaatgggatctaattaaactaaagagcttctgcacagcaaaagaaactaccatcagagtgaacaggcaacctacagaatgggagaaaatatttgcaatctacccatctgacaaaggactaatatccagaatctacaatgaactccaacaaatttacaagaataaaacaaacaaccccatcaacaagtaggtgaaggatatgaacagacacttctcaaaagaagacatttatgctaccaacagacacatgaaaaaatgctcatcatcactggccatcagagaactgcaaatcccacaatgagataccatctcacaccagttagaatggcgatgattaaaaagcaggaaacaacaggtgctggagaggatgtggagaaataggaacacttttacactgctggtgggactataaactggttcaaccattgtggaaagacagtgtggctattcctcagggatctagaactagaaataccatttgacccagccatcccattactgggtatatacccaaaggattataaatcatgctgctataaagatagatgcacaggtatgtttattgcggcactattcacaatagcaaagacttggaaccaacccaaatgtccaacaatgatagactggattaagaaaatgtggcacatatacaccatggaatactatgcagccataaaaatgatgagttcatgtcctttgtagggacatggatgaagctggaaaccatcattctcagcaaactatcgcaaggacaaaaaaccaaacagctcacgttctcactcataggtgggaattgaaaaatgagaaaacatggacacaggaaagggaacatcacacaccagggcctgttgtggggtggggggaagggggagggatagcattaggagatatgcctaatgttaaatgacgagttaattggtccagcacaccaacaaggcacatgtatacatatgtaacaaacctgcacattgtgcacatgtaccctaaaacttaaagtataatataaataaataaataaataaaatgatgcaataattaaataaaaatacagtataaagttgctggttaaatgatgaaagaatagtttctgaactgcacatgtgatttctgtagaaaaatttgtattactcgtttattgcttatttcttgaacaggagtagatatttagaattactgtttgtaactaaggtgttcctcacaatccaagccagaactgcgtctcgaatgtatttcccaccatttctctgagctccagccctctccaaatcctactctttatcagtgcagcttctcaccattgctcagtcacacaggattgggggagagaagagggcagaaggggtggctttgcacctccccattgggcaggcctttcctctgcctgaactgtgctttgctagttctctacctaacaatttcctactcattctttaattcgctaaaatggtgcctttgagctgtctccagctgccccacccagcttcccctggctccctccgtggtgccctcacaaactgtttacaaatttccaacatagcaattattgcacactgtgagctcttccctttgtgttccctatgcttactatagccatgttgctgcctaagggacacacgtagggaaataagactcagcaacacatcccattcaacaacagccagcataagaaatggtaagcttttaagccaggtgcagtggctcctgcctgtagtcgcagctacttgggaggctgaggtgagagaattgcttgagcccaggggtttgagcctagcctgggcaacataatgagaccctggctctttaaaaaaaaaaaaaaaaaagtttgcttcttttacattccctcttcccagagagggaagctttttctaatttacacaggcactttttgctattggagggctgagtgtaatatttgacaaaaacaatcaatgcttatctaataataataaaaatacttatcatttattaaccatttaccatgctaacccctttcatgcgtggttccatttagcactataatagcctatgatggaggtaacagcaccccatttctctgaaatcttcacatagtggatattgctgtcaaataaattatcttctactagggtgagctccactgacatgagacttgagaatgagtagaccgtaaaaatgtcatttattagacacaattttccaggcaccgtactaagcactgcaagtgcatttactcataagtggaatgcaattgttatgtgaatggcatgtccaatcaaggtgcaaaaattcctccccaggcagaagaagcattgaaggaaaacaatagcatgttctctctggctttaaagtgacaattggtttacagtaacagactcacccggtgatcactagtgtctagtacagaaataagaatgaacctgctgggctatgaattcagcatagatagaaaagaatgtgtgtgtgtgtgtgtgtgtgtgtgtctgtgtgtgtgtgtttgagcaagtgagaggaagacagagagggtttttttttttttctcaaaacgtagtattggagggcagtttgcggtgttttatttccttgaagtgtgtttatgtatcttcatggcttttatctctaaaatcttggaggaatttaaatcctagccaagtgaggatatatacttttatcagctagtattccaagtttagcaagcaatgtttgctttttcccttccaaaaaaaaaaaaaaaaaaaaacggatggttcagaaacttttgagccactcacatgctctcacattgtaaatgtgattcactcctctgactggccctgcttgtcatagaaaacacagtctacttgcatttagcatctgaaagatacctcaaggaaatatttagatgggagacaccgtgagagctataccgaagagcctgagacagaaaacaaggggcctgtgttctcatcccacccttccactctcctactgcatgaccaaactccctagcgagagtcctaatccccgtgatgcatcctgctaaaacgggactacaggctaggagtctcagctgtaatggatttgcctctatttgcaagttccccctcttttcattgaagtaggaagaagtgagaattattcaatcagtcacaacattataatgaatgctgtttattattgcacttgatttgttggtttgccctcaatcactcctaggacatgaatgctgcaagtgacctcttactctctgagtctggagtgacatcagatggtggggggtaaagagcgcactgtcagctcctgaaactgagtcaacatccaagggggtaaagctgaataccctctcctatctgaaggagggagggagggagggagggaatgaggggaggtagaaagaaagaacatcttcctagtatagagtctgaatgctgtaaagaaccatcagggtcatctcacttaactccctgatggtcagaaaaggaagctgatgttcagggagcaaaagtgactttcctaagctcacatagataaggaggacccaggccagggccaggaatcttgcctctgatttgcaccacatttatagcttaaatatttgcctattggccttcactagacattaagccccacaagcaaagtatcttgtgtgtgttagttcacagctatattccgtcccctagtgtgagcctccatactacgcgctcaagaaataactgatgaatgaagagatgaaccaaaacttacgcccaggtctcacatctctcagccctttcagcttgcactttctcccaagacatctctgatatgccttgtgagtttttaacagtatattaagggggagttgtatcaaaagtagaaactgttccaaataaatctattcaacctggatgttctttgtctataacccattacttacaacatacactaactcacaaggtatatttcttgattcagtcttgaaatgcgagcaaggttaatttgacttagacaaaagaaatggcttgagagatggagtaccataagagatggggtaccataagtctgagagatggagtaccatgagtagtcaaaaaggaaaaaagcactgtgaattttgtcttctgaagtaggcacgtagctactgcatttctgaaagtaacttgtgatagaggaaggaaaatatgctctgtaggtggagagatttgggttccagttaggactttcctgttttctagatttgtgaccttgaacaagttaccactgagcctcattacaagtggtgatgataatgtgaagtaggcattattattaaattcatgatgcagatgaagaaaatgaatcctaaaaaagttaaataactagtccaaggtcagatggccagtgatttgaatcaaacttattagcaaggactctcaaaaagaaaatgtgtctaatagagaagcagtgtgcctggcccgtctgacaccaggattggactcttgtccctgccttgtgcactttccttacttaacaaatgcctgggagcatataaccacactggcctcaccccgtaacatcacgtgactacatttgaacaaactatattatgaaacagtcattgagctctcccttcctgcctgtaataggtcacagcatctgttcctctactgcagacaacagctattaaccaattcttccgtcagccaacattgcttaggcaattaactactgtgtactcagcaactgctaagccctggaagaatccaaaccgaaaacaaaacagtagtgaagtttggtctttggagtccgagacagctgagtttgaatcccagttctgccacttgccggctgggcaaaattatgttatctctctaagcctcagttttctcatttgtattgtagatttatatagaaaaaggtatttgtgttgtgtttgtgtgtgtgtgtttgcctgtatgtgtatatgtcatagtgttatggggaggattcaatgagataattagtgcaaaatgtttaagaaggtatgttgtgacaatggcacagaggagagctcaataagtattagttgctagtattaagaatgtatattctggccaggcatggtggctcacgcctgtaatcccagcactttgggaggccaaggcaggtggatcatgaggtcaggagatcgagaccatcctggctaactggtgaaaccccatctctactaaaaaaaaaaaaaaaaaaaaaattagccaggcgtggtggtgtgcacctgtagtcccagctactcgggaggctgaggcagaagaatggcgtgaacccgggaggcagagtttgcagtgagttgagatcgtgccactgcactccaacctgggcttgacacactgtctcaaaaaaaaaaaaaaagatgtatattctaaatgggaaaaagacacaatttgagttatcaaagaacagttgtgacggttaatactgagtatcaacttgattggatggaaggatgcaaagtattgatcctggatgtgtctgtgagggtgttgccaaaggagattagcatttgagtcagtgggctgggaaaggcagacccacccttaatctgggtgggtaccatctaatcagctaccagcatggctagtatataaagcagtcataaaaatgtgaaaagactagactggcctaacctcccagactacatctttctcccctgctggatgctttctgcccttaaacatctgactccatgttctttagttttgagactcggattggctgtctttcctcctcagcttgcagatggccttttgtgggaccttgtgatcttgtgagttaatacttgttaaactcatatatacatatatatatatatatatatatatatatatatatatatataataaaaatatatatgtaaatataaataaaaaacaatatcgcatccctggagggattatggagattagtgccaccatcaaggacttaaaagatgcaggggtggtgattcccaccacatccccatttaactcttttatttatttatatatatctatatatcctatagatatctatatagatatctataggatatatatacttaggatatatatctttaggatatttaggatatatatatggatatatatatagaggatatatatgtgtatatatatggatatatatatatagggtatatatatgtgtatatatatacagatatatatataggatatatgtatgtgtgtatatatatatatatcctatttgttctgtccctctagagaaccctaatacagattttggtaccaggagtggttctaaaggaacagaatattaaggatggagttctttcattagttttgggggtttttggaattggcttcttagtatgattagacccaaaaatgctaaggaccctacttctagtagcatggagaacactgatagtccttggcatgaactgtttagagagttatgcaaaataaatgcatttgacattcctgattcaccatttgtgagaggcaaggagtttattgactctatacataatacttttgaccatatgtggagaaccaaggaacataatgaagctgcttggttgctcctaagttcagtagacaaagtgatgaaagaaaaggatgaacccagggattctaactcccagcttcagaggcagacactgagcctcagattgctaagattgccctgagtgagagtctcatctcctatgtgaaagatgaaattgtggaaaaacaggcacaaactcttatcatgcgagtggctgacctgcaatgaaaggtgcatgcacagtctcatcagatgtctatggttaaagtgagggcattgattggaaaagaatgggaccctgcaacttacaatagaaacgtgtgagagaaccctgataaagctggggacactaagtttgtaaattctgatgaacctttttttgccagaagaaacagcttccccatccccagtagtgtcaacatcccctcccaacccatgctgccatcagcctttccacatttgtctgaggagataaaccctgtgctgcctgaggcaaatgtgatggcctcccctgaggcaggtgccaggcaagataatgttgattctcctcaggagccacctccaacacccctatttgcgtctagacctataactagactaaacttctggctggtgcctagagggaggttgagagtgtgacccatgaggaggtgcactacactcaaaaatcaatgctttgaatataaacataaatctggagaacaggcatggaaatggatattaaaggtgtgagataatggtggaaggaacatagagttggatcaggctgaatttattgatttgggcccactagggactctgcatttaatgttgcagctcagggacttagaaaaggttctagtagtttgtttgcttgtttagctgaaatatggattaaaagatggcccactgtgagcgagctggaaattctaggaccaagtttagtggaaactgaacgtttgactacgggtcatccagttgccatgagacctgaactgccaatcatgaactaagtgctttctgacccatctagccatagagtgggccgtgcacagcagcattccatcagcaaatggaagtggtatatacatgattggtctcaagtaggtcctgaaggcacaagtaagttacatgatgaagtggctcaaatgtccatggtctccactcctgccaccctgcaccaatggcctcatggggagttccctatgatcagtagacagaggaagagaagactgggtcctggttcacagatgattctgcacgatatccagataccacccaaaagtggacagctgcagcactacagcccctttctaggacatccctgaaggacagccatgaagggaaatcttcccagtgggcagaacttagagcagtgcacctggttttgcgctttgcatggaaggagaaatggccagatgtgcaattatatactgattcatgggctgtagccagtggtttggctggatggtcagggacttggaagaagcatgattggaaaattggtgacaaagaaatttggggaagaggtatatggatggacctctctgagaggtaaaaaaacatgaagatatttgtatcccatgtgagtcctcaccaatgggtgacctcagcagaggaggattttaataatcaagtatataggatgacctgttctgtggacgccactcagtctttttccccagccacccctgtcatcgcccaatgggcccatgaacaacgtggccatggtggcagggatggagattatgcatgggctcagcaacatgggcttccactcaccagggatgacctggctacagccactgctgagtgccccatttgccagcagcagagaccaacactgagccctcaatatggcaccattcctcagggtgatcagccagctacctggtggcaggttatatatatattgcacctcttccatcacggaaagagcagaggtttgtcctcactggaatagacacttactctggatatgggtatgcctgtcctgcacacaatgcttctgccaagactaccatctgtggactcatgaagtgccttatccactgtcatggtacacacattgttacacacaccccacacagcattgcctctgaccaaggcactcactttatggctaaagaagtgtggctgctcatggaattcactggtcttactatgttccccatcatcctgaaacaactggattgatagaatggtgaaatagctttgtaagtcacaattacaactccaactaagtgacaatactttgcagggctggggcaaagttctccagaaggccacgtatgctctgaatcagcaactaatatatggtactgtttctcccatagccaggattcacgggtccaggaatcaacgggtggaagtggaagcggcaccactcaccatcactcctagtgatccactagcaaattttttgcttcctcctcccacaacattacattctgctggcctagatagtctgctggcctaggtagtcttagttccagagggaggaatgctgccaccaggagacacaacgattctgttaaatgggaagttaagattgccacctggacactttgggctcctcctacttttaagtcagcaggctaaaaaggaagttacagtgttggctggggtgactgacccagactgtcaagatgaaatcagtctactacttcataatggaggtaaggaagagtatgcatggaatacaggagattcgttagggtgtctcttagtattactgtgccctgtgattaaggtcagtgggaaactacaataacccaatccaggaagggatagcccaggccctttaggaatcaaggtttaggtcactctaccaggaaaaaaaccatgacctgctgaggtgcttgctgaaggcaaagggaatactgaatgggtagtagaagaagtcatcaataccagctatgaccacatgaccagctgcagaaactaggagtgtaattgtcataaggatttcctccttcttttgttaaaaacatgtttgtgcatgtaacctgtactaagaaaatatcttcattttatttcctttttcctttatcatgtgacataagatttattgacctcacatcagcatagaagtattgttaactttaatagtatttgggttggagattggtgcatttctggttgtacgaaggatagttgtattatgttaggtgtaattatgaccttattattgtctttatttgaagattatatataatctcagaagatgtgtatgggttcaagttgacaaggggtagacttgtgatggttaatactgagtgtcaacttgattgggtggaaggatgcaaactattgatcctagatgtatctgtgagggtgttgccaaaggagattaacatttgagtcagtgggctgggaaaggcagacccacccttaatctgtgtgggtaccatctaaccagctgccagcatggctagaatataaagcagacagaaaaatgtgaaaagactagactggtctagcctcccagcccacatccttctcccatgctggatgcttcctacccttgaacatcggactccaggttcttcagttttgggacttggactggctctcctttctcttcagcttgcagatgccttattgtgagaccttgtgatcttgtaagttaatacttaataatatatgtgtgtgtgtgtataaatatatatatcctattagatctatctatatatatatatatatatatatatatatatatatatatatatatatatatataaatgggtgtgtgtgtgtatatatataaatatatatatcctaattagttctgtcactccagagaactctgaccaatacaacagtcaagagctctgcttaattccttttgctggtagaataacctccctatcttgctccctattctacttggtgaataatggtctatttaatatttagctcacatgtcccctcttgcttgcctatcctcccctccatagcagaacttatcctgccttcttcatgccccttgagtactttgcgtgcactgtcacattgccttagtaacttagaaatctctgtcattaaattgtgaggttttttagagcttattgtagccccagttcctagcacagtgcctggattattcatgtgctcaaaatatattaggtacatgcataaatggatgtaactatctgataattatttcctaattatctacagtaattaggaaagccttctaacaagagaaagttcatgagaaatgagtaacttcagaagtactggggagacagcaatggaaacagaaaaagaatggggatcctgtaactttaaattggtgtaatcaacgtatggatctcagtgagggtaatttccttacacaggtaagggtaaatcagcttataggttttggccagccccatggagtcacataacctttaggataggtatgtaagaccagccagtaaagactagtctgagagattaccagaagaggagaggagcccttagggaagctacagaagaagtggcattcctgggagtgaagaaatgaaattgaggcaagacatgctccctgcaaatgagcatattacttcatacccatcaaaagtattcagtggtgtcatagcccttggggattgatcaccaaaatctcattgcttgaatcacttgaaaaaaatagagattatattttagaaataaggtataaaattttataggaagtaatttgcctggagaagttctcagcagtagttattgtggctatccactgagagcagagtaaaatgcacacttggaatctttgcaagcaatcacagaaaaggtagtatcgtataatagataagagcgcaactctggagccaaactgcttgggtatgaatcttggcttgtgactcctagttgtgtaaacccttaggcaagtgactcaacctttctctagctcagtttccttatgtataagttgtgaacactatttgtagccacttaataggacttgatatgtggaaagcacttagaatgattaatccatgtaaagcacttataaaagtatccgctatatgagtaagcatttaacaaatgttaccaacaaatgctattattattgacaagtactttttatctatttggttccacacattattctggggtaccttgaagagtgcaaaagaaaattttaagataagatcctcctccttacagggttaagctgaagatgaaacgaaaaactagcatcaatagagcaattagagaacccttaagtccaaactgagtaactgtggttaaaggaaggaaaggatcaggatagtcagagaaggggcctaatgtggtgatatgtacttagtgggtgctcaattaaattcattaaagataacccagacagaattttcactcacattaggattttattaactgttatgtcagtctctggatttggggggaaacaatcacaggaacaaaataataccctcaattagcaatgcatttagagaatgctaaaatagaaaagggaaaaaaggaatttatcttttagcttgaccttgaatgaggtttcaggatttgagaatggtagagatgaaagaaacctcagagatcctcagcgatcaactggtctatgcactgtcttttatatatgaagaaacaggcccagatatatgaatgacttgttcaaattgcactggagaaccaggtctcctcattctcagtctgattcttggctccctgtggacattggtgggcttcactggattctgaaagccattctccctgcccaacactgatcagttagtcggacttccatctatggaccctagagcttttcctgccagtggttgctcctgtaacctactgtggccattgtgggctgacagccatattgtgagggattaggtagctctctaggcattgacaagaacctttgaattttagaaaatatccaaaaaaaaaaaaaagaaaagaaaaacagaaaaaaatagaaatcaagaaattagcaatgtgaccaacaacgtatgttctgagccccatttctctatctaacatatgggaatttaaaaataatttcaacatgtccaattggtgagaataactgtaaagtgagcaaagtagggaataaaggttttttcttctttacttagttttgttttgctttctgaccctttgagttgtagtataagccatagtattttgaaacttaatgatgaaatcctatacaattttaggcttatgaaataattaataggagtcacaaagctggcaatttcctgtggaatctaccacacagaatgatgcacaaattggcaaagaaaatgacactttcagaatctattattaaattttatcatctcttgcactagttccaaacatgaatatctaaatgaagataaaattgctaagggctcagtggaagccttgacacatagtgggacatacaggcattcaataaataaatttattaataaaggaataataattataacttaattagtaaataaaataaataaataaatgaacaaataacccccctagctgacagtagcataaaagctccatcagctttaatgaacctgaagaaagctgtttcagttttttccaaaaactggacctatgacccagtgaccacacaaagtttgatgtttgcaaggcaggatggatgttggaagaaatgtagccgtggtggataatacagtgcaacaacatcatctttgggatttgattctctgatacttctctcatattcccaatttaaggtcatgttcatatccatgctggaatactttgaatcctagcaaataaattaatactaaacctagtctgccaaagccctgtgttcagaatgacggcaccttgttagaaggcttgcctaattactctaggatcctccgtcctagatacttacatccatttattcatgcaccaaatatatactgaacacatgcataatccaggcattgtgctaggaactggagctacaatactaaagaacctcacaattcaatgacagagatttctaagttactaaggcaatgtgacagtgcatgcaaagtaccgaaggggcatgaggaaggcaggataagttctgctatggaggggagtatatgcaagcaagaggggacatgtgagctaaatattaaagaatagatcattattcaccaagtagaatagggagcaagatagggaggttattttaccagcaaaaggaattaagcagagctcttgactgtcgtattagtcagagttctctggagggacagaactgatatatatatatatatatatatatatatatatatatatatatatatctcctattagtggaggaaatatatatatcctattagaggaaatatatatatgatattatatatataatatatatatatgggagtttattatgtattaactcacaagatcacaagataccccaataggcagtctgcaagctgaggagcaaggagagccagtccgagtcccaaacagaagaactttgagtctgatgttcgagggcaggaagacttaccttataaggaggcaatacggagagtgtagagggtgttgaaagggaaaaaaaaagcaatcatgatacattcttgggaccagttattaattacgaataaatggttgctggtggaaatgtcaattcgtacagattatttgaaagcaatttggcagtgtgtcaaaacttttaaactattcataatttttaactcaataatttaacctttagaaatctatcccaagaaaataatccaaaatgcactgaatggtatattcattgcaatatagactacaaagaaaatggaaaacaacaaacaacataggaatgttaagccactgcagtaaattcacttgaaatactattttgtcattatgtttataagacaccttggtttgtagtcttcttttctcgtgatatctttgtcaaattttggtatctaggtaatactggcctcatagaataagttgggaaatgtctcctcttctatcttttagaaaactttgtgagaattggctttcattcttttttaaatggtgtttaatagaattcaccaggaaagccatctaggcatgggcttctgtgtggataattttttaaatcactgattcaatctctttacttgttataggtctattctgcgttttaattttttcttgattcaattttggtagtttgtgtctttctaggaattagtccatcttatctaagttagctaatttactggcatataattgttcatagtattcccttttaaatcttatttgtgtaaggtcaataataatatctcttcttttattcctaatgtttgcaatgtaaatctttgttttcttggtcagtctagctaaggttaatcaatttcatcaatctttgcaaaaaaaaaaaaagatttttcttccccactttgttttgttaatttttctcaatttttaaaattctctgtttcattaatttctgttctaatatttattattgtttttttttttctccttgctttaggtttagtttggtcttacttttccagtatcttcaggtagaagattagattattcctttggatctttttttagtatagacatatatggctataagtttttctctaagtacagtgttagctacatcctataaattttggtatcttgtgtcttcattctcattcatctaaaagtagtttcattttctcttgtgatttcttctttgatccattggttagttaggagagtgttgcttaatttccatacatttgagaattttccaaattcctttatgttactgagttttaatttcatttcattgttatatgttcattaaaactgatgcttctaaagattttctaataattgggaaagtgtgtctattactattaaaattggcttctatttattgaactatagtgtcagcaactatggtgagagctattaatatgttatcacatttaaatacctaaaactgaggctcagagattaaataatatttctaaagtcatacagccaaattccaaagtctatgcccataacacttcattatgtgaaatagtaaacttaaaaatcggaattaaaattatacagaaaagtatagtacaactaaatttaaacaggatacatttttttaaaatgaagaaataatactaagggatatttgtatctctgtaataagatgataactttttcctcaattccctttgaattttttctaaaaagggaagcttccatttgttaatggaaaaaagttgttgttgttttttttttaataaattaagcttttagttaggaaagggagtaaaggttaattgggaaaaaagttagaaaagaaaaattaaatggtagattttattggagttattaatgctactggaaatctttaaaagttttccattattgaattgtggacaatagatagagctgaaaatgtgacactatgaaaaaatgcatacaagcaaatagctaagccacctcatttttattactagtaataaaaggcagctagaagtaaatgagatcattgagcataagaattatgagattaaattcatgaaaaaaagacaaatctgagataactgcagagaaatgcaataaaaagaaactatgtgggttttgttttgttttttgttttttgttttttgtttttgagacgaagtctctctgtgttgcccaggctggagtgcaatggtgtgatctcggctcaccgcatcctctgcctctcaggttcaagcaattctcctgtctcagcctcctgagtagatgggactacaggcacatgccaccacacccagctaatttttgtatttttcggggttttgccatattgatcaggctggtgtcgaattcctgagctcaggtgatccacctaccttggcctcccaaagtgctgggattacaggcgtgagccaccacgcccagccggtatggttcttattcttccattacttctcccccctttcaccagatgttcagttattttgttgtgtttgttttgttttgctttgcccacattttctctccatactcatagtagaaatcattgctcaacattttggttcctgcattcattcagtgagtattgagtacctgtcatgctctcaatcccagagataccaaaatgaaagtaacatgttacctgctattagatcataatgtgataggagagaaatatataaaaataagtggcattcactgtgacaacattgggtagaacacctaagcataaccttaaaaatgctaagtgtttgtgagatggacaaagagaaaagagtttctaaaaccacctcctgagacaagatatagaagattaatctatacatatttaggagactagcatgggctggaaatacagttttgggaggtgtcatggttacaaccatgataatatatggattagacatccttcctaactcttccactgatttgatttctaccaccatagcttagttttgcctgttcttggacttacagtcattggaattatctatctgtattcttttgtgtctgccttctataatgcttttatggttcatccatgttgtttcctgcatcaatagttcagtcctttttattgttgagtagcatttcactgtatgaatataccgcaatgtattaatttacctgttgatggatattagggtagtttccagtttgaggtaattgtgaacagtcttgtaaagatacctttttgtggacatatgtttttctgttaggtaattttctaggagtgaatttctaagtcatacattagttatatgattacatttacaagaagataccaaactatttttcaaagtaactgtatcatgttgcatttccaccaatttaaatgagagttgcaagggctccatgtcttattaacacttaatattgtcagtctttaattttagctactctggtgggtatcaagtgaactttggctttaatttgcatctccccgatgactaatgatgtttttcatatgctttctgatcacttatatatatatatatatatcttatgttaaatatccagtcaagtctctagctcattttttattggtttttctatttatttttcaattgtaggactttaaaaatactttgaataaaaacttttcagatatatatattgcaaacattgtttcccactttgtgacttgtcttttcattttttaaatgacttcttttgaagaacagaaatttttaacttgggctgaagtccagtttaacaacttttttatttatcatttgtgctttttacattctatccataaatctttgcctacctcaaattataagtatattgtatgttttcttctagaaattgtacagtttaagcctgtgtgtttagatctgtaatctatcccttaataattttggtgtttggtatgaattgagtcaaagtttattctttcccaagttgctccagagcatttgttgaagcagttttagctatgggacatccaggtgggcatgagtgagaggttggacttatgagagtgaggttcaggaaagcagcctaagctgaaaatattgttttggggagagccatagttattataactatgttaataaatgggtacgacaatttctaacctcaccaatcttcctctttaatagcagcagacagagaataatatgtcataagtactatggtatgggtaaaaacaggtatatagagttctgtgacaacttagagaaggatactaactcaacttcaagttgagaaaatgagatgacccttaagctcagttttgaagatagagtacttcagcaggataaacatgaggtggagtggaagggcagtccaaaattagattgtttttgtcaattacaattctgaagtagataaacaaaagcatggcaagcactcactgtattctctgcttgatgtctcaggtttttctgataatagcatgtcattctttggagaatacctctccctatacctcccccactccaacagacacacacatctaccacggcgaagtaatttttatgtccacatagaccctgcccactgccaccactgtcataattagatgacacagagctgaacatctaatccgttctgagcacatcagagatcttccctgagattttttagcttgaacccaaagagtgctagagtcactcactggtttagaaactataagaaagggagcttaggattcagtggtagctgtgtttgccaccatgtaaaagggtctgatcagtagggagagaaaaataaagcaaacaaacactccaggagatagagtgagtgtcctgattgcatttgaatcttctattctagttcttcatgtggtttagctgcatgtggcctatctcatttggttgttctacagttcctcagatttgatgagattttctagtatccttgcaataaaattccttttctttatggtagtacagggctgccacatagtctgtgccctgctcaacttcaggagacatccttttcaaacataggcactggtaggcagggagctccacctagaagcctttagagttctcacctcatcactaagggctaaggatggtgaactgggtgtctctgcagtctggggcaaggttgacaggaatcatttgttttaactaaaaaatccatacaaatttgaggatattgtgtaaaaaaaaaaaaaaagaaataggcagttcaacctaaaaaacagccataaacatggtagttgttccttcatcttgtgggacgtagagtcagtcactgtttctgaaatagcctcaggtaagtacctaagagcccggcagaggagtaatttgagaatagagctaggacagctcctgcatcctgggatggtggtggagctggcataaactaaatttgcgggtttacaagaaataatctagtgtgccatttagttgagtgtttctggttaatatgaaacttctattcaatactgtttttaaaaatggtaattatcagtacaattcattttggttagtctataaataattaggacttaaagtgaaactcagatagcagttttatttgcttcagctctgagttcctgtaatacctgccagagcagcttgatgatgtgacaggtctttaatccacagcggccaggtggcaggagccacagtaggcagactctaatgaggcaagatcaggtctctttagttcataaaaccagacaaggatttatggtagacagtcataggaaacatggggtttgagtacacagaaacattctgctttgataccttggctttattgcttaacactggaaaacatcacattctctttagattgaatattatttgttcagcttctccaggtcctagttgacagttctattattgttaaagtccctccctaagaacagctccacacatgatgaataattggtcaacttgaaaatcctcccacttttttacaaataagccagtttctgcattgatcattgatttgtttattcactagcagactttctgccaggtactaggttagggagatattgaaaataatcagtaaatgaagtaaaaataagcactttacttaaggagccagtctacagtttagtagaagacagtcaagtaaaagataaaaaatagagagcaataaaggccagaatgtggggaaacacaaaaggagttggagcatgtattcattcaacaaatatttattgagtatatactatatgtacatgttctaaggcaccagagagatggcagtggatgaaaacacatttcttattttcagggagtttacatttccatggggaaaacagaaaataaacaaatgtgtatgcaggcagatggtgataaatgttgaaagagagagaaaggaaggaaggaaggaaggaaggaaggaaggaaggaaggaaggaaggaaggaaggaaagaaagaaaagacaaaggaaggcaaatagtaatagggccagcacaattttagacaggcctgtcagaaaaagcctcactgataagggggaatatgtgagtagaactctgaacgatgtgaggaatcagccttctaagggaagaagattacaagcagagggaacagcaagagcaaagtccctgaatcaagattcaaggaaatcttgaatttaaggattcaaggaaaagcaacaaggccaatgtggcaggaagacagtgaggcaaagaaggcacagtggcagaggagatcaaagtggtagctagagctggattatggagagcctttccagccatgttgtacattttgggttttattctgaatgaggtgggaagtcactggaggatctcgagcagaatgacatgatctgaattacaattttaaatgatcaccctggctgctgtaaggagaataaagtgcagcaggaataggtggaagcaggaacaccagctgaggtcaatatcatgctccaggcaagagatggtggtgacttggactggggtagtagtggtggagatggtgagaggtggtcagattatgggtgtattttaaagctgagaacacaggatttattaaccaattggatgtggggtatgagagaaagagaggcgtccctgcaagtttgcagcctgcgtaattggaagagttagaatttcccaagttgaacaagactgagggaggaccaaggtttttgtctgcttgcttggtgtttatttgcttgttgagggtttgtggagaagaccacgtgtttggtttgaagactatgtattagatatctaagtaaagatagtgagtaggcaattaattggatatatgagtctggaactctgggaaagtttcaagctggagacagggaaggctcctagctggggagggagggagaggagactcaaaaactgagtccaaatacccccaatttttaaagaccagaaagatgaagagggatccagcaaaacagactgaggacaaatgctatatggggtaggatgacaatgaaaatgtggaggtgtaccagagttcaaggaagcaagcgtttcaggaagaaagatatgatgaactatgtctaatgggaagatcaacagagtaagatgagacctgagaatcaacatttgattgggcaacatgaagttcattggtggccctgaataaagtggtttagataagtagccaggaaactttttctgtaacgggccagagagtaaatattttaggctttgcaggccatctgatctttgctgcaaatactcaattctgctgctgtagcactagtcataggtagtacctacggaatgagcatggttatccttgaataaaaccttatttacagaaacacatagtgggctggattggttcatgggccacaggtcactgacctctggtgtagatgatgttacgatatttgaagtgtgattgaagtaagttcagaagggaagagaagaagggataactttggaggagttttgctgtaaggagaagcagaaagatctgagtggtggctggagaagggtgcaagatgagagagaagagaaggtctctatttccttgggagaaataagtatgacatctcagacaaagtgatgctgtagatgtcttgggcctcaacgttaaggaaaacatcctacttactatatgcattagagtcatcgtaaaatccagcatataatttcagctactccttagctatactgggcttggtctctatgccctttggttacctgagctttttactggaattgagcctccccaacttagactgctgactgagtgatgtgcttttatttagcatgatcagtcttagaaataacataaatgggggaaaaataaaacaggtttcatctgggattccatttcacagaacttaattagaatgattggcatcttgtgattttgatttcttcctaagcaaagaactctaaattgaatttcattttttgagatcaaaagaggattagctcccacagtttcataaataatgaacccagttctcagccttcactaggctacaagtgatagtcgttgggatttgatttttccctacttttctgatctgcttctttttcttatttctaggtacaggtagccccttgtgcttcatgcgagttggaattgtttttattcctggtgttagatttgaagtagtaacaaaaaaaaaaaaacagaaaaaaaactataaaaaggaaacaaacatttttcctgctattagctacttttattaagtatttttaaggcattgcattaagtgctttacaattcatcttttttcttatccttattatgaaaatttttaaacatataaaaagtagaaaaagtagaattatgaatatattttacctgttactaagcttcaacaattaccaactcatgttggtataatccgctgaattgagagaaagttgtagaaaatatgactttttatttttctgactcaggactacacattgcattctgttggtcctatttccttatctcctttaatctagaatgattccttagtttttatggttttcatgacattgacatattttatagttttcatgacattgacatatttggcagaaatactacagaagtgatgttgtgtacttctcagtgttttccatcaggaggcccatggtgtcatgttgtcccacaatttggcgatgctaattttgatcacttgattaaggtgatatttaccagatttctccactataaaggtatcttttcccctctttttaataattaaataatctgggaagagataaatatcctattccccaacaaactttcaaccaatgctttaggcatccacagatgattcttccctaacttgactattatagtgatgattacaaaatggtgatttcctgactttatccttccttctataattattagtcatactctaaagaagagcttttcttttatcccatttttagttacatcatttatgtatttttggtaatcagagtgaactcaaatttttttaattgaatgtgttatactttattactgtcgttattcattttaatattcaaattatccaggttttgtttgtgtcttttcatatgctaccattcattttaggttttgtttatttgttttgtgtttggtgtcatgtttatatttaatactgcttactttctagccccacgaaatgtttcagactcaccttatactttctctgctccagccttggaatgagccatttctctaaaacattctaggttcttttgtggaaaatggcatccagaagacaaaatctgagtagtgaatgtgcattttgctgttagggtttcattacatctaagctcctttaatggatagagaagaaataaaactttttagaaaatcctaagtttatatctcatgcctctaattactggtcaccatcttaagagtcttcctctccttcctccgtaccacgtttgtatctcacctttctttcacagtgacaaccctggttcccaacaacatccatgtgtttactcatttactcaaccctacagcacacaccaaatggtttcagaattgtcatccctgtatcacaaccagcaataaacctgttaagtgaagttcgaggcttctttacagatctaccttcacaatatactcagggggtacataagtactacatccctcccatattaatttgaagcaatccaatgcatcagattttttcagctcttaatattgcaatatggcatgaccataatgccgttattacacataaaaattgacaattagtggatcaacaagtatccagtattttttcagggccaaattggctcataagtatcacagatgggtttggttgttgtaattgttgctttgttttgttttataatttgtttgtttgaatcaagatcaaaatgaagtctatacattgtaactggttgatccttctcaaagtttcttctgatctatgtgttttcctgccattttttattggtttcttgcaattttatatagatgaaatcagatagtttgtcttgtagagcttcccacattttggattttgctgattgattgcatttttatagtaggaattaccatgtttctctgtcctctttgttgctgtaaactggtagttcaatccagaggtttggttagattctgattcatttgagggagttttgttttgggagtaaatagaggttttcaagactaccttgtaatattttattcttttatcagaaggcgtgaaacatctgactgtctctttgtgattgtagcagctactgatactcaatgcctacatccattagttcattaggtttgcagaagtaatctttttttaattaggcaatgttatagacacacatgtatacgtgcattcacatagacacatttctgtaagcagatatatctcaagccaactcttatctttcccttaacccctctttgttacattattacttgttcttttacctcacttgttttcaaagttctctttttatgtgtgtgaaaataagatttgtataatacaaagtagtggcccaaatgtacagtaacaactttcccaggggaacacaattattttagaggagaaacaaggagaggaaaatagcatgtataaaacaataagggggtcacagaaaagacgtatctgagctcagtataaatttaaacctaaattctgcccagagaacacctgtattactaagatgacattttagaactatgaaacttttttaaagcttgagaaataagaacaggaagatgaggagaaaaagtaaaacatgtccctagttttaaggttttctggatgagaaagataaaatatgtcaagattcactcatgtgtgtttaaaaacatgagatttgagtaggaaaataatttgagttttttgttttgtttccttctttcatgaagcatgtattttatcttaagccagttcaccaatgccattacatctcagagtcaggctgggcaatttcatgccatttgacctaacaacctggagacttctgagtaatagtgactcctagtatgggtgttctaatgtctgtcacaacatgaaaggtattcatttaacagagacaaaacaaaatcagataaacaaaagacatgtagatctaattgattgcgagggttggaatgagtggtttactctcattcaattaaagataaaaattatttacaccaaataaaattagaaaccggctacaattgtttcttctcagtccatactatgagattggggagagggtccttttttaaaaagaaatggctttattgagatataattcacatagtatacaattcactcacagtatacaactcaatgttttctagtatattcatagagttatgccaccatcactgcaatctaattgtataacaaacattttatctcccctaaaaaaaaccttggctgccacttcccaatctctgtgcccactatccccagctctaagcaaccacaatttacctttgtttccacagatttgccagttaatgggcaattaccttttaattgccgttcatggcctgtcacacttaaattctttccttttttacattatcataaaaagaaaaattgaagaaagtccaaaaaatatgaatgactatcacaaaaattgtaacaggataaccaaaatgatgttgttgaatccaatagcatctgatgatttaaataaataatcttcaagcatcaagctgtgggaagaacacactgtgatatcacttaagagagtcaagcactaataattttaaatataaacttgaagcaggcttaagttgcagaaacttgtcatgctcttaaaaacagtgatatttgcaaccaggaatatttgcaaattcaatttctgacttctctgctcaccaattgtgtgactctggggcaagtaatagaagatttatacacttcagattcctcttctgtaatatgggaataatgatggtactaacttcatgaagttagcatggagattaactcatgtagagcttttggaaccaaatgtggcacataagtgctcaataaatgtttgttagttattgttttatcatctttaatagttagaactcaacattttaggtcaaattccaaaatagaattcttagatttgccagcttgccccatgccacatttgattggtattttcaaagtgtctatttaaagatgtttcctgctatgaaagcaatggatctagagctaagatactgtcactagagagacaaagaatatcattgatcaagtataattgagaatagggctgtaaatcagccatcagttgcttcagaacaatgtgttctacaaataatagcagaattgctaatttattattctcacctagcactcgtgtaacagattttcattttctatattaaaagaaaaaaaattacagcagcaaaaaagcttatataatggtattacacatgtctaataaaaaataaagaatactgttaaagcattataaaccacatatagtctctcttatagttgaaatgtttagctaagatcctaaacatgtgacttttaagtctgtgaatgtgaactgaaattgtgatttggtttttttgtccacaaatgtaaggaaatgtaaccaccaatacttccattcccttctctttaattccaatctgaaatggcttttgctaataagactgacatgttagatacttttattcttaaagtattagtgtgtattttctgttcttttgtaaagtgtgatgcttagtagtattatgtcccaatcagatgattcatgatacacaacattttcatacttgggaaatgttaacacattatagtccttgctttgaaacataaaagaattaatcacagataacacattttcatattcctttgacccttgagaccatttaaatgatgtggcttgcatgcagccccattttgggccctcaaagccttctgcattgtccctctctgtctacattttcaccccaggctttactcctcttggcattgttttgtatttgcatgaaaatgtgtaattttttttttttgcatgacaagtcattggtgatgttgaagttaaatgtctaacataccttgcagtatcacatgccattaattcttacatgattttttttcttttattttcagttactggagtttaaatatgcttgaaatgtaaaagtggcatgaaactggagtgatgcaagaatatttagtattcttttaaggactatcatttttaactaggaaaatttgggggcagttctcaaccttgtttttggacaccaaccctaaattacaattgatgataaaactatattgaacataggtgctgtcagcagagtaataaattctgaagtgatacctcttttccctctgagaatgtaattttagtacttgaatgtaaagtatatgtcccctaatttcagaaattattaattatttggttcattatttttcataaaaccttattaatgggcatacaattgagctctactactttgctgaaagtttctactacctaaaaaagtaatgaattacttaccgagtgacagcaccaacatttcagtactttaatgtttcctaaatgaacatggttaccaaaatggatatttgatatgggaatgtatgagtatacaaagaagataagttatttataccattttgtcaagcttcaaatccataagggcacaggactcattcccagcaatgggacaaaagcgcacatccaaacaggtgtcctttccttctaagggtcaccttgctgctctacatttattcttaacagcttccattgccaaaaatgtttttgaatacctgttttcaaattgccttcagagtctttggcaccttcatttcaatagccgtgtggtaacaaatcttgatccttggggagtgattttaattttttcagcagctgaaagaccctcagagccaaatcagccaaacaagggtagtagtcaatctgatgaaacatattttttaatgatatatgaatatgaaattagtaagacctgcatggccaataacttataaaatgactgtcaacacatttcccaaagagaaaccccacaaaacatttgcataagaacagcagcagtggaattaatggaatttccttagggagtcttctaggtaagcacatgatatccacttgaatgaataaattctaatgcctgtatcgtattatgtatctatgtgttatttttaattcagcctcatttaagctaatggaatagtttagttaaaatttttaaagacagtcattcttactttttttacctgatcagaatctagagtgactgccatttttcctttgataagttaagttaatatcaagttaatacccctttagcagcaattttaacagattttggttgattgcctcatggctgtcaccaactagctctgtgatagcagtataggacacaacttctctgtgcctctggctccctgtctataaaatgagggcttggggctaaattattgttaattattgttaaaaatctcttttgaataaaaatgttgtattctaatgattatatattcatgtgtcagtctgtaattataccataaatctacatacttctttgtgcagttttaatttaattaaaactaaacagaagtaactcaaattcaaattattttaaaagacatcaagacactaagaagaaaaccagtttctccaataaagcgttttctacctgatggtgataagacatttgtatagcactttatgtttacattgtcttttgtgagtctcacaacgtaagagctgctatcattgtcctcattttgcagatgaacatactgaggttcagagacattcaattccctttctaaggtgatgaactagcaagacgtagagccagcacaaaaaattcaaaaaattctgggtcttctccttctaatttaagactctttccctccatcaccatttatctgtaaccagtcttttgcttaggagacaatttttccaaggtgccaccattcagaatttatactccttgaaaataaaatcgacctttagaactctctggcaccactttagaattatccacttgcgtcactacagctctctgtgcttttacaaactagttgttttgtcagcatgagtgtgacaacaattagacgtcccctgtttttgccccatgccttttctccttcacagtcattcaatgacaagcgtaaaaagagcttcatcttttcacgaaaattcccattctacaagaacaaggagcagagtgagcaggaaaccagtgatcctgaacgtaagtagattctgaaagataatgtcacatgcaacataagagaaaaaaaattcacaggcaacacgcaggatgtaggctctcccacgccacacacctaggcaaacaacacagcaggcaggcagggcaggtctactactgtgaccagcgtctgactacagtctggatccctcctttcacatggctcttctttgcagaaggcattggagagagacttgccaaaactgggacttgcacccaaccaacatttatctttgaccaggactgggtccggtttgccttttctatcatgcaaccctctaagtcttgagacaaattattttctgagaagaaatattggattccattgccacatatgttttttggaatgttaggaacaattaaattatctttattgatttaaagataaactagcacatttgctcactctttccctcccccaaaacactaaacactttctgagcactgagcttgtaatggtggatatcatttagaatttgctatgaaatttggagaagtttattccttaagtgggacatttctgtggcaacgtgattgaccatggtcaaaaaattggcatttgctgaatttttttttcttacaatcttttgtttaaaccttgagttgctctgcaaatcagaaatttccttcttgaatctcagctcaaggagtttggggtgaaagtttttttaaaagaagagagaatgggatccagattgttaaggcagcacggtctgtcatggtagtattcatttcaactccactgacttcttccttcctcttccgtggctgttcttcctctctcattgctctctctggggacttccatgcaggacatccccggattaggtgacgacggttatggaacaaagactctgagtaagtttccaggaatggtcactgtaacttttcttttcttttcctttccttttgagtttggcttttgttccttttcctgagggcctttcactcctagcatgcacaagatacgagttttatttgttacctagctgtgaatgctcctacaaagtaactttcgatcgttttgttctgcatgtcagcatttaaaagcaaaatgtatcaggcactctaacttctgttgcagttaacaccatccctttctgaccatgtgatattatcaacatggtcctgatgcccaccatagcatcacttgctctgccgcttaatacctccatagagcaagaaaccatgttgaaagaaagggtgagctaagtgttctagaacagcaaaacagaaatgtactttatgttctttcttctgccttttcacatggaaatatttaatgaccttgtcaaatctcataattgggttgcactttgctgttagtaaaggagctgtttcgtagtcaaaaggaacatgcattctctaaaagcaaattttaagctactggagattccatgagtatttatttatttgttattaactttgatttttttttctgacttgcggtgatcctgcttgaaatgtttaaagtttggatatgtaataatatgcctatcagtgatttattagctacattataaaatcaggtcttcactttatagcatagagtgaaaaagaaaatatattaagcctttacattttctaattgttcatgtatttagtctgtatctgattgcactaagcaactaaaaaataattatcctgtgtcttaatatactacattatgatttttcctctttaataactaaccccattgtgtaggcaccaatgaaatgagaacagagttttgtgtcttttgcaactgtatcacatgtttaattttttttgttttgttgttttaaattaacagctatgggcaatatttttagaagctgtttatttgtataaaacaaaattgcattgaactggactttgttttcaagggctctttctataaccctgagtattgatactcctcataattcaaattgttcatttggagagtttttaaaagatatttatatttttaaaaatctgatcaagagtactgatcttaaagatgaaaactttatttttgagttactatatggaatatgatagaaaatttttcctgaattagtggctgaagtttaaatattgatttcagcattatctggacagcatcaagcaccaccagagagaatttgtaaactttcaatttgagagggaaaagaaacatcttaatatattgttaataataaatatcactaaaaagtagtggcttttggagtgtcagaaataggacaccatttcaatccagaatatgcaaatgtttgtttgctctttaaaaattgaacaaatttaaaaagtaaaacttcgcaacaacaacaaaaagccctgtcttacccaattcaaggcacttaagataataatctccatgaaatgcactattattgattatgtgccttgactttcattttagtaacagaaaacagatttgcacaggttcatccacacttctttccctattgcctctttgcacttgcaaaacatgtgcccaaattagtaatgcagttctgatcacagaccaacacaaagagaaatgatttgtgtgaatttaacccatgctttggttttcattagtttcatgctttaaaactactctatccaattggcaagaatgtatgatatcaaagcacttttttattgttagagaataattttatatattatttttctctttctaaaaatgtataactattgtcactttttaaaaaactgatgttatttatagtgagcttcagaaatcaaatagtcacatgttcttcatttaattaaagtaatatacaaataagttcatagactgatgagtgtatcatctataacttaacaagcagtatggatgagcgaaaatgattttagaaataagagctcaaattctggcatataaccaacacatccctgttaagttaggtgaactatgtatgaaaaaacaatttggagtattgctgtgcaagcaagtcattcagcatgaatttaaaaaaaacatacttcagccagaacctgtaccgtgtatcaggccatttatctcctgcctgttccatgccactagtattcaatagctatccaagcaagaatcctaaaataaaaacaaggaactattgagctgattcgtaaaatattattcagtgactcacatcttcctcaaagattttcaactcactcactgaagcagaaaagatcttcaagaattccttttcatcctgagaatgtgtttaggaactatttaaatagaaataaaattcaagggattccagggatcaattagcaatttgagcagcgttccagcaaaattcttaaaggctaaaattgagaaataaaaaagcctgcaagaaaacactgcctacacaccagaagcgtctgaatttatagtcaagaaaacactcagtcaagacatactagtcattgtcacataaatcttgaaagtcagaggtatatgaatgggtcatagtatttttctaatcgcctaaattgacattatgcattttttgtaattaaagatactttcttcatttgctaaaaagaagaaacagcaatcaagcagcgggttcctgtaaaatggagataaagttttcatcttctttatcttatctgagttttcttaatgcagcctcctctgcggcttttacttgcctttcgctcacatttctggtagccttgcatgagtgtattcctttccgttctggctgctcttcaatgcttggtatctctttaatttgctgtgctgttcttgcagaacatgtttcttctaatgccagcgatagcgaaagtagctaccgtaagttactgctttggtttgcggttattttctttgcaattgccccattgcctgtggtggtcatttcagatttctgttgttgtttttcaattgctaccttttatcatctgtattcaaagcaaatggcttgaaatgaaatcactggatgtggaaagataaaaaagacactagagccatcagtgcacccttatgtgatttgtgcaagtagtagtggtcttgctaataaacaattccaacctcagttggttgtgactcagtgattcaattctcacagagaaggtgtgtaaaaagttcaacgtggtggatttttacattgtaacccccaaaataattgaaactctcagcaggaggtggaaaatcatcatggtattgttttccttcttattttgccatttcctttctgttcttggctcccctttataggaaaagcatttataaataaagtgttcctttaaaatcaggtttgaatcttttacatcactttctctttgattaatcttttaagataggatactatgacatttctaactttacttttttgataattggggaactgatggaagagtttcatcctctaatgttgaaggaacttaatttttttaaatgtgaccaagtcttcttagatcagaaaacttagctgaaaaggtaggtaactatttaaaagttatttctggtctttgtttggtcacctcaagccatttgcttagtgtatgaaactatccaccaaacaccgatcacatccttttgatcagtcctcatggttttttaccacctacttacttactggtttttggtgactaacatagatacatatttttactaggattcttatgatttctatgagattaatttatattccttagtgaaatgggttacccaaaaagcacgcctaatacctgtgacccacagatgctaaggcagaaattggtgttgtcttttgtttgaatgagtattgtattaattgaaaactagaattgtttgaggttttcccccccccgttatagcatggtactttacaaaaccatgcctttttgaggtggaaggccaaacagtggtacaacacataatttggatttttaagaaaggctttggaaaatcagaggggtggcaagtaggagcagcagcacaaaagtggaaagatggcagatggaggtaggctcagagaaggaagatgtagaccaaggaataaaatgaagaaaattgtaatgagatacccttggtcaatcaaacgttagattgatataggaaccacctaattttcttattgatgaaagttttattgattgattgatagaagaaattccatcaattcttgttgatggaagaattcagaaggttcttgttatcaacacggtaacatgtcaacatttttacattctttatacttttataattttattattatcctaatttcagaaaaaaaatttgcctctcccctttttcattttattttaaaccaagaaactaagccaagaagaattgaccaaagcttgtgttaataacacctaagctgccctcaatttagtacgtagaaaaatataacttattttctgggttccaggaagaccaatgacactagtttccttgatgttcagttttcaattttcaagtgttgtgcttccatccagtagacacaggtatcgaaaaagaaagcatcatgctttatctttcagttcttttaatggaaaatatatactatacaagaactaccttttcttataaaaatcacatttttatagagtattttaaaggcttctcttctctgtttcagaggtgggaatatttttcccagaattattaagttataaaaactggcccaagactttcaactacttggcagatttttagagtgatgttctaagatgacatcaataattatttttactctaaatactagttgcacataaatgtttattgaatgaataaaggaaacacttgcaggcatctcaaattatctatgagaagagagaagagttggaactggattctatgacattagtagggcaaatatggaatctaattatctctattggcttgagtctcatccaaggttacagaaggccagccactcagtttgttttctttacaaatgaacaaaagtaagaagagtctttatcacagctcagaggagaaaaatgacatgtattcctccagaatggaaatatgaagaattccagaggaatgtttatttattcattcggtacctactatacatgaggtcctcttcttggataccatgagacccattgtgaatatcaactaactctagatctcagcacacataatagtaggagagagatataaataaatgaaaaagtgcacaaagtgtgacaggtactaagatagattgatgtctggctcaagaatagtgggagcataagaggtagtttcagagaggaagtagctttgagctgagctttggaaagatgaggaacttgctagctaggcaagatgaggaaggaacttcccagaaagagcactgccatgaaaaaagacacacaggtttggaacaaatatattttccaggaggtaccaactttgaagtcaaaataggctgcatttttctagtgcattcctggcttttgctgtaattatgactaaaaatagtataaacaaatacaaaaaaaaacccctcttttcaccaatatccaggtgttgtatttcactgttatactttaccattccatatccactctgggaacaaaatggctaaataattgtaataattcagagttagaaacaaagacctaggcccttgtgtttcacaatccattgtgtttcacagtctggagtacaccattcacactgtatcctggagttacacatcgtggcaaccttacttcaaagtcttacatgtttcctgaggtaggccacacacacatagatacacacaaacatcaatttctaataaatagttcagatctttgctgcatcatctcaagcattataaaataggttttccaactatatttagcaccagctaaaattgcagctgataaagtgtacattgtctaattgtgcaaaacaccacctcaaaactatcttaattataggctaattctagatttatgtcaataaagtagtaaaattcagccttgtatttttggctgttctgtataataccttacagtcacccatgtattaggaggtggtaaatactaggcaagtatattgaggactatgcaagcttctaaagctgaagacatgccttcctcaaagctcagtaaagctctttacatcatcatggatgtgtgcaagctgataattatccttccaacccattagtgctcaccagttaagtaggattttcaaaacaaggatcttgaagaactaatctgagtgaaactaacgtgttgagatcaggagacccaaaacttctccactggagtcagtcaaaatggtgcatattcttcaccttactctattattctcaactattgcccttagatgtctttactcctttagtctttataaagcagtttttcattacatctattatctcatttaatttctgcaacaaaactatttattagacatgttttacattaatagccccatttccatatgaggaagccgaagctccaagaggctgcctgccttattaaagtagtggcactgcaaatccaaccaagacctcttaattctgaatcccattcatttttcactcttccctgtagtttgtaatccaagcctgacattttacctagtaactttcaaccatttcatactacctataaagttaatacaaacaacaacatttatataacattatgcaccaagtctgattttaaggactgtacgtatattaagttcatcttctgaacatcctatggagacaatttgccatgaatttactatatgaccttaaacaaattacttaaagtctttgagactcagttctctcctatgtaaaatgagtagcttgaattagaatagaaatggcaaataaattttaatcaaggttcaaactcgaaccaattggcagtagctgcctgaagagttgtaatgaaaagtattctaaggccatgttgaggctcagcagtaatcccggcaatgatcagtttgtgatgcctgtcaagatcacagagagtaatagtgtgtggtatgtacttgccatctatgaagcacatgaaccctaagccctttcttagcactagcattctatgactctaagaacctaattagttcttaaaaatcatcatatgcaggcactaaaaacaaaattttgagcattaaacgtactgccactggtcttcaactccatcatctctgttttctagtttccaggaattcctaaagaatggcaatttgcttttctctagcataaaggttactagggtctctcattgtgactggcttccagtttaaacacatagtgttttgtggcgactgtgacaaaaccctctgcgaagtctctggcagctgctgacatccacacacagctctgtgctgctctcccactttcagccatacagttgccaaaacaaaaccaagaaatagtttgtacctttttgtcagctgttattttgaagtgccaacccctcctgagcagaaaatagaaaaactcttaaggatgactattttatggggatgacacaacagcaaaagaaaaagaaacaaagaaagaaagagagagaaaagaaaagaaaagaaaaaaagaagagagaaaagaaaagagagagaacttgtgtttagaggcagagtatctgatggcctcttaataaccccgacctggtttcagcccctatctctctcttcaattttttcttcatttgttagctttacctcaacacccacccaccctgccccacagagaattctgcttctctcactgtttcaagacagtgcaatatactccacaagagttgaaaaaggtgcagtattaaatcttgactccactacttactagctgaggaatcagggctcattaacatctctgagcctcagcttcttcatctgtaaaatggggatcatcagagtacctacctcaagcaatgcctgtgagacataaaagccagtgggtatgaaagcccctcaaggcccgcaaagtgccacaaagacatgaattttctctccttcatcacagtggctttttctctttccctttgtctcttcctcattacccatagggcttttcattcttggacatggaagtaaaaattagtttaagatgctgaattcacagcaattatgtcatgcccacctccacgggtttccccacaggcttcctgggtattacacagtacctgattgccacaaggtcttgagaattggggtggcccggacataagggatgctgccattgctgtctaccaacactactgctctgaaccagaaccagaaccagtgcctttcatagaaaagtaaaccaagaagtgatggatagacagagatagagaactcttgaacaaaattaatcaaagctatgctttgccctagttgtctgaatcgcaatcatacacactgacatcaaatatcttattaaagatttgcctttagaacgttccatcagaatgatttgcaaagccattgggaagagatttttatgggaacttgatgtgctctatttatttagagaaaacgatgctttccaaagttaaatgaccatattgacagaaacacaaaatagaacctaccgttggcctcatcactcatcctgtttcccatgactgaaatcagaatgcaaatttgttgacatctttctttatgttaagcactcaatggggcactggagacatggtgatgaataaaactcagttctcgcctttatgaaactcccagcctaataaggaggtccaagagttacctgacatttaaagcttttgttatcccatggtcagaattcttcccttgcacattaattgttgaagatttcccctgtaaagttatagtctaaaattgcaatgttagtctacgatgcttctatcattaaaactatactttctccccaagaatttttacacttctttaattgacccacagcattttcctgatgaagtaatactaaactaaaaccttgaatgcgtataccctctacatcgctcaggctttagataactgggggttagtaatcaatcaccttcatgttttttggcctaggctctgtacatttcagtagtttattcaaagggaatcattcttttcctgagtacaagaaatagtgaatctgactcctcactgaccaaacccctgaccaatgtggcagagtcccctgaacacttctggggtggccatgggtacataccacttaggaggagcatcaaggtccactctctgtacccttaagaagtagcttggcatggtggcgccattctgagcccaggccctccttgggactgagataagatatgacttcagcctgaggccatttctcacacttgaaaaagtaagacactcctatccccatcccattccagctacccagcctccaaggaagtcatccaacttcgcagctatacccacatattgctcaatttccccaaatcagtctcattatcaaaacagtcgatcatattaactcttcttatgaaattacctctctttctgtggtgctgtggctgttgaaggaggaaaacctggcattgatagactatgaatgtgcttcaggggtgggtggtgaggatatacagcaaaggtgaattgccctttggtttcagaagttacctcatattccacttctgctccactatttcttctagtagacagaaagttcttttcaacagccctaacctattgctgttccaaaggttagtcaatgcaaaaaaaaatgcagacacttccgggtttgcaggtgaaattgagctaatcctctgaccaattaattcatcaattatataaaatagatgattgaaaaaataaatggcaaaaaccaatttactttctatggttatttgttgacttgaggtccaccctgagtcagaaggcttgtagcagatgacattggaggggctgacattttactactgtgtcttccttagttctctatctgaagtttcaacgcacagtttagcagcaattataaccaatgatgtaggacacacctcaatttttgatcttcattaattgacccacagcattttcctgacgaattaatattagagtaaaaccctgagtgtcctgatgaagtttttatatcataaatgaaataagcatatacttgcttttgaacagtgtgcttcttggggaaataaaatagaagatgaaataaaaggtacagcaattctgattatgtagcagccatctattgaattggaccctttccttgaactaaatggcttccttttaagtagtaatgcttggtgtagaggccatggcattccattctcaatgccagacagaaagaagtctcacaggtcattgccctgcagcaaatagctagcaaccagttattacttagagttatgactgtgaaaatctgatactaaaatggtgctaaagagttttatgaggatgaagttatttttgaatggttcaaggagaaagagcaaggagaattaactctgagctgtgtctgtttcctgtgtttcagagcagggcttgtctctgtaatatatgactgttagttcactgtggttttctttccttctcttctcaggaggacaagaagacctcattctttcctatgagcctgttacaaggcaggaaagtaagtttcccagcacgctttcattcctaatttctgggccataagaggtgacatcattgaaggagggaaagagtgaaggactaaggagaataaactcggcttaatgctctgttgtcttgagaccgtaccttactcttacgctgtctctcactttctctctctttgaccctatcaccaaacagacaacttcctgctgagtatgggcactaatagcacctaagagaaggatgcagccctccagatgagtggtcctcaatgggaaggaacacattcaaattacctaaagagcactagctacgagactggtgaataaattctcctgagagactgatgtcagctcagtattgagaatgactttctagcagatctgcctaagatgtaggctatctgtaagctgctgctttttcctggaggcatttatacagaggctaattgctactgacaaggatactgcagagagaattcaagcatcagatggggacttgtacccaatgaactctcaggttccttctaatcccagatacaaggaaatctagaaactgtagcaaagtatagagagtattttgatctggggaaaagaaatcatgaaaacataagatgttattactactaacaattactttttatagtcatatctaaacaatagccaaacagctggtttggattcttttttctcccactcagttgactaaattcagttgttttgacattatgtaggcagagccagagagtaagcaaaactcctccaaatgtttcttttcatcaacagatactgcaattgcctttccctgctagtagattccagaaagtaggcactgccaatctcctgagtgttaaacatcaatttccctatgcaaggctgtatgagtaatttatccagtgaagtaatgcccttagcatctcttactgtctggcaattaagaatcacccttgcaggacagttttgcagttgtttccaactctttctctttacctacatcttcctttcccattctgcagtaaactacacccggccggtgattatcctggggcccatgaaggatcggatcaatgacgacttgatatctgaattccctgataaatttggctcctgtgtgcctcgtaagtgtcatttttctttcctctaggaaaaacaaaaagagcttggatttctttatgagatggtaaaatgtaattccatcctccagtagtctctccagtaattcaaataccaaccatttccgattagctgagtgccttatttaatttatttgcctaacacttttcatttatgctgccgtgtgtcattctgtatttaataaaaataataatgttttctctaaactgattgtagccccttaaaaggcaggatgaatttttgtggcccccaaccatttaaaacagcataggatttatgataggcatcagtatgttttcatagattgatcaaaatgccactgaaacattattttttataggatggaagagatcggaaacaaagccatatattaaaatcctctcaggatgacttagggccatatgtcaatcccaaaacccaataggctttcccatgttgacagtcccaggtttagggagggtgaagacaagaaaatgtgtaacacttcaatttgacctctaggccattacagactttaaactactttcttctcattatagattatcatcaggcttctggtccctctgattgtagccttattagattctaactgctctgcctcttcccctccccacccctaccatactttctccactcattcaccccgtctacaccccgactctgtcaaacagaaatgcatgcagaccttctacgtatgtagacaggtccatcaggaaattttaatttattagataatggagctcttacatctgataccaacaaatatttctcttccattctatgtgttttaagcctgatgctttcaagtgtctctaacattccagtactgcaaattttacatgagatacttaagaatagcaggaattgtatgtgtccagtacatggccaaaagactaggatgattgctgtatctcatgaaacaattcccagcaagggctctgggaagagatcctgccatagaacatatcctgagaaagtcttcagacaggaaggagcaaatgaaactccaggtcgtttacagcaagcttccagcttgctcctccacttttgagagaaagaaaacagaaggtacttaagcattctttctgctttccctttcaccttgcatattctctcttttttgaattaatagaaccattttgtgatagtcaatagatgttcattgtacaaaacttcaaaaacactaaaaagaaagttaaacgagaaaattagaagtatacaaaatcccacacaatacccagagataacatcattgttaatatttttgtacatttccatctattctttctatgcatgcattttttctctgtgatgatttttttgcttatttaaaattttatataactatttcaaatgattattatatcccaattaatcattctttatgaacattttggtttttccctatttttcactattatgaattgtgacaaaaatatcatcgtaattgtgttataattattacttataaaataatataatgaatatctttaaggataaatctgtatctgaagttttgatcatttttaaaaacatatttctaggaaaaaataagtgagtcaaagattaaaaatattttaacagcttttattcatattgctagattgctttccccttctcttcttaccaaaaaatttaggtgaaatggttagagttgctgatttttagtcctatctaactgtgattatcttattttatatatgttgagagtctgaattttatggtcctttatagaatgttaagtttttgttctgacaggtgataatttactgacacagcagcttcttccatttgtgacatggttttagactttgtgaagatgggtgtagagtaagtctagagtaaccttttaaaatgtggcctttctgggatctccatgggttctgactcaactcccgtgtcttctagcaccatgtgatgtctaaactctccatttggaaatggcctctaggtagagaggtggggtgaatgctctctcatatgtttctcttttctcaaagattacagccctgtacttcctgttgtctgatatctgaaaacagttgtttcatatattttgtccagttttttagttgcttatggtgggagggtaagactagtacctgttactatgtcatatttcttcatactacatatttctacatatcaatgttgaggatgtggtggagaatataggtgtaaagcaagtttatgggtataaatgcaccttaattttatcattttttgttttataaagatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagagtatgttcaccaatcttcttacacctcccctgaagaaggtttctaggttgcaaactgcatttttttttttttttggtcattactctttcttgattgcaattgtaaattttgatttaataatttaaaacatccaagcagagaatcaccttagagcaatgtcattaatctttgttctaatttcaataaagtattctcactgacttggaaaaagtaggaagagggctttgtctttgactcactatctgaggccccaatacacaaccttgattttattaaggcaggtttactactttagttgtaaaccaaggggatagcattcctgaattattttgttagaggaagttattttttttctctctctctgaaaacttgacatcctcatggtagaagagaagatagatgagaagggctgcccagccttttgctcgcagaagttctagcttagaggaggtgtagatgctgctattatctttttgctggtaacttcaggggcatggaaaagagaagaatgttcaagagagggtaccataggaaggcacctgggtgtggctacacaatctgcctacagagggatcctatttcctgtgaacacagagaaccagtatcataggagaagatatttgttgggttgatttgatttgccatgacctttctcaatgtaccgctaaagaattaagtaattttgatgtctatctaagaatacactaagaagttgcatctattttcctccctctcaaaagttcagttctatcaactaaatgaatactggttctagtcaaactgtcctggataattgcacctattttcctctttgttcatgttgttaacttgaaatgttctgactggtgaataatcaaccagcatttatacatgttatgtggctgctgcacttcacagatagaaaacttgaaatctattacctaagtaataacggcttgaaccatcttagtgggtttctcagataagaagacttcaagtattcactggactgtattcattttcatgtgaacattatagatgagattttagcccttattattgatttagtattgttcctatctgcataaagtgccttttttctcttcttgcataaagttattctagcctcagggtaatgaggacatttctctccaggaggtagaatatgatgtggcaaatgtatctgcatatccagaaatgctttataaagcagctgcttgctctgagcactcattgtggtggaagccaagttaaatgaggtgtgctataatgtaatagcatttttatttgttaacaaacaagaaatttacatacctcatgcaagcctttctctcttggcatttaacccgcatttaatttatatatatatatatatatatgttttaattatatattttatatgtgtgtgtgtatatatatatatatatatatatatatatatatatatatacatatagtttttattttttttgagatggcatttcactcttattgcccaggctggaatgccatggcacggtctcagctcactgcaacctccacctcctgggttcaagtgattctcctgcctcagcctctcaagtagctgggattacaggtgcccaccaccatgcctggtgaactttttggatttttagcagagacagggtctcaccattttggtcaggctggtctcgaactcctgatctcaggtgatccacccgcctcggcctcctagagtgctaggattacagccatgagccactgcacccaaccaaccatatgtttaagttaaccatttttgtgtctgccctccactagactgagtaccttgcagacaggatatgtacaagtacttggaaaaattcacattattctcaatcttccacaccgaatgttgggcagggtgagacaatgaggtgtctattttttccaaccaacaattctgttagtgctccagacttgggtttgcatgctcctagcactaaactattgggcaagttagttagtgtgagtcttctgtaaaatgcagctgataatacctacctcagagatttgggaatttcttctgacaattgtgttcagagatggtttttaaacttcatgagaacagactcagtcacataacatacggctgcatgtcatctttgtgtgttacatcaggtatttaactgagagaacatatgtaaaatgtccagtccagtagcagacactttgtaaggggctagttagtattagttattgtaaacactcaatgatgaccctatatatcgatttttatttactctttgcagtgatctttttctgactttagaaatccagcatcccctaccttcctctaaaacctacatacattagtttccttttgttggattatggccatgcttcctatattaacttcatatttttcttctctttctaccagggcaaacactgtatacttgatgtatcaggaaatgctatcaagcggttacaagttgcccagctctatcccattgccatcttcataaaacccaggtctctggaacctcttatgtgagtagagggcattggaggccttcatccaactgactccctgttctgtattatactgaaaattactaacaggattttgctgggaatgcttacaaatgggaaatgccattgttgatttttcagcattctctttttttgaagatatatcaaagttcttttaaacaactagaaacataatgtcagtgatttctttttttaacatccctcattttaacaataatagtaattccttaaaacatcttcaataatgtttcctgatttttattgttttacttcacggattgttttctttgttagtttttgaggttttgttgttgttgttttgaggatagcttggcttgatttggttttttggtttgcttttgttttccaaatgataggaagcaatcattttttaattgtctcatacttctgaggcaggtctataagtaaatctttttaaatgtgtagattttttatagagagagcagacaacgtttgagacttttttcattggcattttccttggttctctaatagaattctgatgttccttaattaaaactttacatacatagaacatcgttcttaatagagttttcttagtggcgtggcagtaaaacatctgtaacttaaaccagtagcttcatacctgtgcactcagggttttttctttttttttcccctccaaaggacttgtgaaataacttctttcaagaatcattaaacaaagtgggcagacattcacgatctgactgtaaagtcagtataggcaactcccattcacaaaggtgaagctacagtagatagaggtaaccagaaaaggggctaccagcagggacctgaaaattgatcaggcaagatttggttctttactttgccactgatcagttaagtaaccttgggcaaattgcttgacctttctaagatttagctcctcacctcgaaacgaggcatactaataaatacctcatagagctagtataaaggttaaataacaagattaggaatttagtaaagctgttcatgtactctttggcatatggtaagtactcaataaataatacctattattattgtaaaagatataaaattacttcattataaaggaataaaactattttatcattataaaacacataaacagtacctcttccatgacagtgcaagagataatgccaatgtgtctgtcatgagggccttgatcaaattttgccttcatctgggcctcaagaccatagtgtttgacagggttcaggagtgaaccacagagtactggaaaataatgtttatggaaggaccgaagaaacagaaattatttaatcccagtggtgaaagcaattgcttacagaggatattaactgttctgtgtctcctctgaagacaaagaagcaaagcaaactgcagcagctggagtggcagcctgagagaattaagttaaatacatagttgagctctggggaaatagccagagatgtaccttgaaagcagaatatagtcccatatataaaaaatggacaaggattcttaccaggataaaaaaagtaagatcgggaggtcactgacagtaccttcagccccatgaatttaggtattaaattataatataaagagtttttcccatggctggcacatggaaaaatatgtactaatgataaaataatgattcttaatattatcatccccaatagcatgtattaaatttctccttgtataggatactatgtcgggcattgcacaaagtgaattaagcaagtacaaatttcatgatgtaaaattgatttataatctgtcaagagcctcataaatataagtaatgctaacattaatgagaagaaaaatagtccttacttcctgggaacagccatcttaaaggcctgtttcagaaatagaaaaataaatcttcatattgtaaacactcagtgggataaatggcttcccaggggaatgaggcctgagggaacgacagcagtggcacatttggtccggtgcaatattaggagacagtcccatctggcattccataggagaaggtctactgccttccacaactatgagatgacttattttagttatgccttagggcactgtcacagccacttatcaccaaggaaagttaaatgtactaaaggctggacttcacaataaggacagtgaatctgacataatttgctgcagccatattcatgggtctcaagtgcagtgatggtgacattcagaccaatgcaatctacctactaaaggttggatgtttactttacagttcactcttttccaaggcttttactccaggagcaaagctgccatgaattgcccattccccagagagtagtgaatgctaggtcagccggaacaaaagcatgacagctgtcacatttacacattgatacatcatcacacacattatttctcaagtgcatcatccacatcaaatcacagagcttattagcacatacatagctgactcttcagaggagcataaaatcaaagatgtgtatgaaagggatgttctttttatattgtgccaccatctgacttctgttccctttccatgtggcaatctcccttcaccctgccacttccaatctgcttttaccttcctgctcccatgatgctctgtgtttacttctgtcttcaactatcttataattatgtttatctagctccccatttgttcattcattcattcatttactcatctattcattcaacaaataaatgttgaatcagtctccatgccacatgctgacaaacaagccatggtcttcgccctcaaagaattactgatcagtcaaggagacaaaataaattcacaggtcagagaataaaaacctaaactaagtcattgctgtaatcagtaaaaagggaattcagagaagacagaattcttggaaggcaggtcgaagatgatccagaactatgtgatttctttctttgagacagggtcttgctctgtccagcccaagctggagtgtagtggtgccatcatggctcactgcagtcatgacctcgtgggctcaagccatgttcccacctcagcctcccaagtagctgggactaaaggtatgtgccaccatacccagctaatgtttgtattttttttgtggagacagggtttcaccctgttgcccaggctggtcttgaactcctgagcacaagtgatccacctgcctcagcctcccaaggtgttgggattacagacgtgaaccactgtgcctggcccacatgatttcttgacatctggagcaaatatttatctttctctgaagagtgtcccttggtttagcccagcatcttctccacccacgagtaacatccattcacagcatgtacagctgagactgtttggaagaaaaattatacataacacccctcaggacaagatgagtttagcaacaagagttcaggaaattctcactactttgtatttcagccattaatgtctaatgtcaatatattgttttttttttttccaaatagcctcttttgaaagatatcaagtcttggtataataggaagtctaactgaaaattggtttaaaaaaccaaaaccttgagttcttaccccagattactcttcgttaaatacacagccttaagcacatcccttcttgcctctgttacttgctctcgaaaggaattgactaaggccagatgttccagacccaaatctctggcttcctaagcagcatgcaagacggtaatgatttcagaaattctacatgcacctgtgatgcatcctgatcagccaaccaaattgcatttggcaggacattttttttttaacacctggaagacccggaaagataaagctgccagtagttaagaatcaatagattaggttttagagagaattcaagaatttttcatttctctcccaccttgatttatccttgagccttttaaaaaaaatttatatataatagttgtacaaatttttggagtatatgtcatattttaatacctgtatacaatgtgtaatgatcaaatcagggtaactggaatatccatcaccagaaatgttttgggaacattacagttcttctcttctagctattttgaaatattcctataactgcattttataccccttaaccagcttctcttcatctcccctcctgccttcccttcccagtctctgataactaccattctactctcacatttcagaaagtctgagatacactagaacaaactccaagaaagggtggtcaggaaagttcagatttagaaatcacatccaatgaggggatagatgaagcaataggacagtttattctgaagaagtagaagcctcaagacacacttaagcactttacttaaatatcctagggcctaccatggaggatattaggtccctgcagaacagggaccagtgactacaaatcataaggagacatatttggcttcaatccaatgtgggaccaagagactgccctttgagagaatgagctttctggccgtgagtccttgttgctgaaattattccagcacagaggagtcctgaatgaagactaaaaacctgttgctaagattacactatgttttctgtaggatttatttttgccatacattttaattttttaggatttggaatattccctttatgttctaatacaaaccctcattttcccagggagatgaataagcgtctaacagaggaacaagccaagaaaacctatgatcgagcaattaagctagaacaagaatttggagaatattttacaggtaagttcacttttaccctggtagtgtgagaaaggggataaattgtctgacatttggcacagagagggttctgggcctggtgtacttgtgccctaaaaccttcctgttgagaatccctaatatctgtttcatatacaaggagtatccctctgcttcacccattttgatgtaaaaccctgggttctcctgagagttcagctgcagccagctcccaggttcccaccagccctacccaaaaccatgggcaggagatacccctgagctatctcctaccatgaaaaggatttgaggcattgctacctcattaaactatctccctgatatcatcagaaaacttgaaaaacaaaattttagggctcaaaatggtcagtgtccaaagcagttactcttgagaagaagcttggaggcgtccgtccccagctccatgagctttcatcagtgtccctatcagcagcacctgaacaagatgcttaaaacttcctcatgtttcagttcactgtgtcaagtctcaaccaaaactgctttttttttctttttaaatgtttccttggaaacatgaaggggaatagaggttttcttctggagagcctgagttctgagttctgtattcctatatactttcatagaacactgagtaatcagactttgtgaaatttgccttacacctggttcccggaggtttaaaaacaagaactttcgagctgggcttatgcctctaatcccagcactttgggaggctgaggtgggtggatcacctgaggtcaggagttcgagaccagcctggccaacatagtgaaacccccgtctctactaaaaatacaaaaaattagctgggtgtggtggcaggcacctgtaatcccagctactagggaggctgagacaggagaatcacttgaacccaggaggtggaggtcgcagtgagccgagatcgtgctactgcactccagcctgggcaacaagggtgaaattctgtctcaaaaaaaaaaaaaaaaaaaaaaaaaacccaagaactttcttcctggattaccatatgtgaagttagatgttttattttttaccttattcagaatatagaaagtgtcagtgccttagcagtttgtaaatatcttgaatcaggtaatattaagtaatctttctgtcagtaaccaagatacgagctgtgtttcatcctaaaagaacatccaggtaggagaaacaaaagtgtacattttgacagtggtttatattttgtatacaatacaataatatattctgaggattgtttttaaatatctaaatcatctttcagtagtaatttatttttaagacctagtgtcatatggataatactgatgtgttttggaaatctttctacaagataacttttgttcaaatgagacaataaaatgtacttaaatctactccaagtgacttagtgttttaggagatacacaactgagcagtttgtttatatttcttcctgtttatgtttcttataaatagtggacttatggtattctcaatatgaatagctctgtatggtaaaaatctcaagttaccagagatttggggaattaatgggttttcctattaagggctttgagggttgggaggctaactaaacttccctctaaaatcttcattatttcctcggtgtctacaatatctgaatttctgctgctgccaaaataagtaaatatacagactgtaaggccagttttcttttctaaatagggagctctcagtctgaaaattgatcattgcccagctcagtgcctggctcagagtaggcacccataaaatattggttaaatagatgagtgataaattgtccagtactacagacagacatgtagaaagtgcaaagactgtgaatcatttgttactgatccaggatatccattgaaagcatttcttaaaatcatgaatgtaactttgcttatatgaattttctgcttcttcttactaatgaaaaatgatatgaagcttcctgatgagtcatctgctactgatttgagcctccaatgtgtaagtgatgattgttcttcaccatccaggaaattatttctaattctgggtgtgtttgcttttgttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccattacccacatctgtaattggtacactttgaattttataactatgcacatcttttgatttcttaacaagcaaatgaaagaaagaaggaaaaaagaaaggaatccctttggagatgacatactatcagggaaggataagtgtgtagttttttgactggcatctgcaaagacaagaatttcataaaatttgcaagtgtatggaggactaacctcactgacaggaggggattccacctgggattagctttatgattgttgattgcctattttgccatttataaactgaaagaaggcactaaagatgagaataatttatacaataaaaatatattaaatgtatagaaacaaatttctataggttaaaaaagttttgtgaaatattttgtaaagactaatattgaaagactaaatgtatgcaacatcagcagatgatcaaattcaagacctgaaagttgcactctcccttttgttgccaatgatctgttaagagcatctgagttccttttaagtctgacaaagacttcttcctcacttacctcccttccacattagtgatacactctcatgcagcacatcccttaatgagttgccctcatggatatttttggaagacatttggttaatgcatttttttatgctgatggcttttcagagacaaacttatgcaaatgatctaaagggaagtttttgctttcctctagttaaataacctgagcctgccatgcaaatagttgaataactttgttcctagttactgacatacaattcttaaaggaccatttagcattttggccaacaatgagtaattaggattagtacctttttgttttacagagtaactgagagttttgtaacatccagagatggtactagagccaatgagagatctgttcctagatgcactatttctttgaggaagagagagaagagaagtgtctggttgggggtgagggggtgcagacttttttgtttctatgtacagagcaaagagatagagtcacaaggaaagacaattaatgactttgagctcaaccaactgaactgcctttcttggagctgcacctggaccaagtttattttttaacaattataataacgatgatttaaaaaaagaaacctcccaaagcctataaactgaactagaagagttggtttcccactttagagtggatggcgacatcagcattgcttttgcccatggtgtttggggagagacttttcagtgataataaccactctactctgggttctgtgcatgcccagactaagccccatcgccttatttctggggtacatccagacctggcagggattctgccacactgtgcagcaaaccagcatgtaggctgggtaggagagcaagagatagagccatcagagtgatggggcttcttcacagtaagaacatcggagcttagaatgagagtctctttccaaaaacaggcattgttcatcttacgctaaacatcattgtctgcctggctacagtcaccaaaacaaaacagaaatgcaaaattatgcatcttcccatagtcctgaggcttcctttgccaatggaagggctagcaatgcattctccctctcatgaaagttaaatttccagagacttccttagattgctcaaaatgttaaagatatgtccatgtctgcaattcgccagtttcaggtcaaggcctactttcatcaatattgctcccagaagttttctgacaccagaatgccattcctgatcccagctctatttttaggccaccacgataacttctttggtttctcaactgagcatgcaaccatttatttaaaagactgtcattaatgagtagatgttttcgcgggtcgtgtgatgtgctttccatttactagtgttgctgtggctaagtacaatcaaattgaaccaccaacccttggttttgtagtaatataactatttattttcctagtgtagatgctttcagattagaattggcatttgcactgatttttttatgtagatttatataaatatatagatacatatatatttgcttgaagaatcaccaagcaaattggtgagagggtcttttccaatagaatttacacctccatttgttgtgttgtcttgcacttcccaatgttgatgtctctatggctccaatgaactggtgtattttgcagcaaatctgatgacttgtatggaaatggcatgaaagttacccagattacatctggtgcaaatgcactcggagcctggggccagactggtgctaacactgcaaactttgtccagagctctctccaacctgaaggcttgctgggggtgcaatgtcaccttcacacatgctgggccctttcagaaaagtgccagatcgtgtaactggtgctatttttcatgctctggtacaatgtgtagcaccacgggggtctcagctttaccaaaatcaaaattccatttgtcagctaagtgcagaggcatttgttttttgctctcctcccacagaattgtcggccatttatttgcaggccttttgcgggatttcttggctatttatttgcaggccttttttcccagccccaaattcttgggttggctctgtctgcttaaagagcctgtcttcacaaagctgcactcgggtgcctctgtgcgctgtcttagatcctactgccggcccttcaggactccgagccaggaaagaactctccaacctctggctcgagactctactttttttctcattcttttccttactctcctcctccttctacttccgactaattccatctctttttttttttgttcctctccttttcctattcctccttcccaccatctctgagttgttgactttctcctataatccttctctattccctttctctttttgtccacctctcctttagtctctgtttctctgcccttcttattcctcttctgtcctttctcctctcctcaaatctctgatcatcttctcccgtacatccctgtattgatttttctgtcctctaaagggctcatggctgattcagacagcaagtccatgcactggactaatgacacaaatactttaggtcgccgtttcacctactcagcccagaaagtaaagctgagcgtgaggccctgacctggagcctgctccagcccgcctcccggagccagcctgcaccgttgccctggcagcgatgatgcatgtgctgtgggccctgccggcgcctgagtgcctctgcctgaacactgctcctaagcgagcccactcccagcactaccgcatggctctgaggacattttctttcaataaaggcagactctggccccaattattctgatagcaaacctcttcctcctcattgaagccatgccatcaccttggtttggagagagacatttttttcccattcataagctttctttttcccatttttatgtgaagccccctctgcttttcagctggtgattgctctggtgagactgaatggacttgctggtgaaatgaaatctcttctttcctgtcttggtcctgcctaaattcctacaaatatatttaagccaaggactcaggctaattcctaagttgatcacattaatttgttactcctagagggaaaaagatcaattcccttgaagcatgtggagtacctcctgtgacagctgacttgccaggggactccctacagaattctgtgatatacattttacttctgtgtatgtatggtatatatggtatgtataccatgtacacacgttacattgagtatgaatgactgtggttggaaacacacacacacactcaagtctgtaaatatccttcctcactgaaacctgtgctttggaaatcatttcttgtacagctgtgcagtttcttgtaacagctgaggacaaagctaagacaggcggacaatttagacaaagatcatctaaagagtatagtatctccctagcaactcatgaggacagacaaccaagtggcaaggttgactcccaatgggatggcagacttttcttctctcctttttgagtttgtgtttcctaagtgtttcttaacttctgagtgcaccaggctgtacccgttagatcctttcaatatgacagttttgtgcttctctctgacaggatgtttctccaccgagctgtagcacaggatgggagggaggtgggaatactccttgcctaggctggagtttacagagacactgcacagcttacactcctgttaagtgtaaatattcaacacttccattccatttgtgtaaaaaataaagcacacacgattataaaatcaagatgtatatttcatactcagtgtgtctgtgcatatttattgcgtttctagttgtcagcggtgggtggccccattgtaaaaatgcctgatagagtgtttataaacatgtcatggttttattataagatataaatattaaaacattttatactttatggcaaatgattttctcccaaagcataatttgtcttatttcataaggaatagaatcactcatgtctatttttatcaattttgtctctgattccagagctaaaatgcaattagggtgggtatgccctgagaagtattggcactgctgagaggaagtgaaagtgctgtttttgcatattcttaaatatttggttaccatcttgcctgcttttaatcgggatttttccaaaagtgaacaatgtattaaaagatagatttttaaagatgctcacagctatgtgaggggaaaaatcaatttcccagtgtcaaactgtgggattccagaagatattaaggatacagaaaaatgatttttttcttatctgaaacattatgcaaagaaaggcataaactggggaggaggtatcattgtcttatacaccctggagctccaaagatttgaccatatcaaaaatgttgggtttgggaatctggatctgccagataatgttctaaatttttcacttcaggttaaatacatgccttgtcatattgacatttagccaggtttcacagctagagaaccaaaacaaattctactcatgaaagagatgaaattttgcatcaaagcaattgctttggattatgctttgtttcatgataaactaccatataactgaatcagccatttgggaagccagactagttgttcataccatcctggccatcaggaatctgccaggtgtcctaaagctgtccttggtgctgggtagtgaacaaagactctcagacatggtataagaagacattgactgaggctgcaagacgtgtggacctcaaattttgacaattatgcaattttcaacatttgcacagtctcacctggtttaatattaatggtgacaactgtacacaaagccagattcacttcaataatggatgtgttcataagaagctagaagagcattcagcttttctctgtgtcctgtttcatgtctgcaaaacagtttttaaaccacgatcatgctagaagtctcaaaagctagaagtggctgacacatctctgaacctaagaggggctagttatgaacctgtgatctctgtagatactctgaggccatacacccagtgacagaatttaaaagcctcaccaaggcacaaagctaggtaacatctgtacaggcagccacagtgagacctgtcatctttaaagttgtcaagggaggatgtgttctatagataataaccccaatttctgttctctgtcacctttcccttagggacatctcagaaggcaccatagctatcattagactgatccccttccctctctagtgttacagccaaagcatcaagtccaggccttgtccctaatgccccttagcactcttaggacaaagctagaaaacgtgggtaaacttcgctaaagcctggggatagcaaaagggaaataaaagatattctgatttatggtaggagcttagtgcgcagcccctggcttgctgacatgaaagacacaggctatctttccccagcctcccaggagtccctcaagcatagctagaccagacgtcagaccctttcctctgttgcagcacacctgagaggcgctgtatccatgcttgactcagcacctgctacattaggtgcctactgtctccatcacaggctagaatacaaatggaaatgactcagtgtggctttgattactccttaattgtaaacttcaaaggacaaatgatttgcaacatgcttcacatctcaatataaggcatcagtagaacctcactggtctaaactgatcaaagcccaaaaagcaaggcccatgagagacactagttctctcccacccgcttaaggcctgtccttccagttctgggtccctgtcttgtgtagacgattgaattaggtaacaactcctcttcaagacttcagaaggatgagctgtgtgaattttgaacagcagaaaactaacatccataccataagccaaagatacagaacaggcttcattctagcaaaacataatcgactctatttcaatctgaaagacgaggaaaggaagaaaaatactttcttttaagcaggcattaaaaatttcaaattcttatagctcttcatagcaaattacaatgaacagtttcttagtaacagaattagtccctcagagagaacagttgatttctctaacaaaaatatgaaaccaacaagctaaaaggttggatcctaattggattgttggatttttgcaagccacacctgtgtctttgatatcattagtaacctttcagcagaaattgtgcatgccaccatgctccgtcatctggcccttctggtatgaataacccttgtggtgaggaactctctccacttggtttcccaactggtttcttataacatcactcatcctaatttacttgagccaacaaatctggcttctagtctgcagtccttttcctcaacatttggataaacactcttgactacctgaaattcttcagagtaaaaagttatagaggctggcccggcgcggtggctcacgcctgtaatcccagcactttgggaggccaaggcaggtggatcacctgaggtcaggagttcgagaccagcctgaccaacatggagaaaccttgtctctactaaaaatacaaaactagctgggtgtggtgctgcatgcctgtaatcccagctacttgggaggctgaggcaggagaattgcttgaacctgggaggcggaggttgtggtgagctgagatggcaccattgcaccccaacctgggcaacaagagcaaaacttcatctcaaaaatcaaacaaaaaaaatttatagaggctggattcaagaccagcctggccaacatcataaaaccccatctctactaaaaatacaaaaattagccaggtggagtgcaactgtaatcccaactatccaggaggctgaggcagaagaatcgcttgaacctgagaggcagagactgtagtgaacctagatcgtgccactgcactctagcctgtgtgacagagcaagacaccatctcaaacaaacaaacaaaaaagtttatagaaaatgtgccatatatgaaactgggttcaattaattcattaaaactgggagtatttacccaacatttcatgcaaagaaagactaacatgcttaattaaaattaccacacaaggaaaacatttccaaaaagctggctttttaaattatttatttatctagttatcattccttacacatttggtcagcaaacaataaacacttgctaggagccaggatctattaagatggtaaagtagaaaatgaaataacaaatgctcagagcactctctgtcttttcaaggaatgtaaacctagtagcagaaacctattttaaaaagatagttaaaacacagatgctctaaaacagaccagtaagtgcataaagactccactccaaacaagtgacgttgacatccagaaatcagatgtgcagctgctcatttgctcatacccttggaagagcctgtatggcaaaactaagtctcttctgtggtgttcctgaatctgtcagcctcctgatacccctacccaatcccactggccacttgaattgtctaccaataacagttgggatcccaccccatccctgggggagaggtgaagatgacaggttagcacagactaacttgccaggtgaacaaagagtggtaggcaaggtaggcagaagatatggggaggttagtcatccagaaccgccattcctaacaagtggcaagaattatcaggaagcaagaaacaacttgggtaattggtcaggatgaaggacaaaccaggtactcacaggagaaactagagcaatggagagtttctgttttctctgcaatacacagactattcgatgcatcaaagatctgcttcaaagcaaaatggtgcaatgaggccttcttttctgatataatttcaagcattacacacattacttagaatcataagcagggttttattcccttggaaggggtagtttcctgacctggatgcttaaatcaaaaacatgcaataggaactaaaggggaggttaaactcaactttcaactttatgaggtaagtatgttcctattttatcaacccaggaaacatcttaacaagacttagaaagaggggtggttgaaagagaaaaattgatgtattgagcctataattgccttggtattttacagaacaacttctcagttgtttagtgtcagagatgatcttgacattgaaacccatagataatctccaaatccatttttagttaatcaccttactccctgaaattttgtccagcatttcagacaaaggtcaacactgtcagaaatgtggctcagcactttcctggagtgagggatcaatgcacagggataagttactgactgtaaaaggaaatgagactgaatagtgcaacaacccccgggctaccattattgaagttgtgcatttcacccaataatctgaagcaagtccacaagaagagacttctagtgcagtccctaatgactggtttgcctgactcccttatcacattataatgtggtgcacaacaaaagtatgttctgtgtgtcctgggacaggaaagttctgttttgtaattatgttccattggaaacagagcatcacagagcaggggcaagagtttggccttggtgccagcctaccttgggagcctgcagacgtttatacccacattctatgtccccttcccctctgttaactgctcacagagctctctgaaacactagaaacatcacccagtcctatgtctccatgaatgggcacctctaaatgtgatctgggaccagaggcatgagtatcacctggagcttgttacaatgcagaatcttaggccctaaccatatctactgaatcagattctgcattttcacaagattccccagtgattccacgcatgttaaaatctgcaacacatggtttacaaaactaaatcaactatgaagaaaatagattggagagaaatattttttgataagagagccactaacttcaatgatgaaaacaaaacaaaacaaaaaagcaaatagcagaaaaggaggaaaaggaatatctctgatagtaagcaaatagcttggtggcatcatctttaaacttaaaaacccagccaatctctgacaactccaaggtggagaggtgggttgcaaaattctataaaatacttgatcaatagacttaaacacgggactggttatttccactgtacagactgaggaggcaatccttggcttgcaatgtgaaggatgacaaagcgacaatacaatgtcatgagtcacagcactgacctaagagcagacctgggttcaaatcctgactccattctttactagtcatgtgatcttgtataagggacttaacatctcccaggacaaattttctcactgaaacgtgacactaacaacagcacctgcctctctcacattcagagagctgttgtgagaaacccatgaaaattgcatgctacacaggaagcactcagctagtctcagttgtcataatcatagttagtcactgatctttatgacaaccatttgaaagagacaaggccatttacttccccattttattttattttttattttattttgtttttggagacagagtctccctctgtagcccaagctgggctgcaatggcgggatctcagcttatggcaacctccacctcctggggtcaagtgattcttctgcctcagcctcccaagtagttgggattacaggcacacaccaccatacctggctaatttttgtattttcagtagagacagggtttcaccatgttggccaagctggtcttgaactcctgacctcaggtgatccacccacctcagcctcccaaagtgctgggattacaggcttgagccagtgcacctggctactttcccattttaaaggtgaataaatcagggcccaggaaagcagtgatgcccctatgactgcacagctggaggcagagctggcctcacactcaggctcagcttgcctagttcagtgtcctttactgctagccagacgggcttggtgaaagtgaacgaaggctctggtctggagagcagtgattactaggaaagggccagaaagctggcctgatgggcaagcagacagccacctgcctaccacctgagtcacctgccctgacactccacattgggaatgagttactctgccaaaagccaatgatagcatctggaaggacttctcagcaagtatgaatgcaggaatttgcttgtcagatgacaggaggaacagaagacttttaagagtggatggactattctcaaagtgaagctactcaaaagcactgtgtcagccttatgtgacaatgggggagggggagagaggcggaagaaaaaggaatgaaaagaagttaccaagaactttctctgtgctgggcacagaacttaaggtgtattatctcattttaccattacaactttgtgatgtgggcattatcacctccacataattgtcaggcctctgagtccaagctaagccatcatatcccctgttacctgcacgtacacatccagatggccagttcctgccttaactgatgacactgtctggtgaaattccttctcctggctcatcctggctcaaaagctcccccactgagtaccttgtgacccccactactgcccatcagagaacaacccccctttgactgtaattttcctttacctacccaaaccttataaaatggccccaccccatctcccttcactgactctcttttcagactcagcccgcctacacccaggtgaaataaacagccttgttgctcacagaaagcctgtttggtggtctgttcacacggacacgagtgaaatttggtgccatgactcagatcgggggacctcccttgggagatcaatcccttgtcctcctgctctttgctccgtgaaaaagatccacctatgacctcgggtcctcagacccaccagcccaaggaacatctcaccaattttaggtcaggtaagcggcctcttcttactctcttctccaatctctctcactatccctcaaccactttctcctttccgtcttggtgccacccttcaatctctcccttctcttaattccaattcctctcattttctggtagagacaaaggagacatactttatccacggacccaaaactctggcgccagtcacggacttgggaaggcagccttcccttggtgtttaatcattgcagggacgcctctctgattattcacccacgtttcagaggtgtctgaccacgcagggacgcctgccttggtccttcacccttagtggcaagtcccgcttttctgggggaggggaaagaacccccgaccccttcgctccctgtctctaccccttctctgcttttctgggggagcaagaaccccccaatgccttatttccacgccctgaccccttatctctgtgccctgatcacttatatctgtgccccaacctctatctctgcaccccgatcccttatttctgctccctgaccacttatctctgcaccccaaccccttatttccacgccctgacccctttcctaattttctggaggttaagaacccccaaaccccttccctccgtgtctctactcttttgtccgggcttgcccccttcactataggcaagcttccaccctccattcccccttcttctcccttagcctgtgttcttaaaaacctaaaacctcttcaactcacacctgacctaaaacctaaatgccttattttcttctgcaatgccacttgactccaatacaaactcgacagtggttccaaatagccagaaaatggcactttcaatttttccatcctacaagatctagataattcttgtcataaaatgggtaaatggtctgaggtgcctgacacccaggccttcttttacacatcagtccttccctagtctctgttcccaatgcaatttgtcccgaatcttccttctttccctcccacctgtcccctcagtcccaaccccaagtgtcactgagtctttctaatcttccttttctacagacccatctgacctctcccctccttgccagactgagctaggtcccaattcttccttagcctccgctcctccaccctataatccttttatcacctccccacctcacaccctgtcaggcttacattttcattccatgagtagcccacccccacctgcccagcaatttcctcttaaaaaggtggctggagctaaaggcatagtcaaggttaatgcttctttttctttatcccaaattggagagcatttaggctctttttcatcaaatataaaaacacagcccagttcatggctcatttggcagcaaccctgagatgctttacagccctacaccataaaaggtcaaaaggccgtcttattctcaatatacattttattacccaatatcctcccaacattaaataaaactccaaaaattaaattctggccctcaaaccccacaacaggacttaattaacctcaccttcaaggtgtacaataatagagtggaggcagccaagtagcaacatatttctgagttgcaattctttgcctccactgtgagacaaaccccagccacatctccagcacacaagaacttccaaatgcctaaaccacagtggccagatgttcccccaggcccacctcccccaggagcttgctacaagtgccagaaatctggccaccaggtcaaggaattcctcctaagcccgggattcctcctaagccatgtcccatctgtgcaggaccccactgaaaatcggactgttcaactcacctagtagccactcccagagcccctggaactctggcctgaggctctctgaccgactccttcccagatcttctcagcttaggggctgaagattaatgctgccagatggccttggaagccccctagaccataacagatgccgagcttcaggtaactctcacagtggaaggtaagtccgtccccttcttaatcaatatggaggatacccattccacattaccttcttttcaagggcctgtttcccttgcctccataactgttgtgggtattgatggccaggcttctaaacctcttaaaactccccaattctggtgccaacttagacaatactttttaagcactcctttttagttatacccacctgcccagttcccttattaggccgagacactttaactaaattatctgcttccctgactattcctgggatacagccacatctcattgccacccttcttcccaatccaaagcctcctttgcatcctccttttgtatccccccaccttaaccaacaagtataggatacctctactccgtccttggcaaccgatcatgagccccttaccatctcattaaaacctaatcacccttaccccactcaacgccaatatcccatcctgcagtgtgctttaaaaagattaaagcctgttatcacttgcctgctacagcatggccttttaaagcctataaactctccttacaattccattttatctgtcctagaaccagacaagccttacaggttagttcaagatctgagccttatcaactaaattgttttccctatccaccccgtggtgccaaatccatatactctcctatcctcaatatctccctccacaactcattattctgttctggatctcaaacatgctttccttactattcctttgcacccttcatcccagcctctcttcgctttcacttagactgaccctgacacccatcaggctcagcaaattacctgggctgtactgccacaaggctttacagatagcccccattacttcagtcaagcccaaatttcttcctcatctgttacctatctcggcataattctcataagaacacacgtgctctccctgctgatcatgtctgactaatctcccaaacctcaatcctttctacaaaacaactcctttccttcctaggcatggttagatactttcaactttagatatctggttttgccatcctaacaaaaccattatataaactcacaaaaggaaacctagctgaccccatagatcctaaatcctttccccactcctctttccatttcttaaagacagctttagagactgccccaaccctagctctccctgactcatcctaacccttttcattacccacagctgaagtgcagggctgtgcagtcagaattctaacacaagaaccaggaccgcaccctgtaacctttttattcaaacaacttgaccttactgttttgcctagccctcaagtctgtgtgtggtggctgccactgccctaatactttcagaggcccttaaaatcacaagctatgctcaacttactctctacagttctcataacttccaaaatctgttttcttcctcacacctgacacatatactttctgcttcccagctccttcagctgtattcactctttgttgagtctcccacaattaccattgttcctggtccagacttcaatcgggcctaccacattattcctgataccacaccccatgactgtatctctctgatccacctgacattcactccatttccccatattatttcctgttcctcaccctgaacacacttggtttattgatggcagttccaccaggcctaatcgccactcaccagcaaaggcaggctatgctatagcatcttccacatctatcactgaggctactgctctgccccccttcactacctctcagcaagctgaactcattgccttaagttaagccctcactcttgcaaaaggactaaacgtcaatatttatactgactctaaatatgccttccatatcctgcaccaccatgcaagaggtttcctcactatacaagggtcctctgtcattaatgcctctttagtaaaaactctgctcaaggccgctttacttccaaaggaagctggggtcattcactgcaaggggcatcaaaaggtgtcagatcccattgatctaggcaacgcttatgctgataaggtggctagacaagcagctagccttccaacttctgtctctcacagcaacgcttatgctgataaggtggctagacaatcagctagctctccaacttctgtccctcacggccagtttttctccttcacatcggtcactcccacctactcccccgctgaaacttccaactatcaatctcttcccacacaaggcaaatggttcttagaccaaggaaaatatctccttccagcctcacaggcccattctattctgtcatcatttcataacctcttccatgtaggttacatgcctctagcccatctcttagaacctctaatttcctttccatcatagaaatctatcctcaagcagatcacttctcagtgttccatctgctattctactacccctcagggattgttcaggccccctccctttcctacacatcaagctcagggatttgtctctgcccaagactggcaaattgactttactcacatgccccaagtcagaaaactaaaatacctcttggtctgggtagatattttcactgaatgggtagaggcctttcctacaagatctgagaaggccaccgcagtcatttcttcccttctgtcagacataattactcggtttggccttcccacctccacgcagtctgacagtggactggcctttattagtcaaatcacccaagcagtttttcaggctcttggtattaagtgaaacctttatatcccttacagtcctcagtcttcaggaaaggtagaacggactaatggtcttttaagaacacacctcaccaagctcagccaacaacttaaaaaggactggacaatacttttaccacttccttttctcagaattcaggcctgtccttggaatgctacaaggtacagcccatttgagctcctgtatggacactcctttttattaagccccagtctcattccagacaccagaccaacttggactgtgccccaaataacttgtcatccctactatcttctgtctagtcatactcccattcaccattctcaactactcatagatgccctgctcttgtttacactgccggtttacactgtttctccaagccatcgcagctgatatctcctggtgctatccccaaactgccactcttaactcttgaagtaaataaataatctttgctggcaggactatgctgaatctccttaggcactctaattagatgtcctgggtcctcccaattcttaaacctttaatacctgtttttctccttctcttattccatttagttttccaattcatacaaaaccttatccaggctatcaccaataattctacatgacaaatgtttcttctaacaaccccgcaatatcaccccttaccacaaaaccttccttcagcttaatctctcccactctaggttgccaagcggcccctaatcctgctcgaagcagccctgagaaacatcgcccattatctctccataccatcccccaaaattttcactgtcccaacactttaccactatttcattttatttttcttattaatataagaagacaggaatgtcatgcctctgagcccaagctaagccatcatatcccctgttacctgcacgtacacatccagatggctggttcctgccttaactgatgacattgtcttgtgaaactccttctggctcatcctggctcaaaagctcccccactgagtaccttgtgacccccactcctgcccatcagagaacccccctttgactgtaattttactttacctacccaaatcttataaaatggccccacctctatctcccttcactgactctcttttcggactcagcctgcctgcacccagtgaaataaacagccttgttgctcacacaaagcctgtttggtggtcttttcacacagatgcaagtgaaaatgataaacaggcttagagagttaaacttatttatcacatgagagatacaaaaaaatgattcccatttatcagtgatttttttccccatcatgccatgtttttaaaaaaactcattattttagaatagctttagatttacattaagaaagcaaaagtagtacagagactttccatacacaccaaaactcagtttcctctattgttaatatcttgtcgcaattaataaaccaatgttggtatatcattattcactgaagactatgatttattctgattttttttggcatttacacttttccaaggttctaaccagggaactgtgtgatattttgttatgtctttttaggctccttttcattttgacactttctcagttattgatgaccttgacagttttaagaaataccagtcaggtatttcacagaatgcctctcaactggaatttacctgatgttcttctcatgattagactgatattacaggttttgggtagataagtgccattcttaccacatcaagggtccacgactattactgtggatctaaccttgatcacctggcccaggtactgtttttcaagtttttctactgtaaagttactcttttttcctccatttcatactgtactctttggaaagaagtcactgtgtgaagcccacatttaatgagtagggagtcatgcttttcatccttgattgctgatatttttaggctttgtgtccccacctaaatctcatcttgaattgtaatgcaaataatccgcacgtgtcaagggagggaccaggtggaggtaactgaatcacggaggtggttgccccctgctgttcttgtgctagctagtgagtgagttctcacaatatctgatggttttatagggggggtcttccctcttcacttggcacttcttcctgccaccttgtgaaaaaggtgtcttgcttccccttccccttccccttccgccatgattgtaaatttcctgaggcctccccagccatgctaaactgggagtcaattaaacctctttcttttataaattactcagtcttgggcagttctttacagcagtatttaagtggactaatacaagtgcaaagtagctacatgaattatttgaaacttttctgtatggaagagttgtccatttgcctctatttattcaataatttgtttctatcaagagggattcttggatatttatctgatagttttatagtttatttagtttagttttgcagtttagtttatctgatagtattataatccagaactactttattttgctatacaaattgtttcagctttgtccattgagagctttttcagttaactctgatgctcctttgacatactcccactattgtggattttttgagcattttcttactttctatactacaagaggctcaggcttattttgtatatttcttgcccagtcctaccaatcctagagtcagccatttctccaaggcttttttattggagaatgttattaaaaattaaaatctgggtactaggtgtgttctttgctaatgggacattatttcctctagatcctctcagttgacagagcaaggtaatgaatatgtgtatagtaactggtgaatatagaaacatttatatatgcaaccatctgtatctatattaagctaaacatgagtttctactgatatctctagtctaactcatcaccacatggaccaatcaagcctcttcctctgacttgtgtgtaaactcttactccaacaatgagaaacctgaggccaatcatttttcatctctttatttctttctgactcagcagatccagtacaggaccctctgcttaagaaaatcttgaagagaccaggcacagtggctcacacctgtaatcccagcactttgggaagctgaggcaagtagatcacgaggtcatgagttcaagaccagcctggccaacacggtgaaaccctgtctctactaaaaatacaaaaattaactgggcatggtggaacatatctctaatcccagctacttgggaggctgagacaggagaatcgcttgaacccgggaggcacaggttgcagtgagctgagattgtgccactgtactgcagcctggcgacagagcgagactgtctcaaaacaaaaagaaaaaagagtcttcaagaggcttcaagtctctcacattctgacatttaatggtctcttgattatctcaggctcacgctacttttttccacacttgatggtaaacatcttcattgtaattctttaagggtttcacacatctgaggcatggaaaaataactagtgaataattgatataaagggcaacaaagccaacttaagagggagataatgtttgtagtaaaaaatccgaaggtaaaaatttgtttatgtagcatcattttgaattgttattaagtcagccctcagttttcctcataaagtaccctactcgtgtgtagatccactcagtcaaatgcagtggtttatccagtgacctacgattgtcaacccccccttgcctctgcttcctgcagtctccacaggtgacacttgggttc

SEQ ID NO: 1783 - DNA, 70916 bp, Homo sapiens
  DDX11 gene - 31118077 - 31148992 of chr12; NCBI Entrez Gene ID: 1663; Build 35; sequence includes 20,000 bases upstream of initiation codon and 20,000 bases downstream of termination codon of the gene
gaagagatcaacctgaggatgaggtttggatgcagagttttgagagaagggtgatcagagctagggtctaagcaacattggtctgctcccttggaggagaattttccctttttccttctgccctttagccagtgctgcagccacctcctctctcatagctggcatttaaaagccaaatggatgccacaaccttctaaggcatctagatatgcaactaaaatattaaaaaaattccagcaaggtcaaaataatctcaggcctagatttgccaccagtgccctcttctgggcagctttattttacagtagtgtcacgaaacacttgtttgtcaatatatgtatttgtgcactaagtgtcaccagaaaatacatttatgtctgttggttacagcctaaaaagtttaagaaaccatgtttagatgttttcccagtcaggaaaggccaaactaaaaagggctgtgtgtgtgtgtgcgtgtgcgcgtgtgtgtgtgtgtgaaaaagagagatgggggcccccattccactaagaagatgacagaggctgtgcaggttttttctctgtgatctcccctcctcctacaaatcatgcccagaggagggatcttgaggacctgcccctgcctccccagacccatctccacacccaggccatcctgggcagaggacagcagagctcacatctctgtggagagcagactgggctcactgcaggcctctgtgtcattgttcatcttcacttcataagtctcattctgagacctctcctgacacaccatggctatctggctctcctgggaaaagcacttacaacattcaagatagagaaaatcatcagcagctgccaaccctcctcctcttccctcagcaagtaaggcatcacgcatgcacatatgcacacgtgcacaaacacatgaacttgtgtacacacacacaggcacacacacacatgaacatgcatgcaatttctgtggcctcattttcttgtgatggctgatgaagccatgacgccatggaagtgttaagattagggagagggttccatgtgggaggatgtctggtgtggatccaaggagatctgagtcctgactccaattcacttaccctctggcccaagtcacttagcccaccccatgcctcagtttctctttctatgaaataggagtgacatatgccctgcctgactcagaggcctgttgtgagttacaaataaagcaacagataagacggcgctttgagactgggaaaagtcagctttgacctaagggtcctgggctgtgccataaagggcagggtgggcctgtgaggaggcctacctgtgagggcctgccctcccacccctacctgcaatagctgagcctttgggcattagtttggcacagctgagatgtctgtggcatcctattttgatggtgcccttgattctgacacaagctccctgcagtaaaggcacagaaaggaaacctcacctaggagggtttgctctcccaagcagagggcagtgagccggagtccctactgagcctgaatccttcctgaactccagacctgcctgtaccagaacatgtctttccctatggggacacagtcctctgctcactgggtcctgtcttcttcagctctgagccatgagctcttccttttcctgtttgtgctcagctcagtgcctctctccatctttatcctcagaccccagaaggcattaagggaagatcccagtccatcttcttggagctgagagctggatcagtgcccctggctttgaggcagggtaggggcagttctctctcagggaggcctgcagatcgccacctgccccacggtgggaaggaaagatgacaggtgggagctccaggtggattgggaggggagggagatggagtgggctttggcaaggcatggggggataagcttgagatgcagagtggcagcaggcaggcaacaacatttctggagaccaccaggcacaggacatgctggcctgtcctcaggacaagcaatgccagggcctgagctgcccttacccttcaggacgaggcctgggaactggaatgtgggctatgcttttcttcaccaaactgaagcttggcaccctgagtgttgtttgtaccaactgcagtaggcagacggggaaccaacacttcatgagcactgactgtgtgctgtgcactgtattgcgtgctttctgtttgtttgtttcatggagagatgtatctctggggagagggaaatcccctgagaatcccccctctcctctaaagcccccgccaccccaggttctctaaaaatccctctccccttatgtcacagagaataaagcttcacaggaaaatgcccttagaaagggggatttaattcactctgagatgctaaagatggccacggagacctccttaagcagaggctttcaggagaccgacagagaagaaggcagtgcagggacccagcgtgtcctcaactttggctaaataaacctgtaatcgattgaaacatgtcgcagtcactttttggttaacaaggtcaacggaggcacaagcaccaaagtccacctgaagaagttgggtctatctacgaaccacttgtgagtcactgtgaatatttagaaccgggggctaaagcttattccagttgtctgtctggatgtcagtgaggccactccatagtagattctcccacctttggtttaatgggatggacaactttggattaggactaaggaggtagatttgatcttggaagataccttaggcttcttgtctcttatctccctaggaaactgttggctgtcagtatctatactaggggtaagcccaagtgacagaacagttctggaagcatctccttgagttttcaggaaaggtttcactgacacaagaagagagtagggtggcagagcagcatcgggtttggttttcaattcccttttctatctccacacgtgttgggtgaaattcacagggttgccacactctcgtgggtatatttggattacggatgagagcataggaaggtgggctgtgggatacatacagtggagtgctgctgactatagcccccgtcatgtaagaaagcacgtcagattgccatagaacaagttatgctattgttggaataactgaagttcattctaatttagtttttaaaatcattctgaaactttgtcccccctaccgcatagtagttgaagggtactccgttttccctttttctgtcctaaccaagaaacagagcgtgcctcaactgttctgtgaccccatcagctgcacaatttgcccggcaggctggaacccaaggttacgctttgaacactcccaggcacctacaaaggtgtttaggttgttgccccaaacactgagaggaactggccaggccctgagccaaatgccttaatctctcaccaactccattccctgatcctcatgctgcagacctcactaggtagagcacctctttccctaactgcctatctggaggaaatggtgaaacccagtttctacctaagttctcataataaatgctttgatctgatcaccctggcgtctagtgcttctttctttgggattccaactggtcccatcttgggatggcttggggtactcccttgtgggaactcccctgatgccagcagtggcaccccagatgccactgctgaggtgactccagctgtgaattcactggaaaagaacacaggtattcctgattagttctttatgctccctcaaaggtcagagctcaatttccttgcacctgatttctcatccacaaaatggtatttataacacctctgtggaactgtcctccaatacccttcttcctttttaaaaaaccatgcatttggccacctggaatggagaacatgttttccaccccccttgcagctaggtgtggccacgtaactaagttctgaccaagcagtggaaggtagagtcccatatggcactttcaagaagtattcttaaagagcaagggcacatgcatttctatcctgcctgtcttcttcgtgactagaatgaaacacgatgcctggggctaaacagtgatcttaaaccatcaggaggaagtgatatattaaaaggcggaagagccaaaagatagaaagaacctagatcacttatgctagcagagctattcatcattttgcacagtttaccttcagactttgttcataagggggcaagggagtgtgagttttctatcacaggcaaacccaatcctgagggattgacttaatctatcaacattgctgtgaggatttaaggagataatataaaatccttagcagtttttctggcatgaagtcagagggcaactttttcttttttctcaaaagtaatgaaatattaaggctattgaaacttggttctgagaacactgaaagatatggaaagaccatagaacctgtttccacattggccagaatggactgacattacatctttgaagtcggtcataatcagaatgtttttcactgcttctaaattgtatgcactattggataaaactggaacagtacatggccaggcacagtggctcatgcctgtaatcccagcactctgggaggccaaggcaggcggatcacgaggtcaggagatcgagaccatcctggctaacacagtgaaaccctgtttctactaaaaatacaaaaaaaaaatgagccgggcatgatggcgggtgcctgtagtcccagctactcgggaggctgaggtaaaagaatggcgtgaacccaggaggcagagcttgcagtgagcagagatcacgccactgcactccagcctgggcaacagagagagactctgaatcaaaaaaaaaaaaaaaaccaaaaaaacaaaaaactataacagtactgactccatgttagagaaaagcttgtttgcttgaatacagttattgcttttcctgagactgtagattattcattaaaaacagcctcagaaatacaggatcttcagcagacataaaagaaaaaacactgacaaacaactctgggaatgggctaagtggcttgataagaatagcctgatggtacctgcagaaggtcatacaacattgaccaagaaaacagtgattgcctgcctgcctgcctgagacttcacatgtttcataagaatgctctgatcagccaggtacagtggttcagactggtattcctagcacttcacgaagctgaggtaggaggattgctggaggccaggaggatgaaaccagcctgtgcagaaaagcgagaccctgcctatacacaaacaaaaataataataataataaataataataatagctaggtatggtggtgcatgcctgtcatcttatctactcaggaggatcacttgagtccaggaggtcaaggctgcactgagccaagataacatcactgcactccagcctgggtgacaaagtgagaccctgtgtctaaaaagagagagagaaaaaaagctaaggctattttcaggttaggtcaggcttagtaacaaaaactttttgtgaaatgcttcgatcattgtttgccctgctcctaatttcccttaaaacctcccggatcagacaggtggtctttgaagatgagttcacagcctccctcgagtttttggcttcctgaatgtagctaactttccctttcaccaacatttgtctctagacttttggctttcaagcaacaagtggcctagatctgggtttggttacaaattttggcaagcccagccagaagccgtgtgctctgggctgtttgcaccctgtcagctcccaacagacaaagcaattggtcacagcttcataccaggactaactcatccatattgttgggaggacttcttggttcccaagaggtggagcaattgatggcggcagcaggtcagggctaactcattcacattaccagaggttagcggcaaatgctctgtggcactggctactcatggcagaagggaactgcagagacagccccaaagtctgccaaagagaggctgccaaaactctttctacttcagggaaacttcctcctttcccccattcagtactgactgcctacttttgcttttagttggtgaaaggaaactagctttattttttttattttaattttttttgagatggagtctcgctctgtcacccaagctggtgtgcaggggcgcaatctcggctcactgcaagctctgcctcctgggttcatgccattctcctgcctcagcatcctaggagtagctgggactacaggcgcccgccaccatgcccggctaatttttgtattttcagtagagacggggtttcaccttgttagccaggatggtctccatctcctgacctcgtgatccgcccgccttggcctcccaaagtgctgggaaactagctttttggatgagctgatgagctgtacaaccaggtaagtctactggggtgcaaagtagtagtccactttctttaccatttgggcctttggaccatttgtggtaccactggtagaagaaatgactcatagtgactccataccagtctcttcctttgtgaaagcctgggttggaaaagtgcttcatttgttttggttgtgttttgtttgtgtccaccatgggaagtttttttcatcagtcccctctcagagcccactgtggttcatattggctgactggtaagcctacagtgataaccctacgacaaaaaagataatctactgcaataaggtgtggtcaatgtacgtgatacatgaggaagataggtggccattacatggttctttgaatttaatgttatacagcttgaacatttcaatctgagatcaggaaattgggactgcataccttatattcaagcttttatgttggtacataataagcacgcttcccagaaaggttgctggctgatggtgcaaacaggaccatatcaggtaaaatctcctcactctccattacctgaggaggaaaagaaggagataggataatcttgtcaactataaaccctccacaggcaaatgatgctgaggctttgcaggtgcctgtcccattgcagcctgctctggcacctgtgcaggctcccatggaggccccagctgcagtaccagcacagtaccctgagttgccccatctctgccccctccaccagaggattatccagataatacagacttacagggtgtggtggcccctcctcattttaaaggtagccaagaaataggctccccttttaagacctgacaaggcaactaaatttgaccacagcgtacaccctcatgcggcagaacaatttctgttatgcaaattccccgctggaggattaaatgcacagggccatactcctgggctattttggttattcaccattttctatctttgactaagtaaatggaaaaatattcaagtccatcctatagggatgatccataggagatgactgaaatattcaccagtattttttctattcatcattccacaatagcaggtgtacaagcattattaaattttatgatgaaagggggttatttttagacaagactaatgatggagccagaaggctataccaggaagaccctgctgggtcctccaacatcccagaggcaatttccttagtgaaacgcaaatgaaaccttaataatgaggttatatcttgactgtaggattactcctaagaaagggagtacctaagcagcaaagcctcaataaaaaacatccatgacctctggtaggaggccagtgaaaacccagcagcttggttgaaacaagtgtaacaggcttacagaaaatattcagatattgatccagaggctctggaacatgtttgggtcataaatataactttcatcagccaaagtgcttctgacattaacagaaaattagaaaagcaggaagggactgttggaatgaacccttcccagtttacagatattgcttacaaagacttcaatgctagagaaacaagaaaagctagacaggcaaccattttcatggagactgttcaaaaaggtggaagaatgaggggtgaaatagaaaggaatccctagacaaggaccagtgtgcctacagtggggaaatctggacatgagaagtatgcccccctaagctacagagaaaagatggtaataaaaaagacaagggagaggaaaagggaaatatacgccaaagaaggagatggtggagcaggattgtgactctgatgaagactgatggggcacagggactccgcctgatttaacagagcaacagtaatttccctacaggagccctgggtacaagcgacagtggggaacaaaatgactggcttattggttgatactgtagcaatgtttccagccaaggctggagtcactgggaagttacaacagagactctttcttaagccctaagaatataaattgagggatataagattgaggtatagctttctgtatatgccacattgccctattccattgttgggccaagatttgttatgtaaattaaatgcccaagtcacttttgctcctgagaaacaacatctaagaatccaggtatcacccaaacatgtcctatgcctacaggcactggtgattcagccagagaaaagaactcaagaaccattcctgctggaagtctacaacagagggagttgcactgtttgggaagacaagggaacctgaactagcagtcaaagctcagcctgtgcacgttgaatttaaaaaagcattaattccacataaaaacaacactgcttaaaaggtaaagaattagaagtcatacagggggattacacaggtttctaaagcacagacttattcaatcatgacagtctcaatacaataccactatcttgccagtgaagaaaccaaactccaattagtatcaatttgtgcaaatttgagagctattaatgacatcgttcaagatacccacccaatcgtggctaacccatataccccacttacagctaccccaggggattatggctggttctcagcataggaattaaaggatgcttttgttcagtgtctactaattgaggagaaagcccagttgtttttgcacttgaatggcaagatctggagactagggcaaacttccaaaactgctagactgtactgcccaaatatttaagtattcctttaccatttttgaaaaaaatcttactaaaagatttgagaagcttgcaattaaacaggggaatactattacaatgcatgggtaatttactcattgctagccccacttatgaagactgtttataccagtttttgtttgattgttttgaaacaaggtctcactctgccacccatgctagagtgcagtggtgtgatcatgggtcactgcagccttgccctcctaggctcaagcgagcttcccaccttagcctcccaagtagctgggactgcatgtgtgtgccactgcacatggctaatttttaaaatttatttgttgtagagatggagtctcacagtgttgtccaggctggccttgaacttttgtgcttaagcgatccttcaactgtggcctcccaaagtgtctggattacaggcgtgagccaccgcacctggccaatactagttttaaacagcctggtggaattggatcataaagtatctctttgcaaatatgcaaagagcaggtagtctattcaggggtttgcctgcaataaggtaagcagagtctgatgcctgacaggtaacaagcaatagccactatcaaggctctcaaaaatcagataactaaaaggagtcttaggtatagttggcttttgtcacctttgatccctaattttggtctcctagtaaaggacttatctgaggcatttaaaatgtcagagtcagaacctttatattagacagtggaatgccaacagtcattcaataacattaaagaaaaactaaggaaattctttatgggcccccaagatgtttaccctaagatagttacgttgaatttcaccctgaccatgtaaattgatggcttatcttcacaggcatggaacaagagacataagtcatccctcttctcacctgagacaaatgcatatctgattgctccccctgcctgtttatcttatgtaaaaatgcaggttcattgaactagatgaatgtttaagtgactgttcccctaccctcttacatgtgaaggctaatcaaagactcaaaagaatgcaactgcttgcctcttatctacccatacccttttaaaaatgtatcttcctctttcaatacctggccttttccctttaaatattgggatcccaagaccctctttggaaaaagcatgaaacacaatgtttcctgtggatctacgttctttcctggacatgtcctcaacctcagcaaataaacctaaaatgatcaggactcaccttggtcatttttctttagtttacatttcctaagctacagacctgtgcagcacatgactatactgaatactgtgggcaacttcaacatgatggtatctgtgtctccaaatgtctcaacaaagaaaaggtacagtaaacatatggtttgaaagataaaagtggtatgcctctaaagggcactaaagggcactatagcattatagtatttatatgtctttgtccagggttcctggctcataacttctatggccctcattatagtcttgttatagtgctgggacactttaggctcagaaaacagactctctctgtctctgactttctcctgccctcctttcacctgcccaaggcaggactctgcacatcataagatcctcattccagagagggtcctgcccatccttaggaggtgggaatgctgcacagagaggccaagaatctggataagccttggtgggttttcccatctcagacaactagtgttagatcatcccttctggtccagttgtatttgtacatggttgtcaatcatgtctacccaatgatgtctccattgaaggctcaagaggacagggctcagggagcttctggaaagctgaacacgtggaggctgacaaaactcttccctatgccaggagggtggccacaccccaactccacagaagctcctgggttagggacccctccagactcaccccatgtatctcttcatctggctgtttatttgtatcatgtaaaataccctttgtaataaaccagtaaacataagtgtttccctgagttgtgtgagcactctagcaaattaatcaaacacaaagaagaggtcataggaaccccaacttgaagctggtgggtcagatgttctacagacctggacttgctatcttgggaaggaggggacagtcttgggagaatgagcctacaacctgtgggatctgatgctatctccaggtaggcggtgtcacaattgaactggaggacacctagctggtgtcccctccagaactgcttgtttgcttggtgtgtggggagaaattcccctgtatgtcgtcatagaagtcttccatgttgatggttgctgtggtgtgagagcagaagaaaaacacattggaggtggtttttccacacacaggcacttactatgaatggagcttgcaggactggaagttgctctgggtgagtcagggagtgtgtgttgcgtgcaggtgaaagcctaggacattactgcacactgttgtggactttataaacagtggacacttaggctacactaaatttgttaaaatattgttctttcttcagtaaattaaccttaggtttctgtatctctttcactttataaacgttttaattttttaaactttttgactcttgtaataacgcttaatttaaaacacaactgtacagcttttctttataagcttttttctatttaaaaaaatttcttttaaacttttctgttaaaaattaagacacaaacacacacattagctcaggcctaaacagggtcaggatcatcaatatcactgtcttccacgtgttgtcccactggaaggtcttcaggggcagtaacgcgtatgaagctgccgcgtcttatggtaacaatgcttccttctgggatatttcctgaaggatcttggctgaatctgcttttcagtcagcttcgtttttggaaagcagaggccgggcatggtggctcacacctgtaatccccgtactttgggaggacaaggtagaaggatcacatatagccaggagttcaagacaagtttagacaacagagcaagaacctgtctctacaaaaagtaaagataaaaaaaattagtcgggtgtgatagtgtgcatctgttgtccagctacttgggggactgaggtgagaggatggcatgagcccagttcaacactttagtgagctatgattatgccgctgcagtccagcctaggcaacagagcgagactctgtctcaaaaacagaacaaaactagaaagagtacactctaaaataataataaaagtattgtaaacacataaaccagtaacagtcatttatgatcattatcaagtattgtgtactgtatgtaactctccaagctatactcttatacactggcaactcaggtttgcttataccaggaccaccacaaacatgtgagtcatgcgttgtgctaccatgttatgatagttactatgccactaggtcacagaaattgctcagctctgttataatctatggaaccaccttcctatatgcagtctgttgttggctgaaatatcgttatgcagcccgtgactgtgcattggcatttgtccacttggtcttcagcctagctttgtactttgtctttgacattttggcttccactgcaatttacttcaggcttggactccttgaggatctctccaaacctgccatggtctgtttcttgccaccagtccctagctgcacattcttagggcagctgccccagcttagtctgatttatggggccccttatctcgtaacttttagaatcttgaccaagtcaggctacccggcaggaggaaatgtcaaaggcagaggcaaaagtggccctctcactttatctgtatctccagggtcttcctttgcatggtctcctttccttccaccctcaagtccattcctctcctgtttctctccgcccctccaggtttcctcctttaaccgcatcacctagagtcatcttcaccgtgcaaagtggttttgttcaaactaatgtattaacactcaactcagtgcagttgccctttgaatgatcacacccaggagacttttttctaattagtgttcaccttgactgtactatatttcagtgttgatcattttgtcctttggctcagatagctgtaaactgccttctatttcactgattcatcattctctcatcttcctttcccatcttcaaatgtggatatttcctaaaggtcattctctgttcctcattttttttcaaaaacttttaataaaatatacataatcaaatgtaccttaaccctgttcaaatgtacacttcattcatgttgaacatactggcattgttgtgcgaccagtctccagaacttttcctcttgcaaaactgaaattcttacacccgtaaaacaactccctatttgcccttcccccagcccctgacaatcactcttctactttctgtctctatgaatctgactactctaacaacctcatgtaagtagaataatacagtatttgtcttttgactggctttttcactgagtataatgtgatggttaattttatgtgtcaacttggctgagccaccgtacccatacatttggccaacattattctgggtgtttctgtgaaggtgttttttggatgagattaacatttaaatcaatggactctaagtaaagcagattaccctccgtaatgtgggtggacctcatccaattaggtgaagaccttactagaacaaagactgacttcccctgaacaaggagttgtgccagcagactgcctttggccttgaaccataactcttccctaggtctccagcctgccagccaatacaatcagattttcactcaccagtcctccacaactgcatgagctaattctttaagcctctttttcgctctgtgtagacacacacacacacacacacacacacacacacaccctgctggttgtttctctggagaaccctaatacaaataatagcctcagggctcatccatgtcgtagcatgtgtcagaacttccttccaagactgaatcatattccattgtatgtatataccacactttatgcacttatctgtcaatagacacttgggttgcttctaccttttggctgttgcaaataatgttgttataaacacaggtgtgcaaaaatgtcaagacactgcttttacttctgttgtttacaaacccagatgtgaaattgttggatcatatggtaattctatttttaatttttttccatagtgactaccccattttacattcccaccagccatgtacaaaagttctaatttctctatatccttgccatcatttattttttgttttgctccttttgggttgaggttttttctttcttctttttttttgagacagggtcttgctctgtcacccaggctggagtgcagtggtgcaattatagctcactacagccttgaactcccgggctcacacaatcctcctacctcagccttttgggtagctgggactacaggtgtgtgccacgattcccccctaatatttttttaaattttttgcagagatctggtctcactatgttacacaggatggtcttgaacacctgccctcaagttatcctctcgcttcagcttcccaaagtgctggaattgcaagcataagccactgtgcctggctgtgtgtgtgtgtgtgtgtgtgtgtgtaatagtagccatccccatggattgcagtggtacctcatcgtggctttgagttgcattttcccagtgactgggatgtcgagcatcttttcatgtgcctgtgggccatttgcacatcttttacggagaaatatctatttaagtattttgccaatttttttaatcagattgttttcatgttgctgagatatagaagttctttatatattctggttattaaccccttatcagatagatgatttacaaatacttgctcccattctgtaggttgccttttcactctgttgatcctgcccttcaatgcacagaagttgtaacttttgttgttgtccaattcatctatttttatgttattttacaaatccctcaactcatcaccaattttttttgttgcctgtgctttttggtgtcatagccaaggaatcattgccaaatgcaatgtcataaagcttttcccctctgttttcttctaccagttttatagttttatagcttttaactttaatttttaattttaacttcattttaactttagaaaatccatcttaagttaatttggatatattgtataagacaaggatcctacttcattcttttatatgtggatacctccttccttttggaaacttttcctttcagtaatcttactacctccacagctttagtttagatgttttttgttgttgttgttgtttcccaggggtgatcaaatccatatatccagcttttaccaccttcctgagttctagtccccccattttcaaacaccactgaaaatttagtttgactaagtacatcaacctattatgtgaagaaacaccatgtcccacccccactacggtgtggcttaatgagctaaagtaatatatcaagatagacataataatccaagaaactggggttcagagaagtaaatattattagggtgcatcttgcgctgttccagagtgaggcatatagggttttggggacagaacaatctagtctctgataatgttttctcttatagcacaggcacatttcatgagcctttcccactacctaggtgttccagtttggatgtggtttgtttggcctaagtctcatgttgaaatctgatttccagtgttggaggtggcgtctggtgggcaatgtttggaccatgggggtacatccctcatgaaaggcttgctgcccttatggcagaagtgactcagttctcactcttagttcccaagagaattgcttgttgaaaacaaacttgtacctcctacatgctctccttctagaagaggatctaaggaaatttataataaaagcagaggaacgctgaaaccaaacccaattcatatcagtaatagctaccatttgttaagcttccacaatgacaagtaagatgttaagccctttatgttaccaggattatctcatttatctcataagaattctagaacataggtcctattattatctttattttattcgtgagaaaagcagagactcagaaggcttaagtcataggccaaggtcatccagccagttgaatggtggagtggggaatatctggatccaggcagtcagactgtttttttttgtttttttttttttgagacggagtctcgctctgtcacccaggctggagtgcagtgccgtgatctcggctcactgcaagctccgcctcccaggttcacgccattctcctgcctcagcctcccaagtagctgggactacaggcgcccaccaccacgcccggctaattttttttttttttgtatttttagtagagacggggtttcaccatgttagccaggatggtctcgatctccagacctcgtgatctgcccaccaggcagtcagactttattagaacatgcacttaaaattagcaagaaggaatgagaacaacaacaacaaaattaaaaaatgcttgccaaagaaaactaaaacaatgtgcaatatttagccctgagatcactagcagtgaaggcaaagaagaatgcataatgggtttctacagctctcactgtccggttatagaaaatatttctacattagtacaagcacttttcttcctaagccctgagttttgagagtttatcaagaaggcctctgagttcattcaattaatggcatcatctaaggctgtttaataacaaatgcagaggtagtccacataaggaacttttgcctttacctttgagacaaagcccagggcctcacgttaggagtacagctctctaaatataagcctccagggcagaagcgaggggaggatggagggacacaatgcagatttacagcctggtgggtacggcctttgtcctctccatgtctattgtcactcttgaggtccaagcctctactgcactgcctggtttactgcacaacccaacttggctgcttgcttctggtctctccccaccaaaccatccttcacactgcttccagcttaatatttccaagacactgcatttgcaaatccactcctctgtttaaaaatgtttcagtgacttgcaacttgtctacagtgtgaagtataaatttattagcttgttgtttaaagccttctacaaccagaccccgaccgaccttcacgtcctattgagaggtgacagcctgctggcagccctcgcagccctggctcgctcttggcgcctcctcggccttggcacccactctggccgcgcttgaggagcccctcagcccgcagctgcactgtaggagcccctttctgggctggccaaggccggagccagctccctcagcttgcagggaggtgtggagggagaggcgcaggcgggaaccggggctgcgctcggcgcttgcgggccagcgcgagttcccggtgggcgtgggctcggcgggccccgcaatcggagcagccggcccgccagccccgggcagtgaggggtttagtacctgggccagcagctgccgtgctccatttctcgccgggccttagctgcctccccgcggggcagggctcgggacctgcagcccaccatgactgagcagcccgccatgactgagccgcctgccggcgccccagccatgggctcctacgcggccggagcctccccgacgagcgccgccccctaatccgcggtgcccagtcccatcaacccccaaagggctgaggagtgccggtgcacagcgcgggattggcaggcagctccacctgctgcccgctgccgcatccacttggtgaagccagctgagttcctaagtctagtggggacttggagaacctttatgtctagctaagggattgtaaatacaccaatgggcactctgtatctagctcaaggtttgcaaacacaccaatcagcaccctgtgtctagctcagggtttgtgaatgaaccaatcggcactgtgtatctagttaatctggtggggacttggagaacctttgtctagctaagggattgtgaatgcaccaatcggcactctgtatctagctcaaagtttgtaaatgcaccaatcagcactctgtgtctagctcacggtttgtaaatacaccaatcgacactgtgtatctcgctaatctagtggtgacctggagaacttttgtgtctagctcagggattataaacgcaccaatcagcaccctgtcaaaacggctcaatcagctctctgtaaaacagaccaatcagctctctctaaaatggaccaatcagcaggatgtgggtggggccagagaagagaataaacacaggctgccctaagacagcagcagtaactcactaggattttcttaccacagtatggaagctttgttctttttgttttttaggtctgcactgcctttatgagctgtaacactcactgcaaatgtctgcagcttcactcctgaagctagtgagatacacgaacccaccggggtgaactagcaactccagtacatgccgtcttaaaagctgtaacactcaggcgaaggtctgcagcttcactcctgagccagcaagaccacaaacccaccagaaggaaaaaactccaaacccatcggaacatctgagggaacaaactccagacacaccgcctttaaaaactaacaccgcgagggtctgcagcttcagtcttgcgttagtgagaccaagaacccatcaattctggacacactatcaactttgtttctccaagggtgcttcttaaactggatgatgcacaccctaggagtgtgtgtgtaggatggggtttgaagcagtagggtaaaaaacctagcatacattctattccagaggtgtcaatttaccagacaacagttattttaaaacttttttatgcaaaaacatgttatagggtggaatgcaacatttttatgggcctgtgggccatttgtatacatctttggagaaatggctatttaagtactctgcccattaattctaaacttaaaactaagacttcaaagtccctctaaggattttgctgggccacatcccaagaccctgaagggtattacttactcgccctctccaaactgccgaagtcggaagcaggtgacaaaaaagctgaccctggaatcaccttttgtaaatttcccacctccaagcttttcgatagtttgtaacactggctcctctccccaaaagcctttccttcaagtcccagcaactctccctgaccctgctgggaaggcgcaccaattacctgtcattccaggaaagctcatagcataagatgatcccattggtcatctcccagaaccagactttctgaaaagtcctcaaggaccagctagtccaatccctcactgaataaaggagaagcaaagtctagggaggtgaggtgattcgttgtcctcctaattagcaggtgagctcctggcagggctggggtttcatcttctgggctctctgcaaggtcgtgcccggcacgggccaggaacaatttcataaactcgtcatctagacggcctttgactgacaccatctctccgtgtggaggagccgctggggtgcacggggcaggtgtcgtccgtttcaaaggtaaaataacccagctgcagacctccagaggccgactagagccggggtcagaaaacaggttttccctctcggggacagcgcccaggggaccggcattagaacatcggctgatgtttcatctggtcagggaaccatccagcgcttagtacacctggcgctaatcggcggggattaatctcacaccccgcagctggcggaaagcagcgggaggaggcacctagccctggggttgagatcccagttcccgcgtgcgcaaaccacgcccctgtagattctcgctgctgcgtgttcgcgcgcgtcccggagtgcgcatgcgcagcggcgggggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtgggtggcccgtccggagcgggaaaacattccggaagtggagggccgggccagcgtgattgacaagcgggaacccctgtgtggggacgggtaggcctaggaaggttgtgcctgcggtggaactgggcggtgcgcagaagtgggcattaacagcagccgcgtgtctgggtcttagatttggcccagctgtgttgagcttttcatggattatcttacgtagataagacactgcaacagtgagtgagcgcttgtaacccacctgtctcttacggaaactgagccccagcgatgctaactttagcaaggatacagctgggatcctaaacttggcaatcagagcccagagccgataaagttagctgcatgagtctagcttcccccagggcgggaatcgaggcggagcagggtacagtacggaggccaggaatgagtgcacttgaccagattgttgacggaagtgtcataaaaatggacttaaatgctgataagcagctgtttgggttccacacagggtgcgagctcaggatgcacgttggaggggacacagggccagagcaaggtgggaatgcgggtattatgggccaggccatcctccagctggtggagcaccgcagtactgcagtgtgtggccctggcttaacagcagtgcggaaaagcttttttcttggggctgtggtgctttccaggtgtgtgaagttaaaacattttagggccatacggtagatagtacctgccacatagttgtcttggtcagccccggctgccatgacaaaataccataaactgggtggcttagacacagaaatgtgttttctcacagtcccagaggcttgggatgtccaagatcaatgtggggaggacacaactgagcccacaacaatagtctgtactcagtaatgagtgataattggggactgaagaaaatgaacacgttaagaactaatatgttcctgaagtgctttcacaactctaacctcgttttatgagcgtgagctttgctgtcctggtgtgtgccttggcactgggaggtgatggttgtcctccacacagccaacctgaagagggctgaacaagtcactgcaaatgtttttaatagggcttagtgaatccgttatactcagatttatctaaacctctatgatttagcctgtgctgcttctggaataatgagatccataattaccactgatggggaagtgaaataatacttacgtttcttctgtattgtttagtgttgtcattctagagtttggtaaccaagtctgtcttttttatcccacttatcctggtgggaggaaaagtgaggagatagaaagtttcaggtggcttgggggtctggcagatgtggttcaaatcctgagttcaagcacttgctgagtgaccttgggcaagtcatataagtttactgagtctcagtttctttctctataaaatagagcttataaaaataccacacagggtttttgtggggttatctgaaaacggtttgaaaccattaaagaactggccatttaactaataggtattcaagtcatgggacctccgttacccagcctcggaagagaaaccttcacttacagccccgatgtctggctggctactcattcgttcatcagatttttgttgaatgcctatgaggtgtcgaagcacctagttctgagtcctggagccagagaagagcaagacagacaaggttcctctatttatggaacgtatattccagtgaggaagaataaataggttcagatggtgctaagagctatgaataaattaaatacagagtaatgtgattttttaaaagtgacttagagcaagctagggggtgaggagtgggggtggtgtttgaccactgtccagcggccagacagccggagaggcttctctgaggaggtgagccaaagcctggatattgaggaggactccttctccaggccaaggggagcagcaagtgcaaggcccgagctgagtagatgaggctgggagcctgaccagtctcaggctgaccagtgctctgtcttgagaggagctgctggtcagctttttgtcttgggattcagaacgaggagacatgaagactttttacttggcagtgggagctgaagctgaaaggtccaggggctgatgaggccacgtgtaagcgaaagtttgggataagcagaaaccgagtgcgctgagggagtgagattgtggctgtatccggcacctggctgagcaggagagtgaaccccgtgggtgtgtgtttgctggtgacgttcctggagctgtcttgaagtccgagctgccttgcagcttgtagtctgcctctgtttttggctttcccagatagtttcaattcttactctcagtttgtgaacctcccttcagtgaacctcccttcacttatgctggatatctcttgcaaccggatgagcttcactaaagcagagtcatttggacctggattcgaatccctggttttccactttttagctgtgactttgagcaattatttaatttctgtaagcatcagtatccagtagctgtatccttatagtgttgtacagattaaatgagataataaaagcaaaagaccactgtagagtgtttaacacataggaggtactcaaaaatttgttaggtacctttcttcccctttccttcatgtgttaaagctttttcagtacatacccctctctcaggattgaattgtaaatcatgttttttgattacccttcttgtaataattcctctacctctgtagtcatgtttttcttttttcattttttcttgtccccagaatgtctaacaaaacagccaaatatacctctgtgaagacagagggtaaaataatgctagttctgtgagttctctcttcttgtgcaaatccataaactgccaccaatctgtagtcattttaattgcccctaaaccgaagagcatcgtggcaactacctttcccctcgtaaatagagtgacactatcactagtcttattgaggccaaagttataaagatgggctctcgatctactaatattagtaaaatgggtttgggacttactaacatttgtgcttagaagagacagacctggcaaagagcttggagaagtgagttccaaagagagaggtgtgggaaccaggatggaagagtcaggcctccagatagcgtttacttctcctttcttccttgaatcactgtctcagagataattaggttcaggagaggagaaaaaaaaagatgacgtcaacgtggagcagagtttttcttagaccttagcctagcaaggaaagagaaatgcctggtctcagtactgggaagctgttccagccagagccccgtggctgtgaagagagctctcctgtctggaaccaaacagaaagctcataggtctagaggccagaaaagttagtaggtggtggctctgttcggtgctggaaatggaggccaggatgaactaagaagcaaactaaagatacttgtaagataaggacgtgtaggccgggtgcggtggctcacgcctgtaatcccagcacttcgggaggccaaggcgggcggatcacgaggtcaggagatcgagaccatcctggctaacacggtgaaaccccgtctctaccaaaaaaaaaaattagctgggcgtggtggcgggcacctgtagtcccagctactcgggaggctgaggcaggagaatggtgtgaacccgggaggcggagcgtgcagtgagccgagattgcgccactgcactccagcctgggcgacagagtgagactctgtctcgaaaaaaaaaaaaaaaaagatagggacgtgtatgttaacttgcgctatccaaacaacaagctgtgcttatggtcctctgcctgtgcgtcatgattttccaggacttcacaacgggataaagtgaagtagcttcggcttgtgaatgtgcattgcagagacgtgggagaagaaagctgcaaaagtcattataagcaacacccttgatcttaggggtgctggtctgtgagaagagagctctaagccttttgtagaggcattagaaaggtatcggagccacggtgaaatgcaggggagattgggtttaggggctttcctggtctgcattctgctacagccgttaaatgccgctagatggagtgcgtgattctggtatggcctcacgtggacctgctgcgaaggatggagagaacatggtctctgcttcccagaaaaaaggagaaatttggtaataagtgtggagactgctcttaaataatgctccagatttcaagccacttcttcctggaccatgagagagctccctaatgttgtatttatttttcctaggtccatggctaatgaaacacagaaggttggtgccatccattttccttttcccttcacaccctattccatccaggaagacttcatggcagagctgtaccgggttttggaggctggcaagattgggatatttgagagtccaactggcactgtgagtatgaacagtgagagatactgaaaaggacaacttaacagcagccgtactagcttttcctgtttgcctatccagagattttcatagtttgaagttgggcagagtagtctctgtttatctgagtaatagtcacttcctctattaaagtcttttttttttttttttgagacggagtctcgctgtgtcgcccaggccagagtgcagtgggacgatctcggctcactgcaagctccgcctcccgggttcacgccattctcctgcctcagcctcttgagttgctgggactacaggtgcccgccgccacgcccggctaattttttgtagttttaatagagacagggtttcaccgtgttagccaggatgatctcagtcttctgacctcgtgatccgcccgcttcggcctcccaaagtgctaggattacaggcatgagtcaccgtgcccggcctaaagtcttaaacatagctctgtggtctgagaaaaattaggctgaagtcattggtgcctacctattacggtagatgagacggctttcttaccaactcttttccctcccgttccccatccttcaaatataattctaagttttagtctctgctgagtgaaccagtgtgttatgattatgttttgaacataattttgtcttgaacaatatgtcttaatattctgttttttctagttaataattgcccttttaaagttagtttagtttttaatatacctatgccagttcctcccacatcatccagtggcctctcaatatgattttccatacagataactcctgtcttagtcggccaggactgccatagtaaaataccatagactgggtgacttaacaggaatttattttctcaccattctggaggctggaaagttgaagatccagattctggcagggttctggttctggggagggggtctcttcctggcttgcagatggctgcgttcttactgtggagcaagaaaagacgaggaggagaaaaacaaatctttggtgtctctttctcttttatgaggacaagggctgctcccttatggctgctccgttatgacctcctttacccttgaaggccagatctgtagtagagtcacatggcggggttaggatttcaacatatgtttgtttgttaagatgggcagtctcactatgtggcccaggctggtctcgaactcaagcgatcctcccctctcagcctcccaagtacctggtggctggcaagatccaagattactggtgcacaccaccatacacagcttcttttgttttgtttttgttctttaaaaacatttttttaacatgcattttggtggggatacaattcagtccacagcagtgaccaattccatttttaccttggagccctcctggaatcctccatcctttccctgtcatttgaattagttgctcctcagactgacttgacagatttcagcatgagtgttaatggggacagacggccgcacccacaccacatcagggtatacgtccgtttggaggctttcctcaaacgtctggcagccctggactgcctgtgtatgctgaagaacagggcacagaaaggctgagtctgcagggcactggctgtggctgccaggctgggctcctttgttgggggcctccagttgccagcacatctgtgggattttccctagagtcttcagtctctccagagcaggtgcctctgagccctggcccagcaggtacagacgctgaagcccaatagccggtcttccgggaggtggtctggggaaggggatccaggtggagagtccccctcagtgcctgctttcagcctggccctcctccccctccctcttgcctcctcaatctgccggttgcctccagggctctcctagctcagcttccacttagagcccacttcctgtcttctgcaaggagcaggagcagggattgcaacctgagaatctaattgttcttaaaaagaatttcaacccgtccctttgttttcagtggcctgctgtgttcctaccacttcctgagtctttctgagaatgagtgggggagatctctggggacacttgggcttgagtgtctctgccgaaatcacttccatgtctctgccttctttccctctctcctaaaacatattactccttccactttctttttgtgggtgtaagcctccatattactttggttaattttagtgtgctttggaacacagatgagtgcatgttcattctgccttgtttaattttagagacagggtgttgctctgttgcccagggccgagtgcagtgttaagatcatggtttactgcagcctcaaccttctggcaacaagtgatcttcccacgtcagcctcctgagcagctgggactacaggtgtgcaccatcacacctagctaattttttaatttgtagaaatgagatctcactatgctgctcaggccggtggtcttaaacccctaggctcaagcaatcctccctccttggcctcccatagtgctgagattacaggcatgagccactgtacctgacccctttcaccttgtttagcctgacaacccatcttctccctctcaggtctttccatctcagtcttctgcactccaggcttctgcgtcttcttcctctgctcagcctttaattgtcgatgtttctggttctatagcttcatcttcttgtgtgcagtctctgtgaatgtaccctgtggctttattacctttgacattcttctgtcttctaaatcatctcctgaatagagtgttttctcctgtcctgggtgtcccgcagcccatagaagcagccatgctgtgggacaccctgagtggggtttgtgttacctgttgtgcctaccatgcccttccccgccgtggatgcacaggtgccccaccttagctgccccagatgctgtttatccttgatagtcaccttttaagccttatacaggtctatcaagttgagtcaccattaccacttggtgtgtgctgtgccttgtgtaatactgcagttccgggagtcatccaacctggaatgcatgctttgcggggatctatgatgccctcgaattgtatgttacatgtgaacctgtgagcattttctaggggctctgcacctttgtgtcctcagctctgagccccatgcttgctgcaaccagcaggtgttcagagtgaatgaatttgcttatcttggcataaatcatgtaactgttgatgataccccaggaaggtgagcctttggttataaatccttttaacattttccagtctaaaagttttgtggtcttattacacgatgtagaaaacagtgggcctcagttattcttttgctgttgtgccggagtataccacggttgtttttgaaagataactttgaccatacccttaggaacttcctcagctcactttcaaatggagggcactggctttctaaccattgtgtctcccagcccagtgacagctgaagctgactgcttccgatatcacagacagcacagaagagccgccctccaggtgctgctgggaaatgctgcctggaactctttgccatttactttctatcaaaagctgagggaaatggtacatatggggctttcctaaaaatatgggatccatccatttgtcaacaatgtcattctatcctatcccagggcctttcaagattttgatgaaaactaatagatcccatattccagaataatgctattaataattttattattattacttaatgatagcaaaaagttagctaactccaaccgctcacttgttatttgccaggtaatcctctaatccagaggatttggccttttgtgtgtgttaatgtcctgcttgcaccagctctatgaggaaggtgccgctgttgtcatttccatttctgcactcgtggaaacaagcgtagtgaggccagcctgagccacagagctgcaggtgggggagacagctggaaccctggcacctggctgtggagtttgagactctgactcctgcgccgcgctgctgccccaaccgtagtcatacgaggtgtttcaccccgccctggatactctgagatcccctctgggttcagcaggctcagagagctgactgcctggagcagaaggcatggggtcctccagagactcccctgagctgagttcccctgtggacaccagggccgcctccttgtggcgctccctgaagggtcctctctggaagaactgtattggttccctggggctgctagaggaaagcttcacaaactggggcttaaacaacagaaactgacatcccacagcgctggaggctggagtccgagatcaaggtgtcagcatgcttggtcccttctgagggtcgtgagggaaagatctcttcaggcccctttccttggcttataggtggcgtgttctccttgggtatcatcacatcgcctgccttctgtgcatgtctgcatccacgtgtcccctttccaataaggatattagccctttaggctgggtcccgtcctagtagtctcatcttaactaattacatttgcgacagtcctatttccagatcaggccacattctgagatgctgggggttaggatttcaacacaggaatttggaggaatacaactcaatcaggcttatggaaaattctggtcttaagtcaagggtagtgttctccagtctgtatatggaggcgcacacctatggtcccagccacttgggaggctgaggccagagaactgtgtgagcccaggagttccataccagcctgggcaacatagcaagacctcctctcaaaaacagacagagtggtgtcttccagagtgattagtttgcttaaaaaaaaaaaaacaaaacaaaacacaaaccgtaagcactggcgctcatgactgatcatcctgtatccacgcacgagctgcacgaaggccgcgcggtcactctggctccctgttggcgagtacctgggatttcttgctcagcattttggggccttaattcttttaggggactttttgtctaatgtctccccttcttctaattatgtgcgatatttacatagaatctgataaactgcttcaaatttgttttcagaacagtgagctggataattaaagaagctttttcctgcttcttgggcccagtttccatttctttcttttttctgtttttcctggctattctagtgctaatttccttcctttcctttcctaggctggtcttagagcatcctctcctatgtacagccagaccttctttcaagcttttattaaaatggggaaaggtcatttgggaggctttgttgttttcctgtttctaaagatcatttttcttcctgcaggggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggtgagacctggggtatccggaagtgggagtactggaggaaacagggcttcagcgattgttctggggcgattccgagactcaggcagtgcatgctcccctgccgttgccgtgcctctcagctcttccctcagctccttgggtctatggtgctgccgctgtgctgtcttttttgagctggaggtcagcaggccttctccacataaggaactgttggtgcccatttattactcacctgggaaaggacctgatcattgccattggcagcatggttcaatggctgcaaatggatctgatggagagcgtgtggctttgggaggagtgtgccgccttccgcagtgagcagcgaggctgggaccggcagggatgaggtcccgggaggggatgcggcagcccttgagtgctggccggggaaggagagatgcccccagtgaggaggcgccgggctgagtggcccagactccttaggagaggcctggttttgggcttccttggtgattttccttcatgtctgcctcctgtaggcggagcaggccaggaggaagcagcgagaagaacgcctgcagcagctgcagcacagggtgcagctcaagtatgcagccaagcgcctggtgagcctcatttcttggggggcaggattatgtccaggcagggttgctctgcttggaggctcatgggtgcgtggtcagggccttggtctcccctccgtgaccctcactggctatgtgctcccgtacagaagctgggctgtgagtggttgaggcgtggatcctaggagtcgacctctctccagccaggcagccaggcctatgtgaatggggcgtggtgtgctttgtctctggcatgtggggaggtgggtactggtgctgagacttcttcctccctcaccacctccactacccctgtccagaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcaggtgagacagaggcggtagcactaccctgccccaggccaggggacacccttgaagacagctctttccctcatgccacagatgccatgaagcacctggcaagaggcatggtggcctctgccctctgctctaagccgggtccttcctagggtccatgagtgccagtggcagtgaggacagtcaccggcctggcctgtgtcctctcagctgtcctcacggcagctcaggcagggcaggaacatttgtgtctgcgccttatacacaaggaggctgcagccccacaaggagagactccttggctgaggccacaagcctcggcagtggagagctgggctagaactcagctggcctggctctagatctcaggctctgaggcagctgactgcactgggtaacctgtgaggtgccaaccatcaaggcgtccttagcctgagctttccttctcccataaagcctctgttggtccagactcaaggtttccacttgatgagccatgagctgctgggtgacttagccctgagcaggccacccaggccatttcgggcccacaggatccctggtcacagccctgttcccattcacactggaacctcaccaccatccctgagtgtctgctctgagtatggcactgtccagatgctgtggacatagaagggaagaagacatggaggggacagttaatagacatgaaaacaaatagcacctatgtgaagtcagcatgtttgcctacaaggaaaacaaaatggtgatgtggatggggtggggggctgcacctgatgatgagtcccgtgtgtcctgtgacatcctggccaccacatctgtcggagggtaactgcaagaccagagaccctccatggatattcctgaaggttcatccccggccttcacagtctgtctgcagggcgccttctgatgccacctccagccgccatccaccagacgccagcttccccgctgccctgaacttcctccagcgcaccaggccttcctctgtcctgtctgaggatttgctcatgcaacgtgctgtggccaaacaccctgccctcctcccttggcagatgtcttcctctcctttaaggcctggctcaggtgtcgtcttggtggcttcgggtgtcagctgctctgttttgctcatgcacctgcttgtgcttctgttgttgcctcctctccctggctgggctcgagctgcttcagggcaggaaccacgtctttatagtttgatgttcccagagctgacccagtgtttggcataggggtgtgctcaataaaatcgagttgacatgaatgagcagatgctgcctcgttgcagtctggtagtgtaattccaggctgcgcatgtgaacttcgacttctgcccctgcccagggcagagaccaccgtgttgctttatgcctcgctggtgagagggggtcataaacagtttgtgctccatgaacccttcctgcccgcctccgaggtcatgtttctgctccctctcttctcccttagagcccgtggggacaaggcagagaacttgagtggagatggaggtggtgaatattaaaggaacaaagtgctccttcaggtctgggcaagagccatggatcctgtaggtcagcttctggggcttcccatgccctcacgtttcaggagataacgtgagcctcggaggacctgagttctgaatagaaaatttttgctcttcatttcttcacacacccagcctctcagtgagctcctgctggctttgtccagcatgcgacataagattgaatccaagccttttaagatagagccgcctgctctttagtgaccatgaagccaagcctgtaataattactcttctgatagcccaagacaattgtattctgttttgttagaaaggaatttcgaggtgaacaaaaatgttttctttttatgtgatgttgccataggtagcgtgtgcctgtcagatggttttgtgttttctgaggagcatagactagtagagctagctcagcttcaggccatgggatgcagggctggcttccctgccaacgcctggcgctgatggattcttcccgcattgctgggaagggcagactgaggcactgacacaagaagagttgtagctggtcataagtgacagcatcctctgttcactcgattggtcagttgtagcttcatccaggagatggtcatggggttcctgctgcataccaagctctaggtgaggccacggggactcagcagaaacaaggccgacctgggtcctcccttgtggacatgacagtctggggagatagaccgagaggaagcgattttgaatgagatgggtgtgaagagcaggggccatgaatctgtgtcagagcagccaggcctaccagggaaggtcaaagaaggcttcctggaggaggtgatgtttctgctgctatctcagagttgactgggagctggtgaggggagacaacattccaggcacagaacatccgaaggcctgagatgatgaagagcaaatatccgccctggggcctcagaggggtccagcttgctggagggagggcagagaggagagcagcctgccatgagtcccgaggcttccgactcaagacttgggttgggggtgctgagcccctttctcctttttacatttccctacccacagacctgagcggccatgggaggttggggttggcatttgcctgggggagtttctgagcgagcagcacctgctaccttggtggaacccattgctgggaatggccagggctcagcaccagcgctcagcagatgctcagtgcgttttgctgagtttgctgagggaagactgttttctgttctctctcacacacacagagtggatgaggatgaggatgacctggaggaagaacacataactaaggtaacacaagtgtcctcagctggtgctgtgctgggggtataggctgggctgtgcacccctggggaggaggctggagtcacttggctacttctcaccctcctctccacaaaggaggagcttccagcacttggactccgttgcttcttgcacacaaccctggtcctaagttgctcccttggccagctgcagtggaccctggagtcctctcctggggtcagggcctggggagtcctctcctggggagacctttcctgggaacagggacctgaggagacctctcttgagtttggggcctggggagacatctcctgggttcggggcctggggagacctctcctgggggcagggccatgcttgccaccccagggcatcgaggaacagctgttctgggctgaaatctgggtgttttctgtccctgctgggtggtacgggtaggacagacatgagtcccctgccctttgggtctctcatggtgtgcttctccctttgtctgtgttcccatttgcatggagggctatgggttgtgtatggtctgacatttcccatttggtttcattgatttatgacttgttttctgtcggaagtaggtattttctttgtattttctttttttctcccttcactcttgccttagaggagtagagagagggtattctggtcagccttcctttttccctttggggatgtgtgtgacacactccctcccctcccaccaacaacccaccctccccaagtggggaccctttgccacgggagatggtcacccatgtccaaagattggccaaccccccaaaagcggttgattagaggctggatatgactcgtggaaggagctgcctttggggcattcccttgaacttctggagctgtgggtgacttgggaatccctgggtccctcgatagatgcctgacatgggacattgctgtcctgcctcggctttgtgcattgggagccactccctttccctcagcctctcaggccctggcgtgccttgatgttagagaatgctgtgggatgttttggttctctctttgaagcgcctttctttctctctgctagatttattactgtagtcggacacactcccagctggcccagtttgtgcatgaggtgaagaagagcccctttggcaaggatgttcggctggtctcccttggctcccggcaggtaaacagtagccagtatttccaccaggggccatcctgctcctttcgccacaactttgtcctgctcgtccaggccttgggagacgctgggtctgtgacaggctgaaccgtgtgaggagcagccccctccctgacctggccggcccagcactggaaggcaaaggagaggtggcggggcaggtccacgtgtgttggtaggatgtcatttagctggcaccatctttttgcctctttctttctcctttgctgcagaacctttgtgtaaatgaagacgtgaaaagcctaggttctgtgcagcttatcaacgaccgctgtgtggacatgcagagaagcaggcacggtagccactgggaccatggtgtagccgcaggtggtctggagagagtgaggcaggggtggcagtgactgaagaccattaagtgtctttcatagaaagaatggcagaggagaccccagttccttcctgagtcccctctccttgggaaaaagtgttcctactctctgggtcagtgtctggtccgaatccttggcttggagatgattttacgggctctttctggagaacagaagtaaaaccttacagtgttccgatgagaccacagtaggcagtacttgggagggtcttatagaccctaccccatggaagtgggtctcaacattacacaaccccctcttgggcccgtggacagttgctgtcctctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccaggtgagggccctgcagggccagaaagccgctcttgactctcactgtggtctaggccatgaggggggtcctcatcacactgtagtttgggggatgccccccaccgtggtcaggttgatggcaccttaacccattctctcctgatgtgtgagttggaggaggcgcgtgggatcccttggggtctccaggcagcagggccagttggcattactggggatggtatttaggagccaggaaagccggtgcattcctagtgaaaccacagggagaggggggatgccaggagctgagaagagtgtgctgcatacatctatttacaaatggctttccaagtgatgctcccaacttccatgcctatgatgtgatggaggatgtcagtgatagaaccattcagttttccagtttttcctttttgtaatatcagtactcttaactggaaagctttccctaacttacacctacctgcagcacgtgagaatactgtcttctctgcctcaacttctcttgatttttaaacagaaggaagaactgctaatgtagcagatcaaaagtagtatctcactgttatttggtgggtgcagtttcactatttccttgctacttctttaatttgagtgactttggaaacgggatatcactagtggaaaattctgtataatccagaaaaaaatgtaaggttttaaaagattcagggaactaagtaaccatttgcacagcagctaaatgctcaccagcatacctgctgagctgtgtgggcactggcagagaaactgaggaaagctgccaggccccatggtgtcccaggccttccctcccgtctgtttgcctttagagcaagattagtgctataggcatttatacacaaataccataatatggcccaaaatctttacaatttttgaatttttaaagtactttgaccatattttgcttttatgttaatagtattccagtgaaattctgtgcatggggacactggagcccagaaaagttaagtgactcatattttctcaccaagcgtgggtgatggagccattcagttttccgatattttattttttatatgagtattcctttaactggaaactttcctaacaacaaacacctaaagatgtgcagagttgcttttatttttgttaccccagctccacgccttaaccctcactttgaaataggatgtatcaaccctattttgcagatgaggaaagcaagagtcagagaggttagacaactcttccagagtcacacagctggggagtagcagctccaggagtagaagctggggccgcttcctggtgcaccgatggtctgcaggtgtttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgccacaagctgtttttcgaatgtctctacacagtccaggcaggaaatagaagcactcacatcaggagctcagtgtcaggcaggcaaggctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccaggtgtgtgggcctcccctccccgggccagggcctgctgtgacgtaaagggacttggatggttcctccagacacctgggccaagagttcctccggaggtggggcttgatagagggtgcacgagtcaaggcggtgacctcatcggaggctgaccatggctttccagtgcatcgggggaccccgctatgacagagtgcctcatttccctgcacctcatctgcccccatgctcctgagtccctccagccctggatgccagcagccagttctgtaagccagggagatggcatgtgtgaggcagaagtcccctcaggattggattttgtcattactgaagttgtctggaggggactgaattgaggaatgctcaagatcagcgcaggctcctcctgctgccctatcatgcgccatgcatggcaccaggtgtctctggtcttcacgctgactctgccatgggtgtggtgttcctgttttacattggaaacttggagattcaaagatggtcaagctctgtcctgaggtcatgcagctcatgagtgtggagctggggtgtgcccactggtttctgactgtgaaaacccccacgacatcccaccagctctactgacctgtgcctgggctgaattgaggctgggatgtgatggtggccttgaaccatcactctttgtagactccaggtcttttcccaacccggtggaaacttagcagggagattccatacttgaggaattcagcctcttgctttttctctgacccacagtggacactggaggaaaacttcccttccttcccttttctcttagctcccaccagcctaagggctgtggaaacccgtaccttttgtctgcagccagccccctctcctccctttggtggcttcctgtgtgtccagggccagcatcttctaggtgaatctaagatgtcagtaccttagccctcagctgcttgctcagagcctggtttgtgttctttccccagctctgccaggcccattcccagctgctgcagtacgtggagcgatacgggtgagatgtgaccctctgaggtagtgggacagtcccttggtggccccctgcgtgggcctctgagaggcaggcagcactttggttcccacctctggcccgggctgtggcggggtggagctgcatgccattcatgtcctaggcacatcatggtgtgtgctgcacacagacctggaaggctggggactgaccgctggctctgaggcctggggccgtggccagcctgctctctgggaaaggatttgtagcttgtgacccagtttgagaggcaccgggcagcaaggcttccactggggtgggcggggcgagtcgccatcagggcaccaccacttaatgtccgttggcttcttctcaggaagcgtttgaaggccaagaacctgatgtacctgaagcagatcctgtatttgctggagaaattcgtggctgtgctagggggtgagagcctcgtccccctgctgaccccgggcctgcaaaactcgctgggctgctttttccttggatgcccatcaggacacctcagttctctgtgtttttaagaagggtcggccgggtgcggtggctcacgcctgtaatcccagcacttgggaggccgaggcaggtggttcacctgaggttaggagttttgagaccagcctggccaacatggtgaaatcccatctctactaaaaatacaaaaaaattagctgggagtgttgccgtggcctgtagtcccagctgctccagaggctgagacaagagaattgcttgctcaaacccgggaggcggaggttgcagtgagccgagattgtgccactgcagtccagtctgggcgacagagtgagaatcagtctcaaaaaaaaaaaaaaaaaaaaaaaagaagggtcttggtcattgatttagaaaattcttgttctttgtagcttagttgagttgtctgacttgagctttatttagacccatgggttctttgcccatgttctgaggactttttatttcaggccctgctctggggggatattaaggatacagcatcacatagacacacggtgtttccgtgataggcatagttctgtgggttgttcgaagcacttgcatatgcggttttgtgtgccctgtgagaacgcagtgctggtatttgaatccttgttgatagacgcataaactagagctcggagcaagggctgctcccagcacgggagcctgggatcttctgactccagctcccacgcctctttgcatgaccctgtcacgtccccttcttttatgatggggcacccccttggaaggcgtctgtggaagtggaagctgcagaaagcctgtgggagctcctggcgggagctggtctcgtgttgctgctctgagccaccagctctgctttgcctcaggctcaccagtggcctgggcagctcctctgtgctccggtgccctgcataccttggtctggctgctgtgtcccggcctcctggagaaggggtgaaaaacatgaacttacagggctttgggttccacgtgcaagcacgtgagtcagacatgggaggctcctggacccacctgccctctcagtgggtccgttgcatgctataaacagtgaaaagcaaaacaaagccatttaaatacagatgctcttcttacttgatgtgcagtgtggagggagagaagatagggaagggttgggggtcctgagaaccagcattgtgacctatttccattctcttttttagggaacattaagcaaaatcccaatacacagagtctgtcacagacaggtaagagagttgccctcagagggcccagagctgatctgagccacttccgagcttaaccctgggactgaaacctgaggcttagggtgaagctcccaaggcccttcatgtgtttgttctcagggacggagctgaagaccatcaacgactttctcttccagagccagatcgacaacatcaacctgttcaaggtagaggtttccacctttccacattccacatccaatttccttcctgtcaccacctgtgggtaaagtactatgttaagactgtagaaggaagaaaaagcaaaacagatgtgtaattacttaacccttaacgcaacatgcctgtgagacaaaagtcatcttcttttagagtgaaggccacagggatgagggatgggtgagaaagggacctttcttggtgccccatagaacagatagagactccaggtccttgctctctcactccgtcttctggcacagtctccctcaggcttatggacaggaataggacgttgatttgttctgtgcaacccctgtcacgtcttcccacttgggccttgggtctggttgcagcctcagacctctgctcactccaggtctgtgtacccagcgctccccagatgaaacacggccactgccgcctgaaccccaagctcgtaactcaaatcagcaacagtgactgcccccgggtacagggttctgcctctgttgtaggcggcatgccatgtgctgtgctctgagctaggatatccttttgccccagcaaggaaagcaaacaggcccgtggaggtgacttcaggagggtggcgagcacaggcttcccacaagtgagccaatagcaagtggcagagacagcgtccaaacctggctgcactgacttggggccccacattcttcccatcctgcctgccttttttttcttaaaaccagcttttcccctgaattacacatttgggtcactgtcactgccgccatccctgccagacaggctggatccaggtcatccttgatgcctttctccccttgtctcccacatgcctgtgacagccgccaggcctgacagcctgagacagtcctgccgtccctgcgcttctcccacagctgggacatgggtgcaggcactccttctctcgccttccctttgccctccttgctttccttctcccctcttcttcccatgggtctcgggtctcatcactcaccattgagggaatcctcatcgaaggacgtcgctctttttagaaaccggtttaaaggctccaaactcctcatctctgcatcccaagctaagatctggcaccaaaccacacacattggatgcaccgactgagtggcactgccccagcccctgagcaggtcccagccatcatctcctctgtggctttgctcatagaagttccttttttttttttaactctttgtcacctggaaggaaagccaaggggaactggattttactgagcactcttagacttgagagagacatttggaaagagggtctccaccctgaggaggacactgcgttgtgggcaggggcagtagaggagggggtggcctcggagaggagatgacaaggttggtggcaaggaggctccaggtgcctcagaaggtagcactgcgttgtgctgcctgggtggtagaagtggtgttttttgttttgtttttaagattatagcttgctcagtttgcactcatgcctacagctgggcttggtttttgcaggtgcagcgatactgtgagaagagcatgatcagcagaaaggtaactgctcccatcttgtggtcctgaacaagacccagctgtgccccaaccccctgcccttgccatgctttcctcccctgccctcagggaactccagagtccccttcgtctccactctccttggtgcagtgggccttgctggggtggtgggatgtgtgctgcaggtgtcttgggcctggcagagcctccgatccacccagcctctctctcatggctgtacctcgttcctctccactgctctctctcatcccacccagctctttggattcactgaacggtacggagcagtgttctcatcccgggagcagcccaaactggctgggtttcagcaattcctgcagagcctgcagcccaggacgactgaaggtgaggcaggagggtgggcaggcagagccggctgcacgcatgggcaaggacttctgttcctcatgtgtggacctgaccagagggaggcctcctccccgttctgctctgtgcagctcttgcagcccctgcagacgagagtcaggccagcaccctgcgaccagcttctccactgatgcacatccaaggcttcctggcagctctcactacggccaaccaggacggcagggtcatcctgagccgccaaggtaatcaggtggttcttggccaggttcagttcccaggaaggagccaagctgagcccgggagccgcagcgtgaaaggattctttccttccatcctgggaacttcctgggttaggaggaagcagtgcagtgggcactggcctgctgtgacctgggcaagcagtggaggtggatgggaggagatcgaagggctgggatgggggtcccgtgaccagggtaagcagtggaggtggacgggaggagatcgaggagctgggatgggggtcctctagggcaggggtcctagggaaacttctactgtggggtaggtgggctttggtttgggtcatgattttgtcatctatgagccttgtgatttggactattttctttctcaacttcagtttcttcatatgaaaatggagaggataggccgggcgcggtggctcacgcctataatcccagcactttgggaggctgagggggggcggatcgtgagttcaggagatcgagaccatcctggctaacacagtgaaaccccgtctctactaaaaatacaaaaaattagcagggtgtggtggtgggtgcctgtagtcccagctactcgggaggctgaggcaggaaaattgcttgaacccaggaggcggaggttgcagggagccgagattgagccactgcactccagcctgggcaacagatcgagactccatctcaaaaaaaaaaaaaaaaaaggatggagaggacagtgtggtccacctctgtgggctggttgtcctagagattaaatggtgtttaatttaaagagaaagcactagcacttgtgcctcagacctggactcacctgggggaccccctttgctgggacgacagaagtgtctgttgggcttgcactcacctcccaccgatctgtttttccaggcagcctcagtcagagcaccctgaagtttttgctcctgaatccagctgtgcactttgcccaagtggtgaaggaatgccgggcagtggtcattgcggggggtaccatgcagccggtaaggacacctttcccagcccctcgtgccccaggtgttgggatgagatgggggcttgggagagatgcattatcagtcctgttctctcctggggccccaagccagaaagggtcagctcgagcaggcccagtggtgtccgctgggtgacactgctattctctcactgctgtgccttttaggctgcaggagcagtggagactcctctgctgctccattctgtagccccaggatcacatgtctcccagagaaagctgttctgtggtttcaaactcaaggaaaaaaatcatgattccacttttaaaaggttcattttgatgtatatgaatataatagtctttgtaggcgtaatttttacttatgtgcatagctgttttaaaaacaaaagtacggctccctccatgtgctgtcactggaacttgctcttttcactcagcagccagagggtcataaaccctgtctccttgtcagcaagcatgcacgtatttcagtatcccagctgtgctggattccagttacacagatatatagcatttcatgtagctgcttctctcttgttaggtgtgcaagctatttgcagttttctgttttgagcatgactgtgataaatataaccgcatttctgcacagtggtgactcctacctagcgaagggcctcctggacaaaaagctgctgggaatcctgaagcagtgcttcccagccccagctgccttagcttttgatttttatatttttgtatggatagattcatagttttattcattcggcatattaaaagttgtttacagtaattattgtttctgacgttcacattgtgagagccccttcctgctagctcaggtcctccccgtggcccggtcagtctcgcctccagcacagcagaatgtcatgggatcaccatgggtgtcctttccccacactggattgattcatttctccaagctgctctggtttcttgtaatggggaatgacatttagaagtcaagctgtgggtgctagggtgtttgtcgtgctcctggggcgttttggtagacagatctaggaaatgttttcagaatgaatccatactggtatttctttctttctttctttttttttttttttttttttgagacacagtctcgctctgtctcccaggctggagcgcagtgacctgatcacggctctctgcaacctctgcctccggggttcaagcgattctcatgcctcaacctcctgagtagctgtgattacaggcatgtgccaccacacccagctaatttttgtattttagtagagatggggttttaccatgttggccaggctggtcttgaaatcaggtgatccgccagccttggcatcccaaagagctgggattacaggcatgagccaccacgcctggcccatattggtgtttctaagtaaaaatcaaaggatttgtttacttgaccttttattgtacctctttttctcttaagcctgaacatgtgtgctacattaacatacttatctgctctatcctataatatacttaaaagttttgaaatcatagtaccaatattacttctaacaatagatctgattgaaattgcctttcctctttgcctttagagtgtaacccactaaggatgcctggtcactaggctctaaagtcacgtggaaccaggcttctctccgtgtgcttctgttgtcagtttcatagataactaggctgtttttgtttcattttcttttcaattttagaatttgcttttttcttttctgacttgtagtttttaaatatgtaaatatttgtatggctcaaaagtcaaagcaatataaaaagatctattcaggaaagcctcactctcatccctttccagcccattccccacccccatagggaatccgttttactagcttatcctttcagtctttctttttcccctaaataagcaaaaacgtgtcttcatttttccctttcctgttttatttacacagaaggcatcttagtcagttgtctgaccatcgctcctctagtgggctgcgtggttctctgttggacagatgtagggagcttatccaaccagtaccctctggataggcaggcgcatgattacagggaaaggtccgggggcacatgctgtttggtatttgtgggctgtatcttctcactggactcctaaatatgggattcctgggttaaaaagtataaatatgtttaatttgttaactactgtgaaatttcatgagaattgtaccattctgtatcccaccagtactgtctaggaatgcctgtttctccagagtggttacttttggatttttgccagtctaacaggtgaaagcctggagattcttattcagtagtttgggctggggcctggccatgtgtatttttgaaaattttcgctggtgattttgctgcatggccagggttgataatgactgtgccagatttgctggatttcctttgctgttcctgcacatagtttaaacgagactgccagcactgggtatcagtcaccatttttctttttgttagtttgccatcagccttttctttgacctcttctttcagtttgtgtgtacttgctgtctcttagcccagacttctcgcttcctttctgctgggcctctgaggggtcatggggccgtgacgctgtggccttggtctacaggtgtctgacttccggcagcagctgctggcctgtgccggggtggaagctgagcgcgtggtggagttttcctgtggtgagaagctgtgcccagggtggggcaggctagaggtcaggttctggcccccgttttctgtgggtaatacctcatactgcgaccaggcacaggggcggaggagaccccggggtgggagcctcacccttcgtgcgctcgcccaggctctcctgctttgctccctgctgcctgctgcccagtgtgactggtgatggtgggcgggtgagcgctgtcagtcgctgttcctgtgctggatgatggggcagggaaatgccctctctgcagtgtcttgcagcacacctgcatctccagttttcggcccctccctggctcttaccaggtcacgtgatccctccagacaacatcctgcccctcgtcatctgcagcgggatctccaaccagccgctggaattcacgttccagaaaagagagctgcctcagatggtcagtcccagccagctcgccgcaccacagcctggcctcaggcagcaaagggttttctggggcaggggcgctctggcccaccctgagtgttttcagtgttggggaaattgcacagggacacccgcttagagccacacagaatgagcggcgtcgatctagatgcttatggaggaaggtctgagcttccccgcccctcacgccttaggctgcgaaatatgtattcataaaacctccaggcatcctctgaggacgcctcacacaggagaaagctgctagttccctttggctctcttgccctttggttatatctgcccctgccgggggtagggatgtggggcttgggggcatctcctgtggtgtgcctggggtgtgcagcccctgattgtcgttgtggtgcccatcaggaccctggacagaagaagggaggactcagtgccagggcaatagggaggccccctagggacgctagtgctgtgacatgtgtcagaaaggcgcagtcagcagcagcggctgggtgtgtttggtgggaggtggcacctaccaccccgtggttcccacccaggggagccaagtcctcttccttggctgtagtcctgccgagggtctctcctcagttttgagtctcaaggtgaagacgcggtttgtgggtggctgaggggttgctccatgggggctccctccctccctcctttccttccttagatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaaggtgagtggcctgtcggcagccttcccacttgtgaggacagtgccactgagtcctcctgggagctctcgtgctcatcgggtcaggacaggcttctggctcctcatccccaccgctcccagtccctgactacagaggatttcccccaaagtccctggctgtgaggttctccagtcccctggccagaaaacacaaggccacgagcagactcgagacctggcaccctgaacctgtctctgggaaatgtcctctgtctttctcagatattccaggaacctaagagcgcacaccaggtggagcaggtgctgctggcatattccaggtgcatccaggtgcgggcgtcatgctgggcttgggtctgagatcgtgtgggggtggcagctggaaacgttgtgggtgtcatccaagttttggctcagcaactcagcgtctgggtttctcctacaggcctgtggccaggagagaggccaggtgacaggggccctgctcctctctgtggttggaggaaagatgagtgaagggatcaacttctctgacaacctaggccggtaagtagtggttctgctcgtctcctgggccgtgatacatggccggccctcactcccagcagctgggcccctgcctgctctctgctgccattagagcccacagctgggctgcgactgctcagaccagccagctggagggaggggctcagcagctctgggtttggtcctgggagagcagttggattttaggctacccattgctgtatcaggacccagtcaattggcctagacgggatctctcagccgaacaagccctctccaggtggtaggtacagagtggagagaggctgagttttgatcacagtcggagaggctgagggaaggggtagaacggagcagctggtgacgtgggtgatgacccgggaggtcctgacgtccacctgctgggctcttgtctcccccgcccaggtgtgtggtgatggtgggcatgcccttccccaacatcaggtctgcagagctgcaggagaagatggcctacttggatcaaaccctcgtgagtgaccccagtgtcacagagggtgacaggagagtaggcagtgggtgggagtggcatcacccccagggctgatacagccaggccttccccgctgcgctggcgtctcctgccccctccggaagcttggatgcccctccacaccctcttgatcttccctgtgatgtcacctggacccctgctgctggcattggccacgaagcctcctggtctggctccaaagcctggcagggtcttttcccagggggagctgcaggcagggaacagtcctgatgggtcttccccttcactcccagcccagagcccccggccaggcacccccagggaaggctctggtggagaacctgtgcatgaaggccgtcaaccagtccataggtgagcctggctgcctccagctgggtggacagatgggggctggagaaagggagaacaggaaagaggggttgcctgccctgtttcctatataagtctgaggaaggggagggggtcgccgtgggaatgtgctgtaggggggaggcaggtgttgctcggagccccagcctctgttcctatgcaggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtttctgctgagttttttattgatatgtgctgctgttttctctggaagcctctttagggaatcgaggagcgcactggtgcaggggctgggtggagccatcctccgatggagcacaggcagacggaagcccccaccccagctgcgtggcctcaagccagcctcccgctccccgaaggtggtctccacacagacctgggacagtttcatccccgccccttccagggcagcagggctgaggatcccattctggctgtgtccacgtccgggccatggctagagtctgggtttaggggaggaaggcatggcggcgcccgctaggatttccagttgtcctcttcttcctctgcctgtggctgctgggggttagcagagacggtttgttgtctgacatacgggctctctcctcccggcccctcaccagccccagaggtgaaaaggctggaggggaaagggtgagtgagggaggtctgtggggagcactggtttccccaggccccagagacttaaacacaggaagaaaaaggcaagagagaattaacgatgccacagcccatggcagacagcggccctgcctcctacccttgcgtctcaggaccagcttgttgaagagatcccacatcagttccctgccttggcttacggctctcactgcaataggaaagccacggagtggggtgtggggttcagtcacatttgacccccggctccgtgttcctgtcccctgtagtgtttttgttattagacccttttttctccttggtttaggaatgggggccccagggccacccttgtccaggctccctctaccgtagaggtgagaattccagggagctacaatttgaaaaccactattttatgagccaagtagaacaagaaatgacaactattaaaaaaaataagggatttctgaccagctaacaaccccacagaaaatccgccagggatccagaaatgagactgaggtggcctcagagagctccctcctgaaggggatgctgctgctgtcgtcctgcccggcgccttggactgcagtggccggggcctggggtggggatgagggtgcactgaccagcaccgcagcagctgggggaggttggggtgctgttaacgtgccatcttataggtaggaagtggaaatgggagaaagtgtggggtgcctagggaaggaggtgactgagcagggagcctggctgccatcctaacacccagctcactgggcttgagcgacttgagcctggtgccagggcagagtgggtgatgctggggcccaggctggcaccatacttgaggtctgccaggcaggtcaggtaggatggcacatcgaccttgggggacttggcccaggtctggcatgtagaagtagttctctgggacccatgggattaggtggggacatgtgagaggtgacagggacctgcaggagcagctagcgagacctcatgtgcaccctgcacagctgtggtggcataagggattcaatagagcctctcctagagaggagcctggcagggcccccagcccttgcacctgcccctccctctccaccttctgctccagctgctctctcactgatggacaaggggcactgaacagtttatctgtctctacccccagcatcacatgggtctttgttacagcaccagccagtccgtctgggaagacagacttcttgtatctacaggggcgacgtggaggtcaggcaagccggcacctgctgtcctgggaccatgttcctgacctacctctcccatgtcatcagggacactgcactgaggggtcccaggccactgagccaagccaccctggtcaccttctggctcccacctctgtgctgcacctgagtgtgatgccctaggaccccattaagtcaggctgagtcttgcacccacaccctgcgactccattttctgctacacaggatctctctgatgttgacgagcagcatggagacctggggagaccccccaagcgcctcctccatgtcatccttgggctccagcttggcgctcacacacacaggaaaggacttcagcttctcctgggagggctgggtggctgaggggtggtggatttcggagttggactagcagctggcctagaggctactggggaggagggagcagggagcacccactcctgatccagattcactgcttccctcgcatctgtcatgaccccaaagaagcagatcctgaacctgggctcttgtctttacctttgttctcttccactctggggtaattaagaatgatttgctggccaggcgcggtggctcatgcctgtaatcccagcactttgggaggctgaggcaggtggatcacaaggtcaggagatcaaaaccatcctggctaacacggtgaaatcctgtctctactaaaaataatacaaaaaaaattagccagtcgtggtggcacacatctgtagtctcagctactcgggaggctgaggcaggaggatggcgtgaacctaggaggcggagtttgcagtgagtggagattgcgccactgcactccagcctgggcgacagagtgagactccgtctcaaaaaagaaaaaaagaatgatttgctaattaattatgcaggcagctgatccagtgctgtgtaaccttgggggccaccagatgccaatcaatcagtagaatgggagagaaggatggaggaagtgaggacaaggggcaaggaggaaggtctgtccacctgtctcttctgtgcaggaggtgtccaagcaggaggagcacgtcacatccccactgaaaaagcccacagaaaatgaaaagcccacatgcttgtccattgctgcaggatgggggcaagtggagggggagaggtgtcggcgctcccaccttactcccagtcatggctgactcctccctttccttcgttcttgttcctaatctgtcaccatgtcctgtcgttttctttgtctcacccaaccctctctgcctgaaaatcccctgacggcagcctcatccctgtcacctcctgactgtagttggtgacagaagaggaggctgcactagtgaaggagcagggactccaggtctggcaacaaccagggatggggccgggtgggggtgacttggaccaggagaggggcctgagtcaggcagtcacatacttcatgctggggtcccccaagtgaagcacatttagcaagatctgaaatacagggaaacagtcttgtttcttcaataaataaattgcaaaggagaaacaattgatgaaaggagaaacctatagatccagaaatactaacaggcaaatcaaacaatcataaggagagactttatttggattttgattcaaacaaactaacaaaaaaatgaaattactggaaatttggagacagtagggtagttggtagtattaaagaatagtagtgtgcgatggttggtatgataatggtattgcaattttgctttttttttaaaagagttcttggctgggcacagtggctcatgcctgtaatcccagcattttgggatgctaaggcgggaggctcatttgaggccaggagttcatgaccagcttagccaacatggcaaaaccccatttctactaaaaaaaaaaaaaaaaaaaaaaaatacaaaaaattagcctgatgtggtggcacacacctgtaatcccagctactcatgcagctgaagtaggagaatcacttgaacccaggaggcggacgttgcagtgaactgagattccgccactgcattccagcatggatgacagagcaagactctgtctcaaaaataaataaataaataaataaataaatcataagttcttatcactgggtatggtgtctcatgcctataatcccagcacatttgggaagcacaatttgggaagaattgaagtctttattaagtatttctacccatggatccatgtatttcttcattgatttaggtcttctgtgattttgtttacagcattttgtacattttcagcatacagatcttatatagacttaatcattttttcagagatagtacaaatgcaattattttaaaatgttgattttctgttagttattgttagtatatacaaatgaaattgagttttgtattttgaacttgtgctacttctggaatgtgtgtgcgtgtgtgtgtgtgtgtgtgtgtgtgtgtgtgtgtgtgtgtgtgtgtgtatgtagtccttggaatacaccataaccaagtgggtttttcctgggaatgcaagactgcttcaatacttgaagatcagtcaatgtaatctgccatagtaataatctaacaagaaaatcaacatgatcacatcaattgatatagaaaaaaaatttacagaattcaacatattttcctattacagattttctgcaaactaggaatagaagcaagcttcttaacctgatgtatggcaccttcaaaaagcctacagcaaacatcttacttagtgatgaaaacctgattgccttccccataagatttgagaaccaggcaaggatgtttactctcatcatcactcctatccaacatggtactggaagtcctagccaatacaataagggaagaaaatgacacaaaataaaggtagtaagattagaaagaaagaaattgtctctattcacaaacaaggtgatttcttttcctttttcttcttttttttttttaagagacagggtccttctctgtcacccaggcttaagtgcgatcatggctcattgtatcctcaaactcctgggcacacacaaacagtcctcctgcctcagcctcccaagtagctaggactaccggtgcatgctgccaagcccagataattttttttattttttggagacacaggtagtctcattctggtttcagctctggaaggggtgaagaacaagtccccagagcccatcctgtccctcgtggatgacatactgagggctcaggaagactctccctcacagcctgccccagtttccaggctgagccacctgagcagctgcttcagaaagcctcttgtgccatagccatgcttaggaaaaagcatatcttccattcaattcaccaagaaacaccaagaaataactggatacaaagaataaaaaatactctgccacactggcagggcaggagggtgaaaattgtgccccctccaaaggtaatgtctataaaaggataactaaggccagcgccaaagtccacctacagaaggcgggtctgtctcaaccccagctgtcagtcactgtgaacttttagaactggggctgaagcttcttccagttgcttgctcagatgtcagtgagaccgctccacaacagataaggggagctgtgtgtcagggaagtcccagccactagcacaagctgcactccaggcagacgtttctgttcttgtgcaaagaacagcgcaatccattcaagttcacaggggcgggtggcacttgaaaatgtcagggtcaacttgcagggcagaagttagcagggaagtaagtcttcctgggggagtgggagagcccagcagagtttaggaggagggaggggcaacatcggggcaatcctctgagtctctctttcctcctcaggaactgtccaggaagaccctgcagtctctctgcaggctcatgggagctcccagaactgagacaacacacagatccaggcctgcttcgaagtcagtgggatgcggcccttgaaagtcgatgtattgggttcctagggctcttgtgaaaacatgccacacctggctggttttaaacaacaggagtttattctgtcagttgagaaggctagaagtgcaaaatcaaggtattgacgggatgagttccaactagaggctgtgaggcagatcaactccatggctctctcctggcttctgctggtttctggcaaccattcacttcccatgcctggtagacacatcactctaacctctgcctccctttttcacgggcacattcgcgtgtgtgtgtgtgtgtgtgtgtgtgtgtgtgtgtgtgtggatgtgtgtgttaaggacagcaatcattagactaggtggggcccactctaatccactgtgagcttctcttactttggtaacatatgcaaagacccaatttccaaacaaggtcacattccatgttctgggactgtcttctgtgagatgtctcccccaggatccttccaggttttctgcaaagccaggcagaaaaccaggatcagggcaggacaagaggatgctagcctgtgatggctcccactcaggtgggatgtgagaagtgcctgtggcctgggacacaccaacttgctcccaatacctcatctgagatggattgcacagtgtatgtccagggcccatcccggcacactgtgcctttgcaatgctgtctctgcgctttggaaattgactcagcccactgcgtggggtggtctgaggcgggccacaaccatttcttaaccatccctgagtacctgaccagtatcccccgggggtgacaactggctacatctggagcatgaggagcgtgtttacctggtgagtaaggatgcaagcataggacgtcctggccgatcctctgcacaagcaatgcctttgctccaacgggatgggcaacgttggattaggcctgaggcagatttgatcttggaagatacattcaagtctacgtgttttgtgcgtttattttcgtttccttgaattaacatggagtccatttcaactttcacttagtctccttctttctcttcccccacttctctctctctctttctttgtatatggaagaatttaactctgtgttccataatgtctaaatactcaaatttagagttgacagccatacagcaaattattcaagttgctgtcaaaaaaaaatccctgcgttttctaggattaaaactgtgaatagagtactggaagaaaaaaaagtcatagactcagatgcaaaatgacaacatttaatgggatgataaggaaataagacttgtcaagaaaccatagcccactgcagactgttcacgatgtcagatggttcatgatttttttccaggtttgatacagaagaatcagtttgttaaaagaaatgcttctccacctgggatttaaaacatcatttaaacaataaacacatttgtatgtatatataaatagatatttagaaataaaaacatgcatatataggcacatagacatgtatatacatatacacacatatgtacaaatatatatgcctaaatttttactgacctgtcaacttacaaaacaaaaatgagagatttataaaaggtacatatatagctgtgaattctttaaagctatttttaaagaaattaatataatcttaatgattatcagattactcatgcagtacacagctacacaagtctaatgaagtaccagagacttttctttcttcaactattgtcctatcttattcaggttttcattttcttactagatgtgttttcaatggtttatgacgtaataaaatttctttacttcttccagtaattgctttgtctcactcggaaactgaactactgttgatgtggtaaaaagctagggcatattcttctgaaaaaataaagggaacatgtatttttattaaatagatgatataagcacattagatctaatccttccaataattttgaaatagagacaattactttcccattttatacattatgcagaaatatgctaataatatttaagacacttgatgaaatatattctattagtaaatgatagagacagaattcaaacactccacaaacttcacacagcattcaacaagaaataaatagtaccaaccttccagggaacagttgtatggtctctacaacattttagtatatgttttagaaattaatctatcaaatttttaagttaacatttcagaatattccccactcctctttttaagtcaaagtccacagaagtagcttggaacagtcagtcttagcatgaacaacaatgacaataacaaaaagacctggaagcttagtgtggcttgtatttcaagttcaagtggagccctgtcaggttatattgcaaggattctggtgttgaaaaactctggtaactggaaaatgggttcagtcagaagacacatcatgggataaagaaaccagaacacaaagtaatgccatttattgtttactctgtgaagacagaggttgattttggaaagtttagtagctcagggaatgttagatataaacaccacattcaataaccttagggcatggctgttgcttgcctacctttttcgtactaatcgtagaccatgcctggggctggctgaatgttgaacacaaggttgctctgctcagcagaaaaagtgaaactgtctgctcgaccaaaaacctatcatgacacaaattataattacattgtagcaggtctgagaaaagataatcactgagaaaattatccgcagaagtttatgatctacataattaaatagatctagggtatgattaacttacatattggcaaaataatgagttgttaaccttaaatcatataaaatttcaagttcctttgcttacattgaggtgagaggaatttagctggaagtctcagaggaatgtaggcatttatgtgagtggtaacaatacacatagaaaggatgtctctaaagcgcatgccatagtttggcatttcctcagtaaaataaaaatagaactaccctatgatccagcaatcccatttctgggtatgcatccaaagaaaatgagatgaatattttgaagagacagctgcagtcccatgctaattctttcattaatcacaatagccaacataaggaatcaacctaagcgttcgaaacagatgaatggataatgaaactgaggcatatacacatacaaattattcggccttaaaagaagaaagaatttctgccatttgtaacaacactgaagaacttggaggacattatgtggaatgaaacaaaccagatacacacaaaaaacactgcaggatctcacctgtaagttaaatctaaagttgagttcatagatgcagacagtagaatggcagttatcagggatgggaaaatggggagatgctggtcaaaggatagaaagcttcagctgtgcaggatgaatacattctacaaatctcaggtacagcggtggcctacagttaacaatgctgtactgtatatgtaatattccctaagggagtagatcttaagtgctttgtcacaaaaaaagaagaggtaactgtgtgaagagagggatgtgttagccagctaattcacatatagtcacgctagatgataacaatcagctcactatatatatcaaaacatcacaccacataccttcaatacacaattgtaatttcaaaaaattatggcaaactttgtaagactttagtcaaattataaaataattacatatctactctgtgaccagactgtgtttgatagggagatgatgtttctaaaatggaaagctatctagtcacatagccagggcatatatgaaatagccttggaactagcaaggagaagatgatcagtgggataaaacactggtaatccttaacgtcccttattttttccttttacaaatcctatcatacatatctataagaaattgaagcatccaattatccttggaaggaaaaaagaaaaactttaaagaaaaaaaaatatggctaaacttacattttccaagtagaaaagaacatggtcattcttgacttcagtcttcatcacttggcccttgttttcaagctttgaagaaattgttagggaaggatagagaatagatattagaacaaatgacagcgccactgcagaactgaatgtccactcttttctacgtcacgttctgttttatggaacattccttggtgccatgatgttttcataaacacaggtagcaactaaagaaaaacatatgatgaaccatgggaaatactgactgctaattggtacaaatgaagtacaccagctctccagtgttagcgcaaaaatacaaaggtgaatgttgaagaagaattctatagttttgttttgctaaactacggctaaacaagtatttattttatctttatactctatgtagctgtctttgtgatgaaagattaggcttctattatttacctcttcaatggatgacatggttggagtaaatcctgatagcatttttacatctataaccaccatactggatttattgcgaattccagtgtatctgaaaattttaagaaaacactcgtttagatatcaattttaaaaagtgacttatctcataatgagagtgccaggtggataaatactaattggctagaaatctggaggacaggtaaaagctgaagagaaaatatcggaagaaagtcattttcaagcatctgtgaataggcacaaccagaatgataatgaaagagatgatacatagcaacagaaattggagcaaataatgaattatctggacatgaaatcttccccaaaccctgcttttaagcttacctgcagtctcaaagtttgaactgataaacagagcttctaaatcttttacatatacttaggttagtgttagagttgcgtaacacttagaggacatctttgcttaaaaggtggtatatgagcataattatagagtagatgtgtccccaggagaacttctagctcagtttcctgcttctggataagactattggggtatgaagttaagagttccatagttcatcagggcgtggttgctcacacctgtaatcccagcacttctggaggccaaggtgggtggatcacttgagggtcagagttcaagaccagcctggccaatatggcaaaactctgactctactaaaaatagaaaaattagccagatgtggtggtgcacgcctctaatcccagctactcaggaggctgagccgtaagaatcctttgaacccaggagctggaagttgcagtgagctgagattgtgccactgtgccactgtactgcagcctgggtgacaaagtaagactctgtctcaaaaaaaaaaaaaaaaaaaaaaaaccaaaaaagaaaaagagttccccaattcattgagttcttagccctggagctcaagcgatttttatttagaaattctaaaaaatatctcccaaactaattttactcaatgttttccacatattaactaaggctaaaagcctttagcatctataaatcatgcttgaattcaagaggatcatttcgtttttctattctgaaaagtaaaaatctaaaatgttactctttacagttacaaaataaacatttgtgggcttgctactatatgaccatgcatgcttgtcttgagaaagaaatatagaatctctgtttttcaaaactaggagtacttccatacaacagaataaaaagtatcattgaaacatcagtgcagtgaaagctttcaaatcctgctcacatagactgcatgttttcttgcctcattttagctctgatttagctgaagatgtactaaattgtggtgtccggacagacggctaaaaagtgactgtgctgtagaattgtcaccaccaacatgagaactcattaccatgatttatattttgttatttcactactgtttgaacttttaaaatattttaccatcttgttcacgtgggagttactgtcaaaatatgacacttacttgaggttcactgtgaggtcaaaaacagtcaaagagtagttctttactatttccaaggaaagagaaaatccagatgccttcttaggtaggagaacattgtacttaagggtggcctagaaaggatagcaaattataagaaaacccatcctgtattaagaattatacagtctgactatagtcagtagtaatgtgattttacattttaaaataactaagagtatacttcgatcatttgtaacacaatggataaatgcttgaggtgatgcataccccacttgccctgatgtgattcttacacattgcatgcctgtatcatgcacccggtaaatatttacacctactatgtacccacaaaaattaaaaataaaacatttttaaaaagaaagaacctattgtttatttctattactaatgcagtttacatctttatcatcagggaatcaggttaaattctttagttttcagaataacgtaatttaatgaagatagaatactttctaatagcaatattcctcaaacttctcttagacagctgagtagcttttcataaagtaacttgcaattttggctattgatcatgtaaatacacaaaacggtcaaataacacttcacgtagaactgaacagacagtctgactcttttactggcaaacactcatcaccctcttaggcagatttctgtaacctggataaatgtacaaccgcgtccttccacatctactgtgtattgtccaggtgcctgtgttacttctgaacgttggaccagtaggcggttatgaccgttaaactggatctcactggatccttcactgctaaaggtgacagtgttttgattcttagagaagagcccctcttccccgcctggctcttaggatccccattgcagggcggggaggcacccaccgcgagggggagactgagagccagtccctcccacccccggctcttaggactcgcatcgcaagcgggggaggcacgccacgcgaggcggggactgagagccagccccccttccccccgggcttaggacccccatcgcggttcctaagatccttaggacccacctggaggactgtgggtatggggtgtccaagaagaaagctcagatctgcccacggcaggtaccttacttgggatttacaatcgacaggggtccgaacgcagcccgggaaaagaaagaaagcaggtcatttacaatctaccggagccagcccgtcttcccctcgcttgctcttaggtcccccatcgcagtggggggaggcacccctcgtgaggcgggaactgagagccagccccacctcccccctggctcctgggacccccatcgcagtggagggaggcactccccgcgaggcgaggactgagaaccagcccctcttccctccctggttcttaggacccccatcgcagggacggaggcacccgcagcgaggcggggactgagagcctgcccctcttacccccctggctcttaggacccccatcgcaggagtcggaggcaccccccgcgaggcggggactgagagagagctcctcttcccccccaggatcttaggacccccatcgcggggggggaggcactcccgccaggcgaggactgagagccagccccttttcatcccctggctcttaggacccccatcgcagggggggaggcacacaccgcaaggcgggaactgagagccagccccacttcccccctggctcttgtgacccccatcgctgtgcggggaggcaacccccgcgaagcggggactgagagcctgcctctcttcccccccaggctcttcggacccccatcgcaggcgggggaggcaccccctgcgaggcggggactgagagccagccgctcactccccctgactcttaggacccccattgcaggggggggacgcacacccggagaggcggggactgagagccagcccctcttcccccccaggctcttgagacccccatcgcagggggggggcaacccccacgaggcggggactgagagccagcccctctacccccccatggctcttaggacccccaatgcaggcgcgtggcaccccccgcgaggcggggactgagagccagaacctcttccccccctgtgtcttagaacttccatcgcagcgggggaggcactcctcacgaggcggtgactgagagccagaccctcccacccccggctcttaggacccacatcgtagtggcgggaggcaccacccgagagacggggactgagagccagcccctcttccccccctggcccttgggaccccgatcgcaagggggggaggcaccccccgagaggcggggatcgagagcctgcccctattccccccccttggctcttaggacacccatctcatgggtgggaggcacttccagcgaggcgggcactgagagcccgcccctcttccccccctggctcttaggatccccatcgcaaggggggaagacaccgcccacgagtcggggactgagagccagcccctcttcccccgctggcttaggacccccaccgcggattctaagatccttagcacccacctggaggactgggggttttaggtgtccaagaagaaagctcagacctgccgaccgcaggtaccttacctgggatttactatccgacaggggtccgaacgcagctcgggatcagaaaaaaagcaggtcatttgcaatctaccagagccagcccctcttcccccccttgctcttaggacctccatcgcagcggggcaggcacacaccgcgaggcgggaactgagagccagcccctcccacctctggctcttaggactcacattgcaagtgggggaggcatcctccgcgaggcgcggactgagagccagcccctcttccccccctggctctagggacccccatcgcagggggtggaggcaccccacgcgattcggggactgagagccagcccctctccttccccctgctcttcggacccccatcgcagggcggggaggcacccaccgcgaggcggggactgagagccagcccctctaccccccgtggctcttaggagccccatcgcagggtgggaggccacccggcgaggcgaggattgagagccagcccgtcttccccccttggctcttaggagccccatcgcgggtggggaaggcaccccccgcgaggcagggactgagagccagcctctcttcctcccgtggctcttaggacccccatcgcagtggggggaggcaccccccgcgaggcggggactgagagcaagcccatttcccccccccccggctcttaggacacccaacgcagaggggggaggcaccccctgcgaggcaggaactgagagccagacccacttctccccggctcttgggatccccatcgcggggaggggaggcaccccacacgaggcggggactgagagccagcccctcttccccccctggctattaggacccccatcgcaggggggagaggcaccccccgagaggcagggacggagagcctgcacctcttcccccacgggctcttaggacccccatcgcaggcgcttcgcaccccacgcgaggcgggtactgagagccagctcctctttcccccgtctcttaggactgccatcgcagagggggaggtaacccccgccaggcagggactgacagccagcccctcttcacctctggctcttaggcccccatcgcagagtggggaggcaccacatgcgaggcggggactgcgagccagccccacttcccccctggctcttgggaccaccatcgcagtggggggaggtacaccccgcgaggcggggacggagagtcagcccctcttcccccactggctcttgggaaccccatcgcaagggggagaggcaccctccgcgacgcggggactgagagacagcccctcttccccccctggctctagggacccccatcgcagggggtggaggcaccccacgcgatgcggggactgagagccagcccctctccgccccccccgaccccgcccgggtcttcggacccccatcgcagtggggggaggcaccccatgcgaggcggggtctgacagccaaaccctcttccccctctggctcttatgacccccatagcaaggggggaggcaccccccgcgaggcggggactagagccagcccctcttcccaccctggcttaggacccccatcgcggatcctaagatccttaggacccaactggaggactgtgggtattaggtgcccaagaagaaagctcagatctgccgacgttacttgggatttactatccgacaggtgtccgaacacagctcgagatcagaaagaaagcaggtcatttgcaatctaccggagccagcccctcttcccccgcttgctcttaggacccccatcgcagcagggcagacacacaccccaaggcgggaactgagagccagccccacttcccccctggctcttgggacccccatcgctgtgtggggaggctccccccgcgaagcggggactgagagcctgcccctcttccccccccaggctcttcggacccccatcgcagtgggttggaggcaccccctgagaggcggggactgagagccagcggctctttccccctggctcttaggacccccattgcagggggggggacgcaccccccgcgaggcggggagtgagagccagcccctcttcccccccaggctcttcggacccccatcgcagggggggaggcaccccccgcgaggcggggactgagagccagcccctcttccccccctggctaagacccccatcgcgaatcctaagatccttaggacccacctggaggaccctgggtattaggtgtccaagaagaaagctcagatctgccgaccgcaggtaccttacttgggatttactataccacaggggtccgaacgcagcccgggatcaggaagaaagcaggtcgtttgcaatctaccggagcctaagggcagaaggcaggtgagagaattcttaggagctgtggggttttgtagactgtggatcccaaactttgcagtattagccaagcctttgtatgaggtcacaaagggggcggggaccgggaagctttggaatggggatcccaacaacaggaaggctttcaggagttaaaggaaaaacttctggcagccccagccctggggctaccggatctgacaaagccttttccattgtatgcgtcagagagggaaaagatggcagctggacttttatcccaaactgtggggacctggctgaggccggtggcctaagtctctaaacaagtagacagggtttctacaggatggcccccctgtttgagggccttggcagcaactactctgctagtactagaagcaaataagctgactcttgggcaaaacctgaacataaaggcccccccaaactgtggtgactgagagccagcccctcttccccccctggctcttaggatccgcagtggactcacagcctgtttaccatattgtgagtaatatcatctccccctctggagacctctggagattatgaactgtttcacagacaggtgtacacccttggtgtacagagggtgtacacccgtctgtattgggagtaatatcatcctcttcctccctgaatattaagaacagtatcacaggggtgtttctactccctgcgatatcgcgtgtcatatcctcctctcccacgttgcaattagaaacaatatcagtggtggcatgtccaccttctgtcatattgaaagtaatatcattttcttccctccaggatcgtgggaacaatatcccaggggggtttccactttctgccatatatgtagtcacatcgcccactccgccttggaatattattaaggaccatctaacacgagggtgtatacgtcctgcgatattacgagtaatatcaacttcttggcctctgaatatgaggaagaatatcacagggtgggtgtatacctcgtgctctattatgcggagtcgtatctgtctattacggggagtaatatcattctctccctttcaggatattaataacaatttcacaggctgggtgaacacagccggcgatgctgaaattattatcatcctctccccctcttcccctcctggcccttaggacccccatcgcagggggctgaggcaccccccgcgaggcggggactgagagccagtccctcttacccccctggctcttaggacacccatcgcaggggggggaggcaccccccgcgagggggggactgagagccagcccctcttcccccccggcccttgggacccccatagcgggggggggaggcacacccctcgaggcggggactgagagtcagcccctctacccccccggctcttgggaaccccatcgaagtgtggggaggcaccgcccgcgaggcggggactgagagccagccactcttccccaccggctcttgggatccccaccgcagggggggtaggcaccccccgcgaggcagggactgagagacagcccctcttccccccctggctcttaggacccccatcgcagtgggggaggcaccccccgtgaggtggggattgagagccagcccctcttcccccctggctcttggaacccccatcgcagaggggggaggcaccccccgcgaggcggggactgagagccagcccctcttccccccctggctattacccccatcgtggatcctaagacccttaggacccaagtggaggactgtgggtattaggtgtccaagaagaaagctcagatctaccgatggcaggtaccttacttgggatttactgtccgacaggggtccgaatgcagcccgggatcacaaagaaagcaggtcgtttgcaatctaccagagcctaagggcagaaggcaggtgagagaattcttaggagctgtggggttatgaagacagtggatcccaaactttccagttattagccaagcctttgtatgaggtcacaaagggggcggggaccgggaagctttggaatggggatcccaacaacagcaaggttttcatgagttaaaggaaaaacttctggcagccccagccctggggctacccgatctgacaaaaccttttccattgtatgtgtcagagagagaaaagatggcagctggacttttaacccaaactgtggggccctggctgaggccggaggcctacgtctctaaacaactagacagggtttttaaaggatggcccccctgtttgagggccttggcagcatctaccctgctagtactagaagcaaataagctgactcttgggcaaaacctgaacataaaggccacccatgctgtggtgactgagagccagcccctcttccccccctggctcttaggatccgcggtggactcacagcctgtttaccatattgtgagtaatatcatctccccctctggagattatgaactgtttcacagacgggtgtacaaccttggtgtacagagggtgtacacccgtctgtattgggagtaatatcatcctcttcctccctgaatattaagaacagtatcacaggggtgtttctactccctgcgatatcgcgtgtcgcatcctcctctcccacgttgcaatgagaaacaatatcagtggggccgtgtccaccttctgtcatattgaaagtgatatcattttcttccctccaggatcgtgggaacaatatcccatgggggtgtaccctttctgccatatatgtagtcacatcacccactccgccttggaatattattaaggaccatctaacacgagggtgtatacgtcctgtgatattgggagtaatatcaacttctcggcctctgaatatgaggaagaatatcacagggtgggtgtatacctcgtgctctattatgcggagtcgtatctgtctattatggggagtaatatcattctctccctttcaggatattaataacaatttcacaggctgggtgaacacagccggcgatgctgaaattattatcatcctctccccctcttcccctcctggctctcagtccccgcctcacgggttatgtagcgggttatggcaagaagacaaactgcagtttcctgcacagaacagcacaaacaatgatccaagctcagttacaacacaatattggtcatcatttgaccatggacttcaatatcaacccttagaaaccttcctaaaacaggtcagcaaaacaccaagaagcaatatcctgaatgataggaaaatatccttgcttgtgcaaattgtttccacttaatttttttcaacaaatgttaattatatttttactttctaaaaatttttaataaaatatagcctacttggttaaaaatggtgtcaaagcttttctaaaagttaaggcattacataattcagtggcccctgtggctgccatggataattcttttttttctgttcatcttcaaagaagggaattcagaatcaggaaaagatctttggaaattcattagcatatggttttactccgaaactaag

SEQ ID NO: 1784 - DNA, 222586 bp, Homo sapiens
  STARD13 gene - 32575307 - 32757892 of chr13; NCBI Entrez Gene ID: 90627; Build 35; sequence includes 20,000 bases upstream of initiation codon and 20,000 bases downstream of termination codon of the gene
tataggatctacctccaagatgcagatggagagaatgtgtgccaacttttaaactggatcataaggctccccaaataccttactgcttacttgccaaatggatggcaaggcctgcctgcaggtttccatagaaccctgtgctttaatatgtcttaagacttacagagggtattataattgctgttatttcttgtctactccatgcagggagagtctatgccctttgtttctttatgctcagtatttagtatagttcatagcacatagtaggtacttgctaataataaacaaatcttgattcagaaggtatatgcttattctgtataaagtgtcctgctagttaccgtggaggacacggagatgtaaaagatatgaggctctacctaatccaagatttatctccagccttatatggaacacttctgcttaactcattctggatctttatctgtcagttcttcgtgtgcttagtgacggcagtaaagtaagtgctcattaaatgtatggtgaaggaatgaagaaatgtacctacctggcagtcttgattaatttgacatcaaaagcttgggactgctgtggctcatgcctataatcccagtactttgggaggctggggcaagaagatcacttgaagccaggtgttcaagactagcctgggcaacataatgagacctcatctctacaacaacaacaaaagcttggggctaatatctctcactgtatgaatgaaatcctccaacctctcacaggctgtttcctcagccagttgtgttcaacactcttaatatttaactgcagcatagatccctgaagcaggtactaacattatggattttgttcaccattgcattctcagcctcaaacccatggtagatgatcagtaaatctttgtcagatgaatgaagttgttaatgtttcctttttagcctatatagaggagatgctaaaagtaaacaaataactatgatggaaaataaagagttaaagagaagtaaaacaaagtgttttagggggttcacttgtgggcaaggcaatgtctcgtgggggtacaatatacttgtaaataaaatgtatcaatttttatattatttagggtagatcttagaatgtcagaaggtgtggctatcagggaggacattaacttatatatttttaaaactcatgcattaaagttacagaattctttgattcagagatgtggagtttaaaaattacatagaattcttatctgtatgtccacggggaaaatccagtattttaaggggtttttattacatggaatgttgacagatgtttcttttcaagatttagaagtgaagggcttcaaaatttaattatatgaaattaatgtaaagcactaaaacacattcctacaagagtttaaagtgttttggtatctgaaaatagaccctatgtcttttcagaactaaaagccctctaaatgaataaaatctttaagaaaaataattttacttttaacaataattatatttaatatatgatgtaaataaaatagaaaccatcaaagcaattcctaaaacatttgctaaccatgtagacatctatggctcagtaacaagatctaaaacctcagaagtaagggccttcggcctgtggtgtgtctgcagtgagtggatttcacaacgtgggaaagtccacacagttttcttccttgttgatgaaaaaatgagctacattagaaaattgtctttcattgtgccaagtcatctgcaaatcttgttaaaatgtaggctctgattgagtaggtctagggtggggcctgagattctgcatttccaagaagctcctggtgatgtcacactgctggttcttgacctcaccttgagtaatatagaatttgaagtctcctaagagtcctgctgccccagggtcctaggtgaggtttccagggttctagtatgaagaccttgtcatcagacatcaactgggatgatggttcaactacagaaggtgtctataagaccttctcactgagtgtgcacagtgcttttcattcctttaccacttcagcttgaaggaataatctccctgattgtctttgacatacagcctactcccttcatctccctctgtttaagtgccagaatatagtggtacttaaattccagtatataacagaatataccttgtgtgacttcaggctctttgaggaacctggtcagtacttgttacatcatctgtcaatcaaaacttctgataatttactgagccctaccatatgtcagaggctctctgtataatgcaaggtatgtgtcactatcatttattttgcagatgaggacactgaagctaagatagataaagtgaagtctagggtcacccagccatgaagaggagccaggttttgaatcatagtctcactggtgtccaagctttggtctttctgatataccacactgcctctctgagggagacactaggctggatcaagagaaaggttcaaagatgtgcgtgggatattgtgggtttcaagaagtttatcatataagagcaataagagatgacaaaaaagcaacacagagtgaaaggcccaatgactatgccagaaataagtttcatgggaatgaggaggaaggagtaggtggcgtacacatgaggggcctgggaaggtatcctagagaagggggcctctgagtcaggtcttgaaaaatgagtgggaattgaaggagtgagaagagagcctcacaggctgtgagagcaggggtggactctccttccaaacatgaatgatttcaaaggtttttaaggtgacaacaagaaaggctaccatgatgggcctttaatgccagactgaagaatctggacattgtccttttaccagtgggggaagctcttgatattttaaaatagtatcagaatgatattgtagaaggaacaatatatcagaactatactttaggagattaatctgagagctatatatgcaaacaactagagcaggaagacaggaggttagtttcctcatctgtaaattgaagaaaaaacagtaactacctcataggtttgtttgtagaattagatgagataaagccaggcacagcaactcatgcccgtaattccaacattttgggaggccgaggtgggaggattgcttgagtgtaggagttcaagaccagagtgggcaacatggccaaaaatacaaacattagctaggtatggtgggggtggcacacgcctgtggtcccagctacttgggaggctgaagtgggaagatcacctgggcccagggaggtcaaggcttcagtgagccatgatcacgccactgcactccattctgggcaacagagtgagaccttgtctcaaaaaacagaaaaattaaattaaatgtaaaaatttgaaagaaaagaattaggtgagatatatgtatgtaaagcccttagaatagtgcctgacacatacatgttcaaaaatgtgagctatcattacttcagcattctagtcatgatggtgaatgagcccaaattctgtatttatttacatttaacaaatattattgtcagttcttcattttagagtctcttagtacagttccaggccatggaagttactcagcatcaggtagtgttgctgttatcatcattatttccctcttgcactcttcctccaggtaggtatgaatttgtttcatctcttctctgactttaattattatcaggggtacaatgactttcctttgccttaatgttgcctcattgcttgtatcagtccttcctcctttaattctactccaattatccatgagaagcctttctgaacatgcttcctgcctgcaggcacaagtatatgaaggaagggctataattctgagaaaaatttaagaagaaatgggcaagtccagtctttctaaaaaaagaaactcaaggtggaggccgggcgcggtggctcacacctgtaatcccagcacattgggaggctgaggcgggtggatcacgaggttaggagatcgagaccatcctggctaacacggtgaaaccctgtctctaccaaaaatacaaaaatattagccaggcatggtggcgggtgccggtagtcccagctactcaggaggctgaggcaggagaatggcatgaacctgggaggctgagcttgcagtgagccaagatcacgccacggtactccagcctggtcaacagagcgagactccgtctcaaaaaaaaaaaaaaaaagaaaaaaaaagaaaaagaaactcaaggtggaaatttcctgcagaagaacttgattggttatggcatttggtgtataccagcagctttgagtcttcatacgttagccccctctatacacaaagacttaacataatgaagtaaaaggcatattagacatcattaattaggacagaaagtcatatccagaagaagagagagaagacaggaggcagcatggaggaagaggaataaagtaaccatcagggcactggtcctcatgctccatctgtgctgagtaatcagatgcccttgtgcaattcacacatgccaagtgaaaataccatccttcctacctgtctttcacccagcatttcattctatcaaagtttattgtccattcctatgtaccaggcactggactaaatgctgtgatacaataatgagcagaaagacacatggtccctaccttcatggattgtacaagctaggggaatagacagatattaatcaaataatcatgtccccaaaatatcacaatgcaagtatgacagagactacaatggagatgtacagggtgctgcttaggaagatggaaagcatcctttaggaaatgagcgttgagcagtgttcattatgccactgcagggatggttagcattttagctcagtacgagggaagcgcatgttcaaagcctctggaagggaaatgccagtgtccctagaatacagagaccaagaaggaggctgtgaatttgaggctgcaagaggaagtaggagcaaaaccgattagggacctgcgggcccttttaaaaggttgatttaaatggtaatttccataatcaataaaatgaagggcttatatttataacttttaaatcttgaaaactatactaaacaaatagaaggcaaatttcattatcatcatgagtattgtctttctgagttatactaagagaattttaccaagtaacatagcatagctttaaaataagcatttcacgtaaagtaagcatttatttcactcaaggaatcaatgaacaaggttggactgatcctgcagtcataaaatactctccagagaaaagtctaggcatccacccttttaattcatacgaagttggcgatttcacagactcataaactcttagtttggaagggaccttccctgctaacctatgacatttctgattcagttgaccacataaaattgaaaacatctagctatggaaggaggcctattctatctctatactttgaacttgcttcaaagttctcacccatatttttggtcaaaacctgcaggatgaagtgatgggaaggagagcactaatattacgatatctcagtgcttcatatacataagctaatttaacccttacaagagctttatgaggcttaacttcaattttatagatgaggaaactgagatgcagaaaaatgaactaatttgatttgtccaagcttatgtagttaataaataaataacagagcctgactttggttaaaagttaactcgactccaaagccacatttctaggtgttcttgaaatcatactttagagccatttaaaaaatattttgagtgttccagcatcctttgaagatctgatgaaatctaaaagcctcatgttctagaaaagtgaatatacacccaacatattgcatgcagttgtagagttccagtggcccatccatcacaggttaataactttcaagttactgtgttcattggttaaatcttaagctttattacgacagagatgatgtctgttttatgcattgatgcattccaagcaccaagaactttgcctggcacagagtaggcattcatgaaatcattgttaaatgaaagtgattccaagtgcctgggcccattcacctacctccttagaacacgatggtaaaaggacagtgcagatggagtgtctctgtacggaattcaacaaaaccacaggataacttctcaaatctgagcacacaggacctcaagggacctcccaggcccaggtttgagaaattatgggccaaattttgttttgttgtgtttcattatgtttggcttttttactttaaagtcacttcctcttcatcctgagaaaagaataatgtctttaatagttccttttaaaatttgaatttgaggtgcattagtggaaatagcacttctgagtaatttcttaggaagtgtttggataaaaagtgtttagactgctttatgcaaatggttcccagtgtcaccattgtgttatttaaatagattttgctcattgttgtgaggctagagctttaatatgcctaagtgtatagtcatgcattgcttaatgatggggacatgttctgagaaattcatcattcggtgattttgttgttgtgtgaacattatagaatgtactcacacaaatcctacaacacacctaggctatgtggggtggcctattgctcctaggctacaaacctgcacagcatgttactgtactgaattctgcaggcaattgtaacacaatggtaagcatttatgtatctaaacatatctaagcatagaaaaagtacggtaaacgtatgctattataatcttatgggaccactgtcattaagcaaaacgttatgtggtgtaagactgtatttttaaagctgaagtaaatatcagctcttcagaaaatattgtaaggctattctatggaatttatctcaggttttaaaaccagggatagctataaagagagtttcctacgtctggagattggatctgtgcagtggacagctcttgccatgcccattcaatctttctccaaaaagctacatgcaagaaaggacacaaaatccttcattcaactagtttgcttttgcttggcttagattgtgatctagttgactcaaataatagaaaaggaattgataatcatatagacttggtctgtttatatacattcatatgagatgcgtgtgtgtatgtgtgcatatatacatgtatatgcacatatacttataaacctttttttttaagatatggaaagagagcccctaagaagctaaatgacttacatagtaagccgtaaaggtggtgcgtggtttggtgttttgtggcaggagggtggtatgactgcagtggtctcctgagaagctgaacgttctgtggcattaagtgtagatggggattgggcacagtggctcacgcctgtaatcccagcactttgggaggccgaggtgggtggatcatttgaggtcaggagttctagactggaccaacatggtgaaaccctgtctctactaaaaatacaaaaaaaaaaaaaaaattagctgagcatggtggcatatgcctgtagtcccagctacttgggaggctaaggcaggagaattgcttgaacctgggaggcagaggttgcagtgagctgagatggcgccactgcactccagcctgggtgacagagtgagactctatctcaaaaaaaaaaaaaaaaaaaaaaaaaactgtagatgggatggggccagactagacatagagacacaagtaaaactgtcagggtgctccaggcaggagggcaggtccctgtgtacaggacacatcatgtaataaggaatggatttgagaggcattttgaaagaggaatcagtaaactttttttgttttctctttcttagatgaaattattttgaacactggagttttgcataactgtatgagacactgggaagttcaagccatgtaagaccgtatctgtcattgttgtgcagatttttcttgtctgtctgtcttatatctgcaatacacagaggcaactggaaataaactaagactgaggttccttctccatacccgtatcatatatcattggttaggcttcatcccctagtcatacaatagaatattttaaaaatggagatttaagaattatcacccatcatttcaccatcctaaaaatggtcatgattatctttttggtgcagtttcttctaaacttttctttagcatgcttttttttttttaattttcaaaacattataatcatagtctataccacacaattttggtcttacattttttcacatacagcaatgcactggctgattaacagagtgctgggactggattttccaaagcaagccatattaataaacaagccaaggccaaggacagcccttgagattcccaaagtcagggaatgaaagagagggttttaaggtcattgaagattgtgaggagcttttgttacaaaagatagcaagttctatctttctgtgcagcaatacatttttggtgctcagtaaatattctcttgtgattgattagtgttgagtcattttggcggagccactaaggagaaggtaaccatggctggctatctgtgttataccagatctgtttaaacaggtctgaactataagacacagtgtgattatggtggtgctctgggagactggccagaggccactgcgtgctgtgataagcatcacgctgtaaagataaatggttaaaaaatctcaggagtctctgtatcttcatgcatacacacatattctctaatgggaaagaactcctccagaaagtctgtacaaaacaggcacaaaaataaatgaacctggaggacattatgctaagtgcaatcagccagacagagaaagaccaatgacgcatgatctcatttacatgtggaattttaaaaagttgaactcggccgggcgcagtggctcatgcctataatcccagcactttgggaggctgaggcaggcagatcacctgaggtcaggagttcaagaccagcctggccaacatggtgaaaccctgtctctactaaaaatacaaaaattagctgggcgtggtggggggcccctgtaatcccagctacttgggaggctgaggcaggagaattgcttgaatctgggaggcggaggttgcagtgagctgagattataccattgcactccagcctggatgacaagagcaaaactccatctcaaaaaaaagttgaactcacagaagcagagagtagaatggtggttgccaggggctgggcccagggataggggatgcggaatgggggagatgctaagttctggggatttaatgtacaggatggtgactataattaataagactctattgaatacttaatgagggagtagatctcaactgtcaccacacacacacacacacacgtgtcactatgtgaggtgttgtatcatgatgatttttaaattttaaaatatttaattgactgataaagattgtatatcttcaaggtatgcaagatgatttgagatagagatacattgcgtgatgatgtctgcagtggaattaacacacgcatcaccattcatgctgtccctgagatcccctatgtcatggtgattttttttttttttgagatgaagtcttgctctgtcacccaggctggagtgcagtggcaccatctcagctcactgcaaactctgtctcctgggttcaagcgattcttgtgcctcaacctcgtgagcagctgggattacagtaacgagccaccatgcccaactaactttttctttttttttttttaagtagagacgaggtttcgccatgttggccaggctggtcttgaactcctgacctacctgacctcaggtgatccacccaccttgacatcccaaactgctgggattataagcgtgaaccactgtgcctggcctgtcatggtgatttgaatactaatctgtcttattaattgaaggaggggtatcacataggaaagtatttatgcagtttttttctcttcatgggcatcttttcccccatatagtcttcctagccttctcgcccaggtatgcatccctctaggcacctgcaacacctttctgccatgcagaatacctctattctgttctgacttagtcgtctctcctctgccccccccgggcaccctctgcacacctctgtcatagcaccagcaacgcagtcctataattgtaactgtcctcctcttttgtcatgataaattattgttgagaagagagacagtgtcttattcttctctgtaccatcacagtctagccctgtgcctggcatgaagaatacattagaaatatctgaataaaaaagggtaaaggaaatggtaaggtgagttagggactttgtctctgttgatgacaaacgagacgtcagaaaaaaatctttttattacaccaggatcacttttggttaaattatttctcttaactcaaaagaggagcctccccttgctgccctgctattaccctaaaatgtgtcttccagtcacttcagagctacatgacacctaaatctagacctctagagggatattttgctactctctcaaatttgtagtgctcttctctttacaggatttttaaaatgttgctactcttctctgcaccactttcaagtacagattggtggtcttatattaggaatatggaaggaaagcattctatcatatttttcatattttttggtatactgggctggatttatccaacaaggcatatctaagaaatgcaattgcattattcctcccgcgcctttattcctccacagtcgtgggccatactcaattcccaactgctgcttgacaccatgaagaaagggattgtatataagaatggagacagaatccagggcaacaggtcagcagacaatcgtaataatggtgtgcctctcactgggtaatcccaaatatttacaaaacagatgatcagaagattttccaaaggattcatcataggatttcttcaatgagcaagtgttcatttcatattcaaattataatttgagtcaacattaagaaaatatattcactgttgttcaagatgggaggaggttatagaatcctacctgaagtaaatgaaggtaatcctctaagtgcagacaaattctacctaaaagactaaaaattcccctctagtaatctaagcaattcattgaaaataaaaataagcaattgcttttattttcattgaggacaaaaataagtaggttctagaaaataccagatagtaaatttgttaaaatctccagtaaaattattgaatgaactattaaagagataagtatgagcatgaagaaacagagatggttgataacccagatgcagtttgagtccacgaagagcaaatgaagctacatgaacacagtctcccactttggtaaggtagcaagactggcccatcagaggaaggtcatagacacagttagtgggtgatcaactcagaagattctgccatcatatccctttggaaaaaatataagctagaaaagaaggcagcttggagcactgcatctggttggatagctgttcccacaaaatacagaccagtggactgaagtccctcagaagaggtatctgtagggtcagctgaatgtagctggctcagtgccgctgtactgtttagttaaaggcacggcaagcatgcctatacaatttgtaactgatacaaagataaggtagatattactaaaattttcttatgccctttatcccctctttgtggagcaagaggtttgctcatccctccaggctccctaattttcacaagggaccttaaactgtcctgtttgatggtcaaagcatatacttttgtcactagccaacaaagtgaaatacatgtctttgcattagtcagggttctctagagggaaagaattaataggatagatagatataaagggaaatttattaagtattgacccactcaatcacagcatcccacaattggctgtctgcaagctgaggagcaaggagagccagtctgaagcccaaaactgaagaacttagagtccaatgtttgagggcaggaaacatccagcacaggagaaagatgtaggctgggaggctaggccagtctcgccttttcctttcacgtttttctgcctgctttatattctagctgtgctggcagctgattagatggtgcacacccagattaagggtgggtctgccttcccagcccactaaatcaaacgttaatctcctttggcaacatccttgcagacacacccaggatcaatattttgtatccttaaatccagtcaagttgacactcagtattaaccatcacagtatttaaggctcttcccagagaataaaacctagaattatctgctgtccaatccttgttcaatccaagttgtatcatcagcaacaagaataatacctataatgattgcctaaaaaaatatgcatctattcctctagacatcctaaattttatctttggggaaattcatataatcatttattcaattatttattcaatcaatttgttcaaccaatcgctactgatgtcctcccactctgtgccaggacttacaataggcatcaagtatagaatgtgaatgaaatagacacagaccacccaaagcagtctactgggaaaaattagcaacacacaggtccatgagcgaatacatatgtaattataaattgggagaggggctataggaaccaataaggggatactgccttcacttagaggaagtcagcagggatggcttgcctgaggatgcatcagttaagctgatacttggaggctgagaaagagccagccataggaaggctccatgcaacactgcagctgaggagtagcacgtgcagaaaggcaactgaggcagcaacgtggaggaggctaacggggagctggagttgataggggaggggttggcagggactagattgtgcaggacctggtggttcaagtaaggagtttcactttcattctcggtgcaatggaaaactctagaatattttaagctggaaagtgctgacatggtctgagacatggtttaaaagatcacagacaatagtgtacttgaaccacggttttcgaagaccctcacagaaattactttccctaaataatttgtgaaggatacagttaagaaactgtgaactaaattttgctactttccctaaataatttgtgaaggatacagttaagaaactgtgaactaaattttgctaccatatccaatatttttgagggtggtgatttttttttttttgaaatggggtcttgctctgttgcccaggctagaatgcagtggcacactcatggcttactggagccttgacctcccaggctcaagtcatgctcctacctcagccttccaattagatgggactacaggccctcacaaccatgcctggctaagttttgtaatttttttttttttttgtagagatgggtttttgccatgttgcccaggctggtttcaaactcctgagctcaagtgatgcacccaaagtgttgggattacaggcctgctgattctttatgagggcctgggaaaatcttccctggggtcagcatacctggtgatctgtatttatcttgaccactgttttgtttttcatcttacggatatgttgaattttgtaactgggtttttgctttgtcagagaggcatcttaagccacattctcacccacttccagcaaatgtgcaggacttcatggcttgcatatctgtgaatggattttacccctagctttattattttcctgcccttactttacctttcccccaaattcagttagttgtttattttttacttttataatattggggtaggggttgttagctactagaaataacaaggcagaaataaatagctggaggagaaagtcaggaattgaacaaaactcaactactgcaataagattaaagacctcttcttaagttcaaaagatcttttggtaagtaaagaatagagaacagtcacataacagcagattttatgaaaataacaaagatagcatccagctatttatgcacttagatatatatgatctaatatatgtgcttatatatgatctaaaacatttagatcatatataacaaatagcacgagacaacagatagcctctagcctcccacacttcacttaacgtggggtatagtggtaaatttcttttctgtcttccctggcagacagtcccttgagaacaggggccacatcatactcacctttgtatctactatacttactgccctgtttttcaggcatcccatgttaaatttatgaatgagtgaatatagattataaaaaataaagcctcccataatctcagactgcatcagcaaaagtacaatgccctgaatgcaggaaatatgcacacagtgtaccatgtactactgtgcttggccaagtctagagctctaagcttagagtagatacccacatatttttaaagggatactgacagactggagcagatccaaaagagagcagtcagctggatgaatggctaaagtcatgtggttcgatggaaaaaaacgtgagactacacaaaaacattcttacaagggcttttgacaaacatctgaaggacagcttgtggaagaaagcatagatttgtcctgcctgattcaaaatggcagaatcagagctagtggatggaaattaaaaagaagaacattcttcaatagcttggggtcctctgtgggataatacactctgtatatgcaggtagagaattaactactgcagtagttgagtggttggattagaaaatgtttaatattccttctaaattcaagatgtcaaaactttatgcctgtagtagttgcagtaacaaacagattccatatgaacatgtaacaagccaatctaattaatgtgccacataacagtggtttacaggtattaatatgactggtaagaccaaagagctttgtattagtcatgaaagtgtttctggaggcaataggttttaactgagtctcatgggtggaagagaagggaatcacacaattctagatctgtgaaacaactgagaaaatgaaagaattctggtttggctggagtgcgtgggtgtagtaatggtcccaggacaggacagaccaggttactgtcatatgggctggagctgatggttgcatccccagggaatggcatacgggagagcacatgctcctggaggcccatagatgggaatgcaccagacagtagggagggctgagagacaaagtaaaggaaatctattaccacttacaagtgtttgcggcaggatctggactccagatgagagctgtggtctggagctaggaaagctgatctggaccaagctctttcatggagtcctggtcaaagctgccagtgttagtgtcaccagcttgtctgcactgggcatgggacatggggtgcatgcagattgggaaagttaattggcacagagttgggcacacacatcacaaatcaatcggtgaaaatcctcaaatgctggccttcagagcccacaggaaggctttgacatcaacccacaatctttgggttcatgtaatttcgaaagcagccttccaaatcagctctgcatttttctgcctgccacttgtatctcaaacattttcccagttggcagaactaccttggctccctctgaacagactgatgaggaggctggaatgtgtgtgaaggagtagaaagggcagcagacagtgagccattcctggcttctgtaaaagcactccttagcgttctgccctgtgtatacaagattccattgagcgctaatctgggatcatctatcaaaatacttgaaaattccaaataccaaaagttttgcttagaggtcaaatttcagagttttgactgtatttggagtgtttgcattgacagtgaatgctatgagaaactcaaggcatacgcagcattagccttgaggacggacagaatgcagagaataaactaccctggaaaggattggcaaagagggtcaagctgagctgcttattcatttgagggttgggggggtggggagagtctctagtcctcacctatgggttactcctaagagggcttgtggcttctattgattgactaagggctctgggatctgtacttcttacttgaagacaccaactctcaatcaccacgggattttagccgccccatacccatatttccatgtaggcattccagtatcgcaggcagttaaataggattaggatgattttcaggctcttcttccaaaatgctctcccctttccaatttccggagtgccttttcggtgccgtgtttttccttccctgtctctcctgtgtaatagtgaaaagagtgaaaatagcatcagcttggagatgcacaaaggctctgcacttgcttgctttgtgacttctgtgaatcttagcctcctttccatccaatcagatacctccagtgatagctgtggagattaatgttaaaaaacctaaaatgtgaagccatgaaggcttcagacctggcacatagtaggtgctcaatgctgttcccttctctcctctttcctttcccttctcttttgctgtctttggttctcagtaaccatctgtttatctcactcctgaaatagtcttactgaagatcacaattgatgagcagattaggagggaagaaaagtaggtgaaaactgaacacaagtgccatctgttttcctcatttttaaaggaattagagaggaagagatatggtgtcagtcctggaagatgcttgtgatttgggcactctctccctctttgattccataggacttcatgcactcactggagaagaggaccagctctctcagttgcctgtaaaggaaaagccagagagagaactagccacttcttgattctaatacaacagacctgtctaccccagtggtaattcttctaacacggggactatatgatcacaaaaaagaatttatttaaaaaatacaagtttcatagcaatggcaatactttagcataaaacaaggtactaatgacatgctaatgagaaaataatgttacatatttgctttaaatatagtaccttggaaatacaaaatgacaaaaacatggtgagcaggtacatgaatttatagatactacttgaactatgaaataaaactttagcggccctgtatatgcatacagaaaaccaaatgttgatatgtgatccttcctagagccccttattaaaatgctggctgattttttgaaaaaatgaggcttcattctaagttggctttttttttttaattagggaataaaaattccctttttttaaaaaaaaaaatgtagggccaagtgtgattggtcacgcctgtaatcctaccactttgggaagctgaggcaggagaaatgctggaagccaggagtttgccatcagcttaggaagcaaagagagacccccatctctacaacttttttttttttaattggccaggtgtgatggtgtgcacctggagtctcagctacttgggaggctgaggcaagagaatcacttgagcccaggagttggagactacagtgaactatgattgcgccactgcaatccagcctgggagacagagtgaggcaccatcttaaaaataaataaataaattcaattcttgctctttattgctaagattattttaatgaaatattatatgtagtcataaatacaaacttatgatcttaatgttttcagaaccagacaccccagcactttcaacacattcatgactatgcaaaaaggagacaatgtaagttttattgtcgttgttattgttttatctagtaacctcgccttgacacactgcaatccttctcaggaagaatcattccacttgttttcataatagaatgcagccaagtcagcaatgaactgcaaggttggcattggaaatggccggtctatctttaagtgctctccaaagctataaaaagctacgtattttttcctcacctttacctttttaccttttcctcacctttacttggtttcccagaacatgttcaatgttctcaagtcccatgctcccctcttctttctctctccaccctccttccattctcttccagtaaaaaagtgataaccaccaagtgtctgccttgaacaaaaagttatgacacagatgctcccagtgttggaccatcaagccgaaagcacgtgcacaaagcagctgatgcaagcaccttaattggacggccaccggtgcggactgagctgggctcatgaaccttccaggcagccaactttgcaatatggtgctcgacctttctccattcgagcttctgccgagcagttccttaggtctcagatccctttcaccttccacagacgatgctatggaacagaaaaactgctgctcaaatcctaaataagaatggaaagtgcacagtatggccccatagatctttctttcccttcctgccatgaagccaacctgaaaacaaagacatgatgactcttgtgtaaccacccgaagaggctgacaattaccaactacgtgaggtagtaggcaattgtcacatgctgggctgcagagatcgtgcttaacttgtttattctcatagcgggacagttatacaagacgagctgcttctcagaatcaggctagcaacaattccctcagggaaagttgttaaggcttatgggcctcggagagccagagtaagaagaatcaaagtcctaatttaaatcctgttaaacttttaatttggaaataatgtagaaataatttctcattattagactataaattcccagccaggctatgtttccgtcagccaaatgtagaagcaacttggtcatatactttttgtatcaaagaactttattctttcagccccaggctcagaatttgataacatgttttctgtggactttttctcttcacatcaaacaatgttaaagaagaaaaacagggaaaattataatgacatatacatatatgtcactcagtgtgtgtatgtatatatatacacacatatatacacatatatatacacacatatatatatacacgtatatatatacacacacactcagatatggccaaactgaattactagcagtttgcttaaaccatatactctggttctggatctgcacacatgggtacctacagtctcttgcaaagccctccccagcctctgcctatcagaattccccccattttaaaaagcctatccaaatgtctctttctctatctggcttgcaatcatcaccccagtcaaaaataatattgctcacctagcattgtgtttgcgtcctttttgagacatatatatggcctcatgttagaagcttttgtataacttctcaatgggtccttagcaggttgatgacagtatctttgaagtacctttgcaacttctgcagtgattcttgtcttaaatgattcagtgtcttaaatgtgataggcaccttctaagtattttacctctaggtgattaaaaattggggaagtagagaaatcaaagaggaaaggatgcttaatacgtaacgcgtgtgtactttgcctctctgagtcttatctgtaagagccctccaattcccatcacgtgagggtcaggatctgtggtgtattcactcctggtgttaaagcccttgaagtttatttttcactggaaaagtttttatttgagttgtttcttgataatgaaggtggtggcttacgctcagctgttgatgcttgtttgaagtagtttttttttgttgtgttgtgttttttaaatttaagagatttatcaggtccatcttttacctggctgctgctgccctgtagaaagcgaaggagctttctctaactttgacaggctgaaaagtttcctgagccctggacttgtttgtcttctacttgttttgcccttccctctctctttttctttcgactcctttagtgagggctgcttttgggtgcttcgtcagctctgaggcacgtcaaatacgtgtattttgctttcagcgttgtgtgagggaccctggcggctggaactgcctctggtcggggcttagggctgactgcaaacgttcccattttcctctcttcctctcattggttcccgaggtcacgtgagggccccgggggttggaattctgagttgtggctttggcactcctctttctttttaaaaatcgctgggtctgttgagctgtcctgggctgggtgccttgctctttgactgagactggagacagacggcaacagccacaggcagactgaggtggcaataggaaatctgccgagatgttcagtcaggtgcccaggaccccagcctcaggctgctactacctaaattccatgacacctgagggccaggagatgtacttgcgatttgatcagactacaagacgctctccttacaggatgagccggattctagcacgccatcagctagtgactaaaattcaacaaggtgagtggccggcagtggaaggctgttgctcattctgatttctgttggctctatttcatgctaacccagttttttttgtttgtttgtttccactttataacatatggatttctatgccacactacccgtaactttgaaaaataactttaggctgcagttttcagcaaacaggacagtccttagctgccacatagctcaacataaagtgcacaaaaaacttcacggtgggacagtgaatcataaattcccaaactgacgtgtgtctacagaacagatgagaactgttactcagtgtgtatcttaggagcttttctgcagtttcctcacactccgtcacatttaaaatgtggacacttgtttatttcattagggaggaggcgagggactaatgtccaccctgcccagagtatttcgaatatccttagtgaagaggaggaaagcaagaattctgttctaaaggccaccaggctaagcactagaatcgcattctcttcctgtttgtatgtttatgtcagcagttgccacagatgtgttaatattgttttcctggtagagaattaaggtgttcgttcatctcaaaacaaatcccgtaacctgcacacaaaactccagcttcctaatgcaaagagaagagaatattgattataagctgcttgatattctttttattcccagcccctcaaaataccagcctggaagtctggacattactaaaatttaccagtctcaaaaaaaaaaaaaatttaaaacatgctccttatagggtatatcagtagaaagcagaaagacgaacattcctaagaagcccctaacacacacgtttacagtcagttaatgatcaccctcctcctagactacaaaaaagaaattattatattggtgctaaataagttaaccaggaatttttagagccgttcctaagaagcccctaacacacgttgacagtcagttaatgatcaccctcctcctacacaacaaaaaaagaaattattatattggtgctaaataagttaaccaggaatttttagagccattataaaaatacagtttccacttaaataaatgagtttaagattatattgaatattaaagaggaagttggggtttgtaatcatgaaaatcttattgtaatgtttccagaaagaacaatatgtattctagcgggcagcatttgatgagattgtttccttggaaattaggatttgtttgtaaaggttcaggaactagttatgtgtgaaggatgctggtccttcctacatgctggtctgatttcaggaaggatattatgtcattgcataaactctgtgtccaggtcttgattgaatagaaacaaaagtaattatttccctgtggctagatttaaaaatactttaggcttagaataaaaaccagctccactttggttttagaaatttctgacaatggtgcctttccaaatgccatcatctttatgaacaccgaggcttaatgatgcgctatcatctacaagatataaatgttcctcagcatgcatatcatatgagaaatattgcagagaactagctgaaattgctttgcagacctccttagatgtatttacaataatttattttatttaaatattatttatgttctttttggaatgagggttatttttccattcaagatttgaagttgtgaacacatgcactatcactgaacgtgccctgtcacacagacatatgggcaccctcagtttatgtttcatttttgtctaattaggtaatttgagaattccctcttttttatactgggcaatggagtgtttgaagtcaatgaatgcctaacacttaaaactgacagttaagatcacagggaagcaataaagatttccaacagtcttgtgattcagaaatcattatgtgttaacatcatacaactctttagtaagacaatgagaaagcaatgtgaaacaattttattgagtttattgtattagaagattggtttactgtaatttcagagaatgtggattaaacagttacagcataccaaaatcattgtagttaattttttttattatgcccattttacagatgagaaaacagaggcacacagatttcaagcatcttatccaaggtcacccagtaggaactgatacttgaatacagcttgacagtccatgctctgcaatacactagactattttttagtttttataatgagtgctaaagtactgaacctatgattgagtttcagattatataatatactagagactttttagacttttctactcaggatacagcaatacactatattataggaccagaattggtcactcattatgaaatttcctgtcaggttatatttctctagtggaaacaaagtgctacatgttttattctctttaaccagttactacccaataacacaggatgtcaagttattttactaaaagctttgttttctttttgtttttgagacagagtcttactctgtcgccgaggctggagtgcagtggtgtgatcatagttcactgtagcattgacctcctgggctcaagcgatccttccacctcagcctcctcagtagctgagacttacaggagtgtgccaccatgcctggctaatttttaaaacttttttatagagacagggtctcactatattgcgcaggctggtctcaaactcctgggctcaagtgatcttcctacctcagcctcacaaagtgcggggattacaaatgtgagccattgtgccctgtcactaacagcttttaatcattccattaatcatgtgcaaataaaattaatgacagcattattttctgtagtttacaggttagtatcttaaagtgacagccacatcactaaaattgtttgcattattctactttagagctttaagatttagaattatgttaatttgatttaagacatcattacttataatttctcatggttgttgggaacagtggaaacaagtaagttgctccccactgacctcattatagtgagataatcattgaatggcgtgcacatgattcaatagcagatacactcatggggaggaaaaacaaggaggagaaataaaggaatctttgatgatgcatagaatcagaattcattatccaaacccaggatgaatctaaacttgctcatcttagggtacacatcaaaacatacatgcatcatttctctagcctgttttttagttctggggttgcaattccatttcaaaagagaggagatgtttaaaagagggtgttgttttgcagagtgaaagtttatcataagtcatactgcccataatccctaccccacattcttgcttgaatcaatagggaaattgttgtagagagagagaatggaaataagaatggtccttatttgcctcactgactggcgcttgggagtggataggagagaggatgctgggggtggtggaagaccatgttaggccaaggaaagggagaattggatttttttctaattttttttattgtggtaaaatacacaatacattaattttgccatcttaaccatttttaaatgtatggttcagtggtacttaatacattcataattcataatatccaaccatcaccgccatccatctccagaactcttttcatcttgcaaaactgaaactccatacccattaaacaagaattcctcattcctcctcctctcggcctttggcaaccaccattcaactttctgtctctatgaatttgactactttaagtacctcatataagtgaaatcatacagtgattcactttgtgtgactggcttatttcactttgtacaatgtctttgaggttcatccatgttatagcacatggcaggattgccttcctttttaaggctggataatattccattgtatatctatactacatttcactttctgtttttttattagtagccatcttaatgggtgtaaggtgggagaattggatttctatgtcattatttgatggttttgatttattagttctacatcattatttggtggttttgatttagtgcaacatgatggatgcaccatgtttaaagtctacatacacacacacacacacacacacacacacacacacatatttggaaaacccaaatgtaagtagaaacataaatgtgattgcttgctttgtgaaagaacttatcacactattatactttttattttattttaaatgcttagaaaacagcataatccggattgcagtcaagtccactgaagtaggataaggagacaggcatccaggctctgtatagaagctccttcgctcctttacagcgttgagttccagagcttcactggacctttggtttttgatgagacaatgaagtggatggactatgattgctcaagtttattctgtgtctcaggttctggaatcctctctgtggttaagtcagcaactctttgaacaggattgtagaaagcaggggaacataaacgtaacatactagaacctaaaaaggcaacagagcggctttattatgtggaatatatcagtggcttacaattgttctacagtttctcaaggaaatggtaaagtggaagttaggtttttgttctacctcagcaactaatttattgtgtgatctgagagaagtcacagcttctctagacctttttcccttcttccattaaataaagggtttggattaaagaatctctgaagtccccatcatctctacattctaggattctgcaatcacaagtattaccttaagacaaaagcaatgcatatttacatttttcttattatgtcattcagcatatacctggacatgcttccttgaaacctgtgtcatgctttcattaatatcgatgtaataggaatgttaggaagtccagtctgttgaactatttaaatgtcagtataactataattatacagaaacttgtaaacacctttctttctccaaaatccaggcctgtaaagtggaattgtcttgatgcctgacctatagcaaggattgcagctactgaaggaagtccgtgtgtgtgcctcttacctcacaatacaacctctttcttttcttgatagaaaatgtggaatgtagaaagtttcactaccgagaaagtagtgaaagttaaactgtcatttgagttgccattctatctgaggctatttttaagtagatatggcacctgatttgaactcaactggagtgggatatactgccttttaaaaatttccccagagaatgccagtgggcatgagtgatgtattccccctcattactatgtcaaaaggcatcttgggaatttgcccaacctaagtggtgaacatggcccatccccatggcccatacccccagcaactgggtaatgtcagcctaaattaagcaatcatttgttcttttggaattgccctttctctatgtttagtactttcttgcccgactactttcaaacctggagggtgaatgcactggcagaaagacagatggaacacaggaagcaggctgagaatgcatcagtcatgtattgctcaagttctgtctgtttgtttttttttttaagagtggcaactgtcataaattcacatttcatgaatcagagcctctttctactcagtgctggtgtttggagggcctgtacagaaaggatactgtttaaccaaaattacaggaaaatctgctaagtgaattaaattaactaactttgactaacattttaaaaattactacatagtaaaactaaaagaagtcaagaaatgagtactgggaggaaattaacaaaaggacaatatgcttgtaaacatataaaacttgagagtttaactttaaccaaattgtaggttcaatagctacacatcattgctttataactcacacattggccagggtggccaatccattggagttgcctggagcagcacatgacacagtagcacagggtgtacagagatgggtatttgccttgtgccttcttctgtgccaatcgtccaggagttactctgttggcagaatgttgaaacttctgttgttcagatgcagacagttgccaaatttgggttctgtaactttagcttaagtaaataaaaattcattttttaaaatgtctttccctctcccaccttccccaatcatcagtgctttaattcttagcaaattttggacaatggtcaactcttacaatgcaaaattcctcatttcattagcaaattaatcatgaacacagaaacacaagttagaaaaaacagtcactgctagtggtcttaatagtatcaattgatgacctaaaacagatttaaaaagagaacaaatgataagtgggttttggcaaaactcttatataaagggacataaatagatggagatttagtggagacatgtcattaacaagagtacacactttctctgtgtttcattagctatgacaacagggtagtgaggcaatcaagaagacttaagaagataggagaacctgaacatgcattgcacaccagatatttgaatgatctaaagaccacataaaaaatatttgccgtctcccttggagcaattgaaatatgattttggtatggggaaagatactatatattaatttacattccacctcattacctagaggatttgaggtcatttatagaagaatatataactaaagattgcaaaaaagataaatctgatgaaaagagaaatgttggccaattaatgaggtaaaactaggaagatatatcacatggaaatataaaatgtaaggccttgaataataatcaaaaatgggctgcaaatttggcttgagcttccctgatctaagcaaagaggaaaacacaaccaagggaagattttccctgttcttaaggtaagaacttaccagccaagattttcctgggacttgctctttgggagaattttctcccaagaacttgacctatgagaggaatttctcatacaaatctcataaagggaacactgcaagctatagtgaatggtgccttcaaccatgcctgctgtgaattcagtagtgagtctcatttcttataacatcctgcagtggaaatgggggcgtcacaataaattatagtccagtagaaatatttgggtgtgggtgggtgggtaggtaaaaacgagaggtcaggtatgcagtcttcagattctctgtcttaacctagaaatagcatggagattatccacaggcaatttctataagtctgcttcacagaacactaggcccattagacagatattcaagggagaaaacatttctgtggttaagtcatttttggaaatgctacattccctttcccttggaaattcagacttatgaaaggctcaggaaaatcttgcacaaagtagtttaactgtgtttaaactggtatatttcatcttgaaaccacttttcacaggatactgggaagtcacatattgcaaaaccagctttccctggggaacacattttggaaatgctgatctaggagagtatgtggcctacgcttcccttagataattctctctgaatatacttcttgcatagatttggcagtagatactttgaagttgtgttttggagaggaacattgcaagtattctatgttttccaaaaaggccagccacaaatactttaaaagtcaactgagtaaaggccagatgaccatctttttatgaaaattaacaaccacacaaagattctatcttgggtaggcagaacagaaagctgagtcggtatatgggtagagttaataattataacatcaagaatacaaccattcctcaaataactctacaagataggtactgttgagccagaaggaagaaattattgccttctagctctggctttgtcttaccataatgtagttgaagtcctgggtgaggtccaaatggttctaacattaatgtagctaattcaggatattccattactgctgggaagtggagtcactgccccacaggaaagaagcaagaaactcttcagaagtcttagagtctcctttgccgtgggtgacatgggatatggactcactgaagctcaggcactgatgggtggctccgagaatttctgaattcatggtccaaaaatatctttggttatataaaggctctcctagtatgacagaaagaagtgaatgaagtaaaattatgtagataattctaattagtaaaatctgcttgctttagttatggagacaacttatcaatttccaggaagtctacaaatatattcttcagatgtttttcctcctgctggcaaagagatacacattagcattcacattatgaatgacgcttctggagagaaatcacacaacatccaaaaactccaacagaatgcatagggaattaccatactgcctagcccaagccgccacactgtgaagtcactcaagaccatggtggtcattctggactggtgcagtctagggaaggaccaagtaccatgaaaatttatatactactgtttgaaaagacatgaattctctctcttttttttttttcagaagcttaggatctaaaataatctaaatggagaacttggaaaataacttcaaaattacagaaaatgctaatgctgttagcaaaagaaaatcaatagaaatagatctacagtgtctggctagactgtcaaatgattttcctcacacagcataggaatcctgagaattttaaaggtctgacagaggcagagcttactaaaatacaaatgatttgtgttgctttgcctcctaacagttggataaaacacaagggcgaaacaatgcagagagattggaaaggaacttggcagtcaccaagtacctaatttacatgtcaggatttcgagctgaagtaggcattctcttcctgcattccaactctccccttcctgcttacttctgaaaatcatacatatggacagcaggaacctttgattagtattcaatctctatgagtgaacagtagcatttcatatacatttatattcaccaaacgacacactggatacaaaaagtatgtatagtcataaaatcacattttcctctgagagttataccaccctgaaattatgtataatatgtaaaattattataagaaataagaacgattcacaaatcctgcgttaatgatattccaacgattctcactcaaatagacggagttcttatttgagaaaattaaagaatcttctccagatgctttgagggacacaacacatttcccactacatgcatttctcaaaatagagtgtgaaatccatcgcaaggcccttactgtctggacttctgtaaacccatgcgttatgtttaacaggttcttaatcatcaaaccaccttcattttcaccattggtctctttcagataggaaagtctactgacctccttccctgaaaatttggatcctcatattagcattccattccacttgctgtacttttagttggaaggtctaaggcagacaaagctgcttaaatatttttatcactgacttcctagaagaaggaggaaaaaatcttggcaagaagaagggaaatcagtcttgcagaatatcttgaagaagcctgcgaaggaattccactgactgtgttcattatctattggtcccaatactgagtggaatttttatgtgttatcactggccagggtggccaatccattggagttgcctggagcagcacatgacatggtagcacggggtgtacagagatgggtatttaccttgtgccttcttctgtgccaatcttccaggagttactctgttggcagaatgttgaaacttctgttgttcttaggagcaaataattgaaacatgttggttgaatttcaagacaccttttcttctctttttcaaatagccctgtgattacagatagccttgattcctgtgggatcaagaatgtcttagggatgttgtccatcaacccaaactccaaacttactataactctaatttagagcactttcagggctttggagtcatgtacacgtgaatttgaactctagctctacatcatccccatagagtgaccttggacgagtcacttaatgtttcttagcttttgttcctctgtgggtaaaatggcattaaaagagcaacagtctcagagttattgcaaggattaaatgagagactataattaaacacagatcacagtgtctggcacatactaagtgctcaatttaagacaaaatgattattaaacatccatgtacatatgacccttcaaactgctgcatcatcaactgaagagtaaattatgtttgagtaagttatacactttgtatcatgtttattatggcagacatatataatgccacattttttgtgtgtgtcctcatgtcttccagaaaatttgaaacaaaagaggttttttttcttaaactgtaatgaaaaccattgccttttccaattgtggtttcctgtggacaccagttgctctctctcaagttgccctgaactggcctgaaatggtgggtttaggccaggcttcaggtcttatagataaatagtaaagcccgttgaactttaccttgtagcagtgaaagagacagtccttggcaggaagtgttcctagctctcggaatcacttggtggtaaatactgagctgagagggcaggagtgctggaggaaagggctgtgcctcacattaaaccgaagggccgggaggttcttggtgggggtaagcgggtgggaatgaagtctgaggcaaacatcattaactggtaatagatgggacatttgggtttaaaactgtattccttagaacccaaatatccgtttaacagccatcttttcaaagcaatccaatatctatttttgatcctccagtgatggcagcaggaggccaccaaacccaggttggggtgatcttagataagtcacctaagtcttccggttctacattttctcttctatcatgtaaggggtgaacggatcaatctgtaactgaggttctggaaagccaatttgcccaaaggctagtgctacattcgtcatggaaaacaacttaaaaattataaaacatggtaatgctttgaatgactgtcttagtttgctggggctgcagtaataaagtgccagagactgggtgacttaatcccaaaaatatgtttcacagttctggaggttggaagttgagaacaaggtgccggcagggtttgttcctttggaggcctctctcctgggcttgctgacagctgccttcttgctatcttcacctggtcttccttctgtgtgtgtctgtgtcttaatctcctcttgtaaagacaccagtcgtattggattggggcccatccatatgatctacttttatcttaatgacctctttaagggccctatcttcaaatatactcacactctaaggtattgggagcaaggacttcaacacatgaatttgaggagatgcaattcagcccccactacatgaatcaaatatttatttcccaattttatttgttacatcaaaaaaaaaaaagacagactgatttttatgatatgcctctgcttaccagcatggtgctgattgcttccatgtttttgtcttattcaatactcaacagccctcccttgaagatcgatattagtatctacctgttttcagcataggatactgagaaaacattcatcacaagctgaaagaaaatgaatgaaagaataagagtatatatttaaaaaaatttcaactctctcaaattcttgtgatttttctaaactgaggttaactttgagatttttgttaattttgtaaacctttccagttttacatatctttgtggagagaaacagaaaaaaagtgctgtacaatgcatgtaaattttctaatgcccacttgacaacttaaaaactaagctctcgtactaattcaaatgaattatttaagaaactttaattgcccatttcctctaaggatttcattccttttgattgaggaatattcttcatatttgttgaatccctcagctatgaaagactgcctacaaatctgatcactatcaatttgttgaaatttattcttagagtttaatggactaaaatcttaacaattaaacattgtggattcttttgcgttattgattttatggaatatgtatactcttaagtccccctctatttagaaattcctccagaaagaatagaaacatcctttagtacagtcttatacatcataagttacatgttaatcttgagccttgcaaaaaccttgttttgtaggataaaatattggctgtctgcatatggtatcttggaaaccctgaaaaacggttgtcatattaattccttcaccagtgtagtgcatgacactttgtggagcaattccacatgcattgtcattttgaagacaggtgtccaatgaaattatagtcttgtattaggaatctctgtcctctgaaatctttcagagaactgaaaaatgcatagacaagttttcctactttgacatgtttctgatttcattttcctgaatcattcctttggaatcgagttttgttgtatggaaaaacacatttgtccaagagggcgctatcaataagtggagactgacttgatataataaggaaacttggcggcatgcagctgcaattgtaaaacattaaccggtaaaagagagattgtttcagagtccaattttccctcctccccaacccccatttagagtaaaattacttcctcacctcccaattgataattgcatttctgccaaagccattatatttctgttggtttcccatgagtttcttctgtcacttttgcctccttctctgtctttggttaccttagcagagctggccctggacactgtagcttccattctgtgaggtttattgctttgttcgataatgccaggaatgacgttgagttgagacaagttcttttcagatcattagctgtcagtcacctttccttcaggctgcttgaatctgtgcagctgcacccagaggcccaggcaagccatgcctctgactacgggagaatatttccactgaatcacccatgaaaagactcagggtttgtcatggataggcaggttgtcagcagagtttattaacctttaagatgtacttagatgaaatatttgggtctggattggtcatttgacttttatatttctcaccacaatattgagcctttgaaatgtttacattttaaaaagtagtaacaatatacttatgcaggttgagtaaccctaatcagaaaattcaaagtctgaaacgcttcagaatctgaaacttcttgagcactgacgtgacactgaaaggaaatgcccattggagtattttggatttcggatttggggattaaggatgcttaactgatataatgcaaatattccaaaatttttagacatctcaaatctgaaacacttctggtgccaagcatttcagataagggttactaaacctgtagctacttttgttgaggacccactgtgatgtaccaagaactattttcagcactacctatattactattttatttaattttcataaagacctaagagttaagtttactcatctggaaaataaacatagtaagacctaacagatgagtaaacaaattctccaggagttaaataaactttcccaaagtcacacagcgagtgggagttggaacagggctttgaactcaagtctggacgatctgggagcccacgttattcttgactgtgcaaccctgtcatcttcataattatacgtaggcatgtttacttggaaccaagaagttttttttttatttgtatgttttatgctttttttttcccatcattatagacctggttggttctcccttcctcaccaacccctcatgttgctggaggacctcattgtgccaccagcagcaaagccgtgtgcccatcctatactaactaccctcccactcccctcttgagggctggctgctctttatcaagaactctgcttcccaagtaaatgtccaaggcatcaggattcccaagggcaggatccagcatgttgctgaacctacctgaggttcctaagttcctacctaaggaataggcgtcacagaaagtatggagtcttctacccgcaacctccttcctctacttccagcccttcaaaatgctgcccttcttcctagaaagtgctggggtgggatgcccattctcccccaagttttcccggggcacctggggcccacagagctcagggcctcttgtgacttcacagtggaccttttctgacactagggagtacaaggagtgaggtgggaattgggtaagacctgtgttgttctctagacagtggatctggaactcagccatcctctagtgagagaaaagtgtgtattaaaggagggtccacattttcagagagaagtcttgggtggagatttttttcttccagattttacagttctgtcctcagtcatagctgaggcccgtagaccagaatagttacagttgtattctgcacttgtagctagtgaacagtagccagtcagaaaaaagtatcaatgttctgccaacttctggtgtttgtgaaattttgccagaagcaaaacaggatcaaaaataataaacagacctcctccctggcttcttgactgctatttacataaagagattgatgaactgactctgcttgtgggagtgtgcagggaagggaatttttaaggagaaaaggttaattttggggtccttggttgcaagtgatttgaggttttcttcactaattgggtttccagagacaacctttactatagatggtgttgcttctccattataagcagcctaaactatggataagacaacctgacacatggattacatgcagctataaaacttccacagggaaagaaaatgaaccttgaaaacaaaggaataatatgagccttaagtagaacacttatgttcccagtagagggagagacctaatttgtatggcaagcttgggaaatctgggtacgggaggcctgggttctcgagcacgtttgtcctaacatggtagtcatcgatatttttgttaacctctcatgcctcagtttttgaatctatgaaatgggaatactattagctcctactattctgtaatataattgaggaaaaagtaatcaatgtgaaatcaattcaaatggaaggtgtggtgctcagttctagagtgcctgagggatgctggcatctgttaggggtcactaaacttgcctgcatacaggtgccatataaagccagacccagctctttgctgtcctcagttgcaccaaaatataactatatttgcttctcttccttgaataataattcataccactcctcaaggatatgggaataatgtgccactctgtgctgttttgttttgtttttttgttttgttttaggccgagtctcactctgttgcccaggctagagtgcaatggcgtgatctcagctcaccgcaacctctgcctcccaggttcaagcaactctcctgcctcagcctcccaagtagctgggattacaggcacctgccaccatgcccagctaatttttgtatttttagtacagacgggttttcaccagattggccaggctggtctcgaactcctgaccttagatgatccacccacctcggcctcccaaagtgcggggatttcaggtgtgaaccactgtgtccagccttgttttgtttttattcggttcacaaatgggcaacacctacttgaataattctcagcttcactttaaatattttttatatatttgatgcactgtgagcgaatgtatataattaattagggtcatttcaaactctagttttccctctcatttttctttcttctcatttttcaccttcattctgaagtgtcaagaattatactttgtatttttactcagcttataaatattgtttcacctttaataatttcccatcagcaggaggagaataaaaccttttaaagtgaaaggtactgtgccatagactgagggactctgacaagtccaagtgtcataagtcatagctttcaaagttatgaatttccaaatgtcaattgggcttactgcctaaggccgtgattttgtgtggctggctattcctaggcagaagagcctggtgtgggtgtctagctggaggcttccaagtacttattgtggtcttagcgggctgtctgactctgaagagacttaaggaccccaatgtcacaccgcccacattatctgatgagggatgcctggtgttcccctgccatcctacctagcacagcctgagctggaaagtcttaggaaagtagggtgaaagttgccggaaacacacactgtataaacatattccttaacgtgtttaagttttgtttgatagttttgatatcagtattattttgtttgctttaaatatttgagtatgctgatgatggtagtttttagggaaaagggtagttactaagctgatactcatgtgaaagtcttcaaaaattggtaaacaccctacccatttggtcattatttggaaagtctgggtatcctaacttttttttatcttctgagtggagcttgaggggaatgtgaatgaggaaagaaagcgcttatgtggcagaggagtacccagctcatggaatggcttgtcaaaactttttgctccaacaaaaacttagactctacattgacttcttccttacacaagaaggtgagactaacttctcgtgcctccaaacttcctggcagcctttggtttagcagaacacatttcttgtttatagctggctctgctcactgaacaaccacttaaataaattaccatgttttgtgattgatgctaataatctgacatggagttattaagacttcagatccttgatttattggagaaagaatctttcagatgtttcttttgtttggctctgagaagctgtacattttctgaaacttgtagttgtagaggccatgttcattgctctaaagcatggctttggcgttagctggacctacgttcaaatcttagttccagcactgatgcgctgtgtgaccttgggtaagttccaggaactctataagcctatttcctcgtctaaaatgggaataataataataacaacatcttctgcctacagttgttttaagaatgaagtgttctcacacctgcaaagtgcttatcacagagcccggctcttactcagggctcagtgtgtgttactttaaagggaaaacaaaaaaggatattaaccatcagcaacacggccagttctgctatggatgaactacttatggggaagatgaaaatacccgagcttagataaatacataaagtagaagctaaagaacagccacaatcctagtgaatctgaaatgagtgtttaaagtatcctcagaggaagaaaaagtataacaagggcagcttagaaactgcaattttagcagggagttttctgatcaaatgtatttacctttgaaagcagatagctatcgaactcttggtatgatagataatatgttttgtcctaaaacaaatgagaccaacccccagaagtccagtgtatgaacttcatctctggcatgaagttgacagaagcgtgtctaacctttgataatgcctactcttaatatttcaagtccaacttcccaaaacgaagcacagaatctttcagacatttgccttaacagtacagttaactggaaactaataatacatggtcccaactcctctcataagatgtggtaagataagcccagaagaagcctgggacagtacccttcatcccaccctctagtttgcagcctcttccacagctgagagggaaagagacggcccagcagcagagacaacatatcttccatggccagaatcccctcagcttcttgtcaaagacagccttttaagtcttctaatctaactacgttttgccaaactcaaaacattggatcttgcatttgttgtaactccactggcttacagaaaatgaagtgcatttattgtctttctatttctgtacaggggaaactagtcttccattcactcactcactcactcacaagattgtttgtaaagtagctactctgtgtcaggtgctctcaggtccttgggatataacaacgcattcaaatacaatatcacaccagagtttgatgggcggaccttaaacaggctctgaggaatgtcataggtgcgggaacggacatctgtgtggggagagtggaggcacaatggaaggtttcagttctcatgatagctgttgggttgttgttgttgttgttgttttaaggtttattgttccattgcttcagcttctatcccttggtcagaaagtgtccatgcctgtctttactgggagattgagggaggatttcttgttagctgtctggggaatcatgaggttatgacttcatcagtttttgcccttttatgtgtcttccttcaaatttgaataggtggtccagtctgggaacagggaaccctctcccttttgtgaaagtgtgctgtccttgaaaaaccagggcccaccctctacggagagtttagctgtgtgctgacactgctgcactcgagtttgtgttccacctggaaggattatgataagatagtggtaaatttctcatgaattcaactttagtaacatagcagtaacttatcacaaatatttaagagagactacatttcagaaacagagaccactttttccgcatcagctcttctattggagaacctagcctagtcaatatctcaacaaatatttgttcaaagccgattgtgtgcaagatcttttctgggattgtgtatgatgcaaaaattatataaaacatgatcactgccttcaaggagattataagtaagtgtgataagacatataaactgtcataaatattgacaattcaagggagcgtatggcttagtgactgacaggctatcaaaacaggcacttagaagtatgtgtaggcaacagagtggtaaggtaaagaggggagaccactgggcctgagccatgggaagaagctgtatttccaccgggcaaaatcgcagagttgtcctaagcagggcaacagaatgagtggaaaagtatgacttgagcaatttagaatgtagtccaaattcagtgacatgtggaggttataggaaatacagatgataaggttggcaaaaaagtttgaggccagactgcagtgagtttgaaatttatttgataggtaatagggagctcctgagggcttttaagtagagcagaaataggacaaaaagagcagcctagaaagatgaatagataaacatgggtttgaagtggccagactgaatgtaaagatatagtcatcgtggttgagcatgtattttatgcaggccctgcctaaacatgatcaataattatgtcatgtaatcctcagaagaggaagtaccattgatgttcccattttaaagattaagaaacgaaaacccagagaggttaaagtcacttgttccagttaaacccaaataactagcggagccaggaggtgaacccaaggctgtctattgctgtctgtgttctgccacagctccaggcttctccttagagtggttgttgcttctgctgctgctgcagttacagtgactactcagaaaaataccatgagggatgaggatcttaactatggtgataaagaaattataaatacaagagatagctccataacttttcgggatggacaatgtttacatgccttataaaatttttatgtttacaattcctaatgtatctcttcatgttctctccccactccccatgataagaacccattaatttgaatttattactgtaccttctgcttgagatttttattctacttcaagacacctcttcagtgatttgtgtcatcagtaattcttactcagtaaagtctgggtcaccttacaacagaaatttcactggaatcatatacattttcttcctgcttttggcatgactaaaaatgtattgaaaagggataaatacaataaactacgaacattaaatgaatttaatatgagtggcaaggagatttgaattttaaactgctaacattatagttgcttgaactatttcatattttataattcttagagtaaaatttgcccaaatacaacataatttagtgcctgattttagaaatgtgaataaaccaaaacactagttaaattggtacaagttgtctgaaatagctgtaaaccccaagattaatttgtaaagaaactcaataaacaaatgtccctataggacacctgttcatattgtttacaccaaattcctaagtggtctgtcagcatcttagcaagaaggagattttcaaatgtgaactcttccagaagtaaagatgtttaaatatttaatgaagtaggaaattgcacatatttgcctcaggcagctgccccactgatactgaataaaaaatactcatagagtattttataagagctattaatatagagtttaacttctccacctgaattgtagttcagattctgaatctctagctgcaggttaaatccaaattaaatgagatgagtaaggaagcttcaggaaacagagtttgtgtgcttcaaggaggaagaagccacctcggagaactggcttactctgaaaatgcgcaaatgatcctgaatgatctctgtgctcattagcacccctgcacacattctgctattctctcagcacactctagtctcttgactcctgtttggaaagcaatgtttcactatttccctcaaatccaggccacttttatttctcttcatcaagacgggttgtctctaggggtcaagatgggcagaggttatgttgagtcagcaaagactctctgcttggcaggtcatggtcacacccattcccgtaacttctcccagcatgcaagaactagaggccactgcccagcctctgagtcaatgccaggttgttctctagaataggctgctcctgacccagtaaccagctccggaagtttccaggcttctcaaaggagccttcttctttgaaggctcccacttagtgttcttgtcccgtatttatatgtcaatgcaattctctctttcctgctgatcaagccattctgttcatgggtggcatggaagaggtcataacctctgcaacccttctatgtgtcaagaaagacctctagactctgctgatgaaatacgtgaccctaattgcctctccatgccaatggcagactcattccctggctgtttctgacattaccaccagctgagctaaaccaacaggacccaagttcctcagggagcacattgtttgggcaattagtggttgagctccatggaagtgtgatccatgactgttgctatgtaacaaactgtcccaaacttagtggtattaaacaaccatgttattatgctcatggattctgtgggtcaggagtttggaaaagacacggtggaaatggcttgtctctgttctttgatgactgtgacataggctggcaagacctgcgggctatgcctggctcagtgactgggctccaggaacatccgaagccttgggcacttgcatgactggcagtggatgctgcctctcggtcaggacctcagtgagactggcagctggtgcatctacatgtgtccatgtggttgcccaggcttccttcttccccacatggagactgcatcccaagagtgagcaaggcaaggtgtgtgactttttatgatctagtcttggaagttgcctcttcactttttctgtattctattagtcaacatagccataaaggtctgctcaggttcaagaagagcagacccattattcaatcggaggagtgtcaaataatttgtagattaaaaaaatatatgtttgacacattcagtaatgctgggttcctgtcattttttctggcatgtggctggcacctaactgattcatttgactgaatgctccaactagaatcatcacgcgatgttcttttgtccccaacatgaagagagtgctcgggtgacattccatgtatgccagctgcattgcaccaattctttggttgtgactgtgtgaatagttgcaggcatcattctgtgcagtttcaaatacattaggctcatttaagcccctacaaaccccgtgaaacaggaaagaagaacatactcccactcccttcccaagattaaaacaaaatccagaatctctaagcaaggccaattggtactcaattttatcccaaacctggttttccaccaaaagttctctcatttcatttgtagctgtttactttgctgctcctgaatccttgggaggtagaattaaagtttctgggtgatgttttattaaacatttaaaggagagggggctcctttacagcagaggcttgcaagcaggtacaattttgccctccagggaacatttggtaatatctggagatactgttgatgatcacaactagggggtgggtgctgctggcatctagtgggcagaggccagtgatgctgctgaacttcctgtaatgtacaggatgctcccccacaccaaagaattatgtggcccaaaatagtgccactgttgagaaacgctactttacagggggttttataatccttctaataaaatgaggaaactggggttcagagaagctgagtgacttgcttaagattctacgactagtaagtgatgagccagaatgtagactctcatcttgagatcttcggtctcatgtctttatttcctatggtacttgagctggccttgccacctgcctgtagagagaggacttggagtggggagtgggtattcttgctttcctggaattctgggcatccaccacacccatctaataagcagaagtcactgggatggacattgtgctcctgcagttttctttactcattaggatccaggggcagggcttacatgagcagagtgaagatttcggtaaggcctgggtgggaactggactctaacctcccagatcgagacttgtaaataacaactgaaaaactagagtacagggtgtgtgtgtgtgtgtgtgtgtgtgtgttgtgtgtgtgtgtgggggggggggttctgggtgtggtgtgggagggaagtaagatcttatcccacaacaataagcaaacagctaattacttgtaattttggagataattgttttctcctcctgcaaacatgccaaacaggaaattaatttaaaccccagaaagttcgaatcatctgcagattgtcaggaaagaaacactcattatccccttagagcccccatcatatctaacaggcaggctgaaaagtgcagctgcagcacagggctgccacctctgtgcgaggtccccccactggctggtggctggagagtaacaggacggagcctctagcagaggcaggaccgaggcaggcagacggggcccagcttcccattgacacctgattcatgccacctgatgcagaatgtctcactgtgagtcatccttgctgatagacctattcatcactttgaattccatgtcagtgcaagagctggcttcattcggccttggataaatgagtcttcaggtaatagatgacagttaaaatatcaggcaaatgttatctccagtgaaagacttggctttgcccgcttagtctgttttgcttctcagcttaaggcagtctctcttcacttctaagagggaggatgaacacaatccagattgttcatttagatgaagcatcttcctcctcctaacttctcactgctcgtgggcccgagttcaccagggaaagccttctagggttgagcaacagaacaaaaggaatgggctgccctgccttccgaacccaagcaacccgtgcatacagtgttttaactgttctggaaagaatgaagcattcataagcccttccattttcaagaaaaaaatttcctgtgacattttaatccccttttgtgctggagaatttttagagttttctcctgccagtcatctcaaatgttttgtatctttcccttttagctgaattgcgtattatgagccatgacccacaataaaaaataatgccactgttattgaatgaaagtctcgttctttgggttattctgggctatggggtcagcatataaatgctgacctctgaaagtccaaagatgttatctagttgaggcttatgccgggagaacaaaaatgagctgtgagatgaaaatgaccacctgggatctccaatttggtttatgtttccgtgaaatagtttctataaatgatatgagtgggtgccactgcattttctctaaaaggagcgctggcttatttctgagatctcttgtctgtgtatggaatttttgtagttactctctatctaaattggggttctcaatctccccactatcgacatttgggggccaggtaattgttttttgtggggactgtcctatgcattgtgggatgctaagaggcatccatagtttttacctctggataccagaagagatctaacccacaagttgtgaaaaccaaacatgtctccagacattgccctgtgttctcaggggagcaaaaatccctgcagatgagaaccattgagctaaataaaaataaggatccctagatagatacaaatgaattcattcctttgttcaatcttttaacaaatgtctcttaaatgtcttctgtgtaccagagtcttctttgaagattgtaaattgagagatgactagatcatagttattgccctatagggacttggagagaagacaggcatgaatctaaataattacaccaggaatgccctctaatgaagacgggaaggacgtggcttaggagttcagaggaataagtgttaactcttcttgaacttatcagatttcctgaaaattctgattctccatttattcagaaacacttacgttttcaagggaaaaaaatcctgtttattaagatattacactacagagagtttcaaagtcaaacttatgaattcttttatgtaaatgttttggtaaggtaaattttggtttcaaatgtagataaaagaagtcgcaatatctagatattagttgatgtacaaaacatgtacatgaaaggctctgaatgaacggattgggtaacagctgttcaaagggctgagtgagccctgagcttggacagtgtccaggctctgtcttaggaaagtgtctgccatgctttgaagtcacaattttgaacctttgttcacagtaacagacaaaagtggatgtttacacttcctggggcttcagatttgatgacctcccccgtaaaatgtagagggcagtaagatgaaacagaaatagacctgcctccactgttgaagcagcgttggcaatggctgcccactgtgagctgcagcgagcacagctcccagaccaccagctggaaatccacccctttctctttcattgcaaataagtgcgaaagatgctacgataaggttttgaatctatggcaaatgaatatttgaaatcctttgtatgttttaactatgtgggaggtactgtgatgtaatcatgaagaacactagctggaaagttagaaagacctgggttaaaacccaggctccaccaggcctagatgtttgaccatggaccagttatctaaccccatgctgcctcaggttctttgtagaaattagactaatccttcccacctcaaaggattgttatgaggtaattataggagatattttaactgtctaatttttttttttttttttttttttggagatggaatctcactttcttacccaggctggagtgcagtggcacgatctcggctcactgcaacttccacctcctgagttcgagcattatcctgccttagcttcctgagtagcaggtccctcccatgacatgtgggaattataggagctacagttcaagatgagatttgggtagggatacagccaaaccatattaatatggaaggtcatcattgcctaggaagtgcctgcataaatagatataagttgagcttttaatttgctttcagttcaggttaaatttggaatattggtaatgatttttaaactcaagcaagcgtattgtcactttttggcgatttcctaggcccaactgaaccataaacagaggattcctttgctcttgatcttttgagacctaataagaatgcacaaaccactttcagtgctctctttgcatgacaactatgtagatgtgatggagtctggcaatgtcaaaagaaaggaagcatcctctacccagggttgagattgcatcagatcatgggaactgacaccaaagccagtgtgaagtttaagagtggaggcattgctgagagtcccattttgaagaggtcctttttattcctgtgcacattcttgcccaatatcctccttactgatatatgcttctctattaatttttaatttctaccaaaatctcagaaagaagatactgtcagtccctatgaaaacaaggactgtaacaatctcacaagtttgtttctcaaaagataatttttctcatccattcctgcatttattcattcaacatttattcagcaactgttagatgctgggcaagacaagatgtgggccccaccctccaggagcttccattctagtgggggcaggggaggaagggagggaggtagagaggtaatgatagtacaggacagaagtacaagggtaggcattagtgcaggatccaaggggagctccagaatccatactaaatgcttagggaaggcttccaagattaggcaatgttcctgttgacttttgaaagagacagcccagcaaagatagaacagaaagatgttgttttccaacagtatggcacaacacttgaagaacagaaagacacttataggagaaagatctcatgtgctgtagtcaagcacagtgagagagcatggtctgttctaggaagagcaaattaaggagaaaccttgttttctgtatggaagcaaaggcctagataggtcactgtggctccagagttgagcatgcattgcagaattccattgcactgatccctgttatccttctccaaatcagcctgaccataaaagggtttgtggctctattaagtccttgtgtaagaaaaactacacataaagatttaattgaaaataattgcaagaatggttctcggaaatattccactactctgcatttagaaatagcctgaaatgttttgtaatccatctgcgtgccttccagctagagagcgtgcaaacaatacacactgaaaaggccactcttttttttttttctttcttcctaatctccagcattgacgattgcatggtgtcttgtgtgtttctggtcttcatagccattaaactatttctaagttgaatcgaaatccagttgaaacctgttcttttttgctcttcttctattgagaacatagaacaactgctctctagcacatctatttttttaggaaaatggttatggaagcattcactccaatcacataatatgggtgggcaattgcttgctttaactacgccagataaaagatgacccccaattctccatggcaaccagaatcattgacgatcaagccagaggaagatgctttgtgtaaattgtgtagctagaaggagatttgcaaatgaggggactctcactggcttaacccaagaagctgataaaggggagctgtccatttaaaatgcatcagagccttatcacattcatataaaacaaaatgactaaatgaagcagctggaagattatagtgagttttaattatcttttaatagccaaagggctcttgccaacacatgctgataacctgtcacttgttatgtgtcatataatctccatttatgagtctcagctgttacaaattgaaaatatatttacagtgatgatctttccttgttaaatgcaaattcccagaaatgttcaaactgcaaggtatcctcacagctttgtttctgttaccctcttgtgtggaattgaaaaggctggtaatactaaacaaataataataaccaaccttcttcttgttcataatttatgactctcattatgagtataataataccagttcttaaaaagtaagggtaaaataattcctgaggcttggagattatatttctgaaattgcttacaaatccttttttaatggtaatccacatttttttcaaatctgcctgccaccttctcctcctctccttaggtgtatccatctcaaatgtcttcaggctccagggctccaaggcagctgctgtgatgtcattcatattccctctatattccctagatagataggtaaagatataggtatagatataggtacacttttatataccatgcttggcattcagtacatgtgggatcaaatgagaaaaagtcttgcaaagttgctgaccccttctacttgtcttcttgccttgacctcactggtatctcatttctctgcttctcttgactatttttactgatgtccttggtagcagctcttattcctctgcccagctctgtgtttcccaagatttagttcccattcatggtcttatcaccaaatttacatggataattcccagatctacatcttcaggtcagactttgcaccttttttccagttctatatgtcaaatggccttaattgaacatccttaattatatagtcatgatctcttccaatcaacaagtttaacaactgaatatgttaattttatgtctgaaaacttttcctgttttggttagagcttcatttgctctgcctatcttcttgataagaaactttgtgttattttgtagcttttgtatctgtatatagtgagtctgtaaggactaccttcgagatctggcataaagattaaattattctttatttccactgcaaacattgtggttcaaatacagaaacttgtctatttactttcaactttaaaaatttaatatataaacaaattatactttattgaaatcttcatcagtcctgctcatcacctacagatggggttagcagcaatgagtcaacatttttgtttctgccatcttgtttgttaacatgcttgtctcgtttaagcttgactaggaaggttttttgcagtcattttgaactgattctggtttgttaaatgcaaagcagtattcattcagaatttaaaagcagttcaaagttctattaagaaaaaaatacccctatgattaccatggaaacaaaagcagatgtttcaaaaaaattttaaagagaagaaaatgtgctgcattgtggacttgggatgaatagtttgctagctgctgaactgtcaatgtgctgatgggttctgaaggaacaggagtaaataatagaacaagtgaaaactgtggggcctgggtacctggtgatcatttgcaagaggggaggaagtgaggcggacacaatggcaacactgctgactgtagggctggaggagcagcctcttagtcaccagggccagcaggagccctctcaggaaggccgagccagtgagggtgcaggtaatgaaatgcacatcattgacccaggatcatttcttagttcccatgcctgtaaaaatctgcacatcagagtggtcacagcccagggctggtgacaggttcaaggcatgttcagaatttgggacgccacgaagccaaatttgaaaattcattttgaagatgaatcctttgttattgttgagtgtatacttggctcctttagtatttcagtaggcttcattaatgaacacatttggaaagtggtcagatgaagataatcaacttatgtatgtatatttatgctttttatttatacttgatataaaaattgacctgcatacatgtgctctttctttagtgcttatgaagagtcttatactacctgtagaccatcatgatatgtgtcagtttggggaacatgagcagaagggccagtaattagtgttagctcctcaactcagagtagatagaactcctggaggtctcttccctgcacagttgcaagcaagggtttgtgcctttgccatgagccgtcccctccctgccctggagggagtgtggcagaaatgaagttaaggatggaaatctctttatgcacaacccttgtttgttggggaggaacaggcattttggggctcactctggttcagtctgatttttttctgtctctagcagcctcagtaggtatggcctttgtagtaagaagagaggaatcatctctgtgaaaaaacttaccatcaaggcacactgtactatgaaaactctcccttcccattcaccaccacatctactaggctgggagagggtggacaggggtatggttgatggcaacagggtgtgcgggccctggaggatggagtttggcccagttgtgagcggttctctttagagagggtgggcctggataaatatttttcttagctttgataataatagtgaaagtccctctcagcatcctaaaggtgaggatttatccatctcttaccataagccaagaagggttgtgacactggggtccctctgagtagtatgaatgatacacacatcagcttacacatctgtatgaggctttcaactttgttgtattcacagtgaaacgggagagttccctggtccccctcgtaggatgtgcaacaagggtgtggctcacctgctcggtctctgaacctgatcaagcctctgaggggggggggagcacacagatggacaggtataggagcccaagttgtcgtgtgttacagtgtgcccttttagccctgctgtccgcagatagtgtgagtgttatccagctcagtggaccctctgccttttctcaagggcagagggccagtgtgacagctttctgtatcctgagctcttgtccagcatcctggaagaatcaagtcacacacagacttaaaggatgaatgtgggagttttactgagtgatggaggtggctctcagtgggatggatggggagccaaagaggggttggagtgggaacacgatcttcccttgaagcctggccgtccagcagccaaactcctctctgaccacccccagccaaactcatctcagcattcagacatccctcctcttctctctttctctgccacgtcattccacagttcgtgtgcttgtctcctcacctacaggtctgcttctggagcctgggtttcgggatttatatgggtacaggataggggggcatggcaggccaaaaggacatgaaaacagaaatgctgttcccacttagggctgtgggtcttcaggcttgatggtagggcctttgtcggggaatcaccccctggtatccaatatttccctgcctcctgcccatatcaacagaatactttcaaatgctagaatataggcaacagctatgaagggattgagaggcctaaaacaatactcaacaaatcagcaataatgacaactcagcacagtgacactgtctcacagagcctgtaaaggtgctcacctgtgtcacacgcacgtgttctctctccaacactgttaagcctattgtcctgactaccccttggcatatccactctgttgaggtgtacaaattatcctctttgccgctgacttgacctcatgctgtgcctctgacctcagtccgctttgccacccactaccccatcagcctagtgtcctatctgctggggaccaaccagcccactttgtctgagattcaatagtttccagagacattaggctttcagtgttaaaatgaggatcactccaggcaaagcgggatggctgatcaccctgtgtgtgtcagactgtgcatcccaatagtgcatatattcaattgcagcactaatacattttacaatttgatcaccaattgacagcacacctggacagggtgttcccccatggtctgtggcaggcctgttgaaaaaccttcatttatgttttgttcattgctcatcaaatttgtatccgttcaagagaggcctttatttttatcccgttcagtctaggcatcatctttagatcgtactattttgaaagttcaatttcaggctttgatgatacgcttataaatcagagctacccttgacataaatcagtagaatcaacgccatacattgaagggggtcaccgtggtctcgggggccacatgaagcagacacagctgtacagctgtcagcagaggtggccgagaaggcatccctgccctcatcactgaccggcagcctcggccttcacaaggaggtccccctcacccagcagtgctgcagctagagcccaacagcatgcttcatcttataaatacacgctgcggcccttgttgtaggtggaaccttcatttagtgctcaacttaagttctgtgtggataattgtgttctttggggtaattgtgtttttcctggatgaagcatgtactgcatatattatttccaggcatgtttacgctgtccattggcttaatgtagcttttaaaatggtctgtgtgttaacacctattcttaattgccagaatttgaactcaagggcaagaatagtgaacatcacatcacaaatccatgttcaaaggaggaatacagcacctgtctttctaccgaggtctaagaagtcttttaggaagtctggctgtccatagtcattgccttaagaccataaaaactatccttttagcaggactacaatgatggtaggcaaagaacacacatggtgttctggaggcataaagttagggctcttttctggttcatggaaataccacatgatactaggatctaagtatcatgggaaaattgtttggtggtgacctttttatatgtccctaaaataatccaaaaaacggaaaatgactgggtcagatcatctgtgacatgggcccaaggtcagtaccttagggaagctcgcttggtgggtgatgtgctcactgtcttctttaacccaccagctctctaacattctcaggcaaaggcaacacattttcatcctttacaaccctcgtcgtaccacctactggcactgtaaaacttctgcaacttgcgtcaaatccaattttattggaaaagtactttcagatacaaatcttgctaaatgatttgatgtgggaaaagttagaaaaatatctaagcaaacattctcctggatcagtcttcaattgtgtgatttcgagcaattcttccgtaattcaagtgaaacacatacctgctgggtcaatactattgatagtgacaaaattggtttccctctgacggcttcaacattatgttggaagccctgcatgtgtagatcttaaagattgggattgataaagtgagaactgttcaaagctgaaactggttgtttagtccatttgaaagtatgcggaagggagggacctgaatatggcccatagagtgaaaatcttctccgtcactcactgtggttagaaacaaatgacagagggctgttgtgcagctatttcagtattgtaaatggaacatctagcactctgttatcactgctcccagggcagcctcttgaggcccttgggccatcccagcctcaccatgttctcctctccatgttgtcaaaaataggcaggacgtaggagtgtggcaaccggagagggattaaaggcagggagttccaaataaagggcagcctctgagctgtaaaagctgctcacaattttggatacatcatatacataaccagaataaattgaattagaagatgatggtctttcctttttagtgccagagggccatttatcatgtaggaaatatttaatgtagtaatgataggagtatcttatttaacgtgtgattatttttatatctattttatatctttagccttttaggatgaataaagcttatcgttttgattttcagcctttaccagaactctgaagaagtaaggttttgctagtttgtctgttttggaaaggaagggaatttactttgaaattgtgttcaggattaggtgttactcatttaatgtaagtagcagccttacttgacaagctaaatagggtggtaaatctgaggtttgcagagtagacttctaaaatccccatctaacattaaaaatgtatttcattatagcttaccatcaagggaggaactaacccaacatatagatatgcccatactttacacaaacagccaattagacatatgtattttcttttgatgaaaagagaagcttttggaaatgcaaacatgtgcatccacttactaagagtctaccagcctcttatgtgggactgacataatgatgtcttgtgcacttcctcttttaaaatacaaaaataaatgacactgagaccaaaagctctgcaaattagtggctattcaggcttgataactgtactgaatgcacatggttttctgatgatggccacagctggggaatgaatcatcctaacctggcagactgttttagtaaacctttcattttaatgaagtgattcacttggaaagaggggcaatgcagcgagcataaggcccagatacttccttcagcagcccaaaaatggctcagagccacagaatcttgtcatttgatcatcctggcaggcttgaaagtgaaagaatcccaggcggcctgtcaacctcagtgggtcctacctcctgtagaccagatgtttgtgcagcatcatctccccccatgctcacaaaaatcctgtgaggttgatgtgatgatattttataaataaaaacatgagcctcagagagttaaataacttacaactcaggcatcttagattctacactatatgtgttgctgttccttgatcttatcttgttctctcttcttcctctacctataacgtctcccttcccttcccttccttatcctattcccatttctcccctccttctatgctttcacttattcaaagcatagtgagcttctacaccatgccatgccctatgataaatgccaggatccagtaatgaacaagacagacttaagtcttgtcctcatacagtttatgatctagcaaacaagaacagatgtgtgttcaaatagagactaaggaacatgggaggaggggcaagacatctggaagggatgcttcataggaagagagcaagtgtactggttgacagacagactgagaatatttaaagatttcaacagcatgggtcaatgggccaaaatcactggttgaaattacacaggaataaatgtaaatctgccatttcatattatataaatacagaactgggaccacatgacttcatagggttccaagtgatgtttgaagcctcagcaatatgaaataatgcctttaaaaggatgcagtcttaggctgtgtctgtaccagcatgggttccagaatgaagttgcttgtaattccatgccacatctgcaactctctgcagggctttcttgttttaagggagacattggttacaagacagtgaatactgtttttgcgagaataaaattctccagaattatatatttcccttggtagaaggtgagagacacacacttaattcttattcattcctctgcgctaatgagctttcctatagggaacttttggcttggtagatatgaactaggaggagataattggccccccaaagtaactgactttccttaacaatacctagcaatgtctactgctcagaattttcagagaattattttccagatttttttttattgttgttgctcttttagtctgattgaggaaacaaaataagggtgtgtaaagctgctgtaaaagaacataattagtttatgatgggggctgggcacagtgtctcatgcctgtaatcccaacacttggaaggctgagacggggggatcacttgagcccgggagttcaagaccagcctgagcaacgtagtgagacctgatctctacaaaaaatcaaaaaaattaggcaagcatggtggcaaatgcctgtagtcccagctacccaggaggctgaggtgggactattgtttaatcctgggaggtagaggttgcagtgagccgagatggcgccactgcactctggcctgggtgacacagtaagaccctgtctctaacaaaataaataaataaataaataataacagataattggtgtatgatggcattaggaagaaacgaaagggagacagtttgaggaagtggaaaggatactgtcattggaattaaacatgcagatttaaataccaactatacctgtattaattgatacagacaggttatttaacactctctgaggcttagtttccttaattgcaaaatggtatactaatatctgcattgtacgattgttgcagggattagaaataatattggcaaattcatgaccaaaaagcctggcacattgtaggtggctaaggaaaccttgagaaaagaaatcattcaaagaaaggaggtggagtcaaagacgaattcttggaagaaatgcatttttagattcatacttaagaaatcgtagacatagactgactgaatattaagaaacccattacagacggaagaaacagtgacaaaatgaagaagtaaggtcaaggccttgtgtagatactattgtgttttctttttggtcaactgagtcatcgtgagttagtgtgttctcttaggattggaatttattgacagctgcttgtggccagtgataacctttgtgtgtctgttgatttccctgcttcgaaatcctcctaccatttaggaaatgatgttatcgtgttcccaacttttttttcctcattttaatgtataaagctagcagtcatttcaatgtcatgtagcatgtcacctatttttcatgaaacacatttgcaatggctgcctttaaaatatagtactcatttatcttcctttatcagaaatatctggcaaggggaaaaaggagttttgttttcttttctcttctttagtagaaatgatttcccaacttattagtgaaaagtagcttatttaaaatttattgttttaaagaaaactagatgatatgttcaacttgccaccctaaaatctaagaccagggagtatcaagctcattcaataaatacaactaataatttaaaatattatgtaattcaggtgttttgggaacacccaaacactgaataagggaaaggataatggtgagaaagaaacaaagtgactggagaagtggaggaagaagaaaaatcaaaatatgggaagcaaaaggggaaaggaatgggaggaataccaaaacaaaagaagataaatgaaggagaaaagaaagacaaaaaacagggaagaggaatagagggatgggggagcagtgtggagtgggagtcactgtacctaaggccagaggccctgctgctccttccccacccatcattcaagtctggaccccaactggtaggtaacactggaagctacagctcacaaatctcttaatgctctcacatgcccaggatcgccatagacttccagttttaagtagtgactaaaaattcctttgttattaaaagtctattaaattacattcctttattcttccttttttatcttcttcttttttttagagagagaagttctcactctgtcgcccaggctggagtgcagtggcaggattatagctcaccacagctggttgccaccacacccagctaattttttattttttgtagaaatgaggtctcactatgttgcccaggctggtcttgaactcctggactcaagcaatcctcctgtcttggcctcccaaagtgctaggattacaggcatgagccaccatgcccagccttcttcttcttaacgatagccctgactcattcgaaagtcaagacaataatagaaatgtaagtttaaaatgttatatgcccatttattcaaaattaatatttttagcctcattgagtcttcaagtgcagtatataaggaccccccagaagatgaggtaaatcacccacatgaaaagccctttgtgtcagtggtccccaaccttgttagcacgtcagaatcacctggccattcatgaaaacctggggtgtctgggcacctcaactgagagtggtttgaattggggtctcagcacccactattttgtaagcatctcaggtgatgggaagttcagccagtgctgagaattgtgcgttttgggcgatagcagtagagtgagtgaatcacggttccagcacttacaagtgagggccattcatatacatatataactgggatatctaatatatagcaaattgaaaatttgtaatacaatagatatgtaatatatttgatattgtacttgatattatatttggtgtctgttatatatacagcaaattgcaaaaatatatgatagaaatatatattatatctaatataacgtatattaggcaccctgaaacatgttatgaaaagactagctccaaaaaatgagagggcactggtcatatggagcagttgtcctggcgacggcattgcagagacctcatgttgaattcgtgtctgcttgtccatcatctgagcacagtgctcatcacgttgcccccatcgcctgctgaattgagtactaagtccccactcagagtgtccctccattctgactctctgccgcctggtatcttggctccagacaaaccaagccgcactttctcttctggacttttttccagccgttttatttatttatttatttatttaatttatttatttatttatttatccgagacagagtctcactctgtcacccaggctggagtgcagtggtgtgatcttggctcactgcaacctccgcctccagggttcaagccattctcctgcctcagcctcccaagtagctaggactacaggcatgtgtcaccacactcagctaatttttgtatttttactagagacggggtttcaccatgttggccaggctggtctcgaactcctgacctcaggcgacccacctgcctcggcctcccaaagtgctgggattacaggcatgagccaccacacccagcccagccattcctttaaactggaccaatctataactctctccataaccacacccttgtcactgtcttttgaaattttatccatccttcaaggtcttcttccaagaagcaatcttaattctcttgccaacagataattctttttgcttttgaaatcccaccgcatagtgttttattctctcctctctctctctctcttagtttttgtttttgttttatggtcatcaatatttttattattttatttgtctaataacctgagtgaaggtttagaatatcttctatatctttggatcctcgttggatctacctagcacagtgttttgcacagaaagtgctcaacaaatatttattcaatagaattaataaaatttttaaaaagatgttgataggggtatgaaacctattgaaatatgaaacttaaatttaagcaggtgtgattgttgaaacaaatggctggttttagaagatgcttgtctgttcctagacatacagacttagacaaagatacagccctgagaagctcaggtggactagagatgtgtgtgtgcctgtctggggtacattaggtgcatagaaagtgaatgaataggtaacgttctagccaaccctgacttgatggtagtgctttcctcttttgtgaagcaacacagccacttattcatcttaagtcacttctccttacctctctttgatgcgcatgtcttaaattataaccctgggatttattatcttttgcttcaagagacagacaaagcatttatgtctatgaacacagtgcagttgcccttctacccacacactaaaaaatgaattaaaaaattgccaagcttgagcttattcattacaatgtttctctggataacaggcccaccccatcccttcctgcacccttcaaatatccttacttgtacggtgaataaaatgtaattttattgtccttaggctatatcattcttctgctcacagtaaccatgggcatgcatttaaaagtagaatctggcctcttgagtttaccagttaatttaatcaactccctataaattactttacaaaaaaggttgggggagaatgaaagaaaagaaaatctattttagaaacaaaaatgtatctgtgcagctttgttttctcatggaagacaaaggttctttccaataggacagaatgacagttccacttatcttggctgcacagaaattagatcagtaacatattttctgttgaagaagaaaccttatcttagtggctccatttcagaatcaatcatctgcatttcagtcctgccccttctcacaagcagggaacattatacaatttgtatgtttcaattagtttgccataaaaaataagtagctcaagggcattagtttattactggtatccagccatgttttcttttgctaaatgacattctgaaagcctccattctgagcataatcaccttagggtacccacagaatgtggccccaaatgattcaattacagctagaagttgttctcttcccaaagcacgagtcttttgcattcacaggatattttttctttcataaacattcctgcgagaatgtaagtgcggatgaagattgtgttctgtcttcttcttgtcttttttctgtttactctgattttataaaatgcagtgtcatgtcttaggacaaattatcctcagtttgccagcaagtgagtttataaattattttattcaaatgagaaaattttccgctagaaccaatagtaaaggatggtgagtttccagctgacccacaatgacgtatttaactcacagtgaaactcagctctgcggttttaatagtttccttttatttctaagagcaagggagcctatgtttctaataattggacatgtctggaactgtccctaacatttgacagttttttcctccttgccagtgttaaggagattctttcttcctcacttcagagacagcttaatgtgttgtatttggatgtagggatgtgtcagttacctattgctacatgacaaccgaattcaaatttaatggctgaaaacaacagtcatttattggttcacagttctgtatgttggcaatttggtcagggctcagctgttgagttcttctgctggtttctcctttcttgtgcagttacaattcattggcaacttgatggagttttgtggcctaatagtgtctccctcagatgcctcgtggttggtttcagctgtcagcttggcctttctctacatgtggtctcttatccccaaggaggctagcctgggcttcttgtctcagagttccaagagggtaagcataaaagctgaaagacctcttcagccctaggctcataagttgcacatcacttctgcttgatttgttggtcaaaacaagtggcatggccaaacccagatttgagggctcttcttgataagaggagcagcaaggctaaatttcaaagagatacagggatgtgaggaattatcgcagcagtagtctatgtaaaaagtctgctagaggactggtggggtgagtggtgagaggtgacaggtggtgaaaggagtgagagggtgactgataactttgaagttcagaggacctggattccagtgtcgctttactatttcccagtaatgtgactttggaaaaattattaacctatccaagctttagtttcctatctcttgagactaattcctcatccacagagaacttactaactctcctccttcacctcccacatcctgattttcagctttcatggtatcggcattcccagatgaaggtacaagttgaccatccctaatccaaaactccaaaatctgaaatgctccagtgagcatttcctttgagcatcatgttggcattcaaaatctttcagattttgaagcattttggataatgcaaatattaaaaaaaaaaaaaaaagagccggaatctgaaacacttctggttccaagcatttcaggtaagggatactcaacctctattcccatccaaataagtgcccaagttagagacctggaagccatatactcccttactctcatctcactcttagccgttggttcctgctttccacctttaaaccagtgcttaaataccttacaggtgccagacctgggcttaacaggtaaacgaagctgacatagttccaaggaacttgcactccactgataatatgagaatctccaagttctatgaaggaaacaaaatgttgtgagaaacagtaagggcccggggaccctgtttttgcccacccatctccaccactccctgctgagtccgggacaccattatccctggcctgtcacaagtgtctcagccacacggattctctgtcctttatggttcatccttcacactgttgctagaggtatcatttttgagaaaaaaaaattaattccatacttgaaaatccctatgacccataggattaaaatctgaactccttaaggtggcataagaggcccttcactcttggctgtggtgtagcccttcccacacccaggtactcttcaccctgaggagctacactcctcacaggttgtgggattggtcatacactggcaggaatctgtgccttccctataggaaagtctttactctgaaatgcctctctttgatgcctaccattcccccttccacactccaacatttctatttacttttgtactttagagctttagaacatgtaagtgctcaataaatgttgaatgaatgtttgtggtatttaaaggaggggtagctgagtatggttgtgtccaccaaagagtaccatgaggaagaagaggaggtgcactgtgctatggagtgggcggtagggatggaatgagggggccttccttggcaaaacagcaatagagtaggaataggaattcctgtagccacatcatccaggaaggagagttgtgatggagaggtgttttctgaggctgaatacatgcttgcaggagccagcagtttggaaaagactgggactgtttttgttgtacagtgagaagtaatatatacctgctaacttagaggaattactaggaagctctaagaacagaaaaacagacaaagacacaccagctaagcctccaaatatatcagactcaatacatagtaaagaaaaggtgttttgaaaatagttttaaccataaaactattaactccatactttttttattttttattttttttttagtatttactgatcattcttgggtgtttcttggagagggggatttggcagggtcataggacaatagtggagggaaggtcagcagataaacatgtgaacaaaggtctctggttttcctaggcagagggccctgccgccttccgcagtgtttgtgtccctgggtacttgagattagggagtggtgatgactcttaaggagtatgctgccttcaagcatctgtttaacaaagcacgtcttgcaccgcccttaatccatttaacccttagtggacacagcacatgtttcggagagcacggggttgagggtaaggttatagattaacagcatcccaaggcagaagaatttttcttagtacagaacaaaatggagtctcctatgtctacttctttctacacagacacagtaacaatctgatctctctttcttttccccacattgcccccttttctatttgacaaaactgccctcgtcatcatggcccgttgtcaatgagctgttgggtacacctcccagacagggtggtggccgggtgggggctgccccccacctcccggatggggcggctgctgggcggaggggctcctcacttctcagacggggcggccggtcagagacgctcctcaccttccagatggggtggcggcggggcagagacactcctcagatcccagactgggttgcggccaggcagaggcgctccctacatcccagatggggcggcggggcagaggggctccccacaccccagaccatgggcggccaggcagagacgctcctcacttcccagacggggtggcggccggacagaggctgcaatctctgcactttgggaggccaaggcaggcggctgggaggtggaggttgtagtgagcctagatcaggccattgcactccagcctgggcaacattgagcactgagtgagcgcgactccgtctgccatcccggcacctcgggaggctgaggctggcagatcactcgcggtcaggagctggagaccagcccggccaacactgcgaaaccccatctccaccaaaaaatacgaaaaccagtcaggcgtggcggcgcgcgcctgcaatcccaggcattgggcaggctgaggcaggagaatcaggcagggaggttgcagtgagttgagatggcggcagtatggtccagcctcggctcggcatcagagggagaccgtgcaaaggggagagggggagggggagggggaggggcatactttttaattaaattttattttccatttatacatacatgactgaaattgcctagaaaaatacctttgattcagaactaaaactgctttatcatagcttttgttgtagtttaacattaataaaaatgcagtttttattaatacaaaaactgcattaatatcaattacggttttattctattgtgttgaatacccaagttatttcttagctagattttaaacattcactaggttccttttactcattccattgtttctatctttattgacctccattagtgctaagaattaacttagatctactttctatgaatagaggtctgttttgacacttaatagattgtagaaatcaatggccctgaaatagtttacaaaacaatttcatacctgtaagctcatggaatcctcacaacaaattcagaaatatgacagaacacagtttactcatttataatacaatcttaataatggcaccctacacaagatatccaacttgggaagtgataaatgaaagtatctctgtttgcagatgacatgatcttatatgtagaaaacaataaagactccaccaaaaaatggttagaactaataagcaaattcagcaaagctgcatgatacaaaaccaacatgcgaacatcagttgcattgctatacatgaacaattatcaatctgaaaatgaaattaagaaaacaatactacttatagtactatcaaaaggaaataaggatacttaaggataaacttaaggatccttaaggataaaatacttaaggataaacttaaggatccttaaggataaaatacttaaggataaacttaaggatccttaaggataaaatacttaaggataaacttaaggatacttaaggataaaatacttaaggataaacttagggatccttaaggataagatacttaaggataaacttaaccaaaaggcaaaagacttgtacattgaaaactgcagacattgctgaaagaaattaaagatacaagtaaatggaaggaaatctcataccatggattagaagacaagattgttaaaatgtttatactactcaaagtgatctagagatccagtgcaatacctatcaaaatcccaatgggatttttttattttgcagaagtagaaaaaattctaaaatggatgtgggatctcaaaggatcctgaatagccaaaacaatcttgaaaaagaaggacaaagttggaggcttcatacttcctgatttcaaacatgttactaagcttcagtaatcaaaacagtatgttaccggcatgaagacagacatatggaacaatggaacagaatagagagccaaggaacaaatcctcgtgtatacggtcagatggtcttcaatgagctcatcaagactacataatgagaaaacgacagtctcctcaataaatgggaaaactggatatttacataccagtgaatgaagttggatccttgccttatgccacatataaaaataactcaaaatggataaaatagctgaatgtaagacctgaaaactataaaatttctggaaggaaacaggagaaaagcttaatgacattggatttgcaaaaatttatttgatatgacatgcaaaacacaggcagcaaagcaaaaatagacaaatgggactacatcaaacttaaaaactcctacacagcaaaggaaactgtcaagattgaaaaagcaacctatgaaatggaagaaaatatatgcaaaccatacatcagataaatggttaatatctagaatatataagaacttctacaacttaacaacaacaacacaaacaaattgcctgatttaaaaacatgggcaaaagacttgaatagatatttcttcaaagaagatatacaaatggccaagaagtatatgaaaagatgcttggtatcactaattatcaggaaaatgcaaataaaaaccacaatgagatatcacctcatattcataggggtggtcattaccaaaaacaaacaaacaaacaacaaaacaagaagtcttggcaatgatgtggagaaattggaacacttgtgtattgttgatgggaataaaaaacagtgcagctgctatggaaaacagaatggaagttcctaaaaaagattataaatagaattgtcatataatccagcaattctacttcttagtatatctctaaaaggattaaagccaagagctcaaagagatttgcaccccaagttcattgttgtgtcagtcacactagccaagaggtaaaagcaacctaaatgtccattgatgatgagtgaaagcatgaagaaaacgtggtatatacataaagtagaatactatttagccttaaaaaagaaggaaatcttgttatatgctacaacgtgtgtgagccttgaggtcattatgctaagtgaaataagccaatcacaaaaagacaaattcgacatgattccacttccatgaggtatccaaagaagtcaaactcatagtcacagaaagtagaatgatgactgtcagtggctgggggggagggggaaatggggaggttgttgcttaattgatatagaatttcagttttgcaagatgaaaaagatgtggagacccattacacaacatgtacatagaaaaaacactaatgtgttacctcttaacacattaagaagttattttttatcacttaaaaatggttaagatggtaaattttatgttgtgtttttttaccacaataaaaaaacatgctacctcatggggatatcataggattacagagataatgtatataaagcacttgactcattatatgcacttccacattagctattattattgctacaaattaatcaactcaagcctaaggatgataagtgactttctcaaggttccacaactactaaatggcagcactgaccatcaagtcaggttttctcactctagagctcatagattttctactgttccttgcttcctaaaactgaaactttctttcatatggcaaaaatttacaccctgggatccccaaccaaaatttcaaaatcactagtctgtttcttactaaacatacatataaaatagatgatctacttttaagtctatgctgcttttctaatgtaaacttttttatcactcactttaccttttgggggatatatattcattttccccaaatctttcaccttatttgaccccatccttattccaatctcttgggcagccgttcttagtccattatagtgccttaggacaagcagatgtttaggttttaactattaaataaatctttagtcttgaaatctggttttgccattgaaactagccagggagttggaccaacaaagaaaaacccaagtgagtgaggattatgtctgttgtgttcaatgttgaattctcagggctttatgtggtgctgtattaatggatgagtaagtaaaagaaaggtaagtgctatctgaaagagagtcctagattatctgagctggaaagtaatccaaggtcacctgtaactactcagtagaagagctaatctcaaaacatatttctacttaatactatcccactcataagtgatactgatcagttactctgtgtcgtttacataagatgtgttcttgaaagacataattttgtctatctctttttatgaagacactaatgaaacatttcttcagacagtgatgaaacagttctttgaatctaacatactcttggtttttgtcaccaggtaaaatgtttcatttgattctaagccataaagactcttctcaacccaattggtatagtttaaaggcaaaaatcatttcagaggaaatatggtgtttctcagaacatcagtagagattgtgccaagcttttccttaaaattttttggtaagtgtagtcaaatgggtgtaggggatggtggtgaggggggagatgggaagtttttaatcaagggatcacactgatgagtggtatgatccagaaatgtcttttctagcaccaaagttaggattaactggagaagcaagatgctggaggcaggaagaccagaaaaatagttcattgcaatagttcatgtgggaagtgagactactgcaaaacaggtcaatggcagaaacaaaaaggaggaataagatgttataaattgaggctcgtttacattcttgaaggcagggcccaagtcttacacctgcagcactaacacaatgccttcttgctggcagggactcaatttatagatgttttatgaatttatgaaccgattgaaagtgaggccaaggaaaaacagggattacaacatgacttcattatttaattatttttcctagttaaggaagagtggtggcttctttaagaagttagaaatctggaactaggactttgaaagaggacaagagtgaagttccaggagtggggctgagtgcagaaagagattaggatatgactaggagaaagctgaattccttgacatggacaagattgtagagggctggtttaggaagaaaagagaaaaagttaacgtgtagatctttggggaaagtacatatagaagaagaggaagaaagaagaaaattgagcagtgaaaaccaaaagtaattccataagggtatatatcctagggaagaaagaatttcaggaaggaatcagtggtcaaaaactatcaaactctgaagaagagattgaaatgtttaagagaaaggaatgaatttataccaactgcagaagatggctgtaatttaatttctaaaagtaatacattcagtaatgcaacaacgttgaagaaagctattgagtagctattgtgagccagagtggttgtaacgcactgtcctcactgtccgcaagggattgaagaccagttgattcctgctgttacctcaagatcaagcattgaagccatcccagcatcagaggactcaagataataaggattgctcttcccctgtatccacatagatgcactttcctaactggcttccttatgctcagcattagaccaccatattgctaaggaaacagggggatgccaaggaagactgttgctgaaagcttctgatttagcactccaaagtttggaaatctttgcatatgtacaaaggcttaagaggattaaccaggatgaaaaactgaggtctgctattcagcacaggagattttcctcaaaatctctaacactcacgcagccatgcgtttccaccgaacccagggaactcctcgcacctggtccttccttattcctctccacagaaacactaacaaggcgtttgaggagggtcctgcttgctaccaagtcagaagagaatgcaaatcagattcctgccaaagattttggatcatgccttactggccagccataaattctgtcttctgaaaggaatgatatgattcattctcagcaatctgaagcattcaataatagagtgattcaatcttcaaaaatcaaaaggcacttcgggttccccaaaatgcccaagagaaagcacaaattactcacgatttgtaataaaaacagtacgttttcataattttaagaggctagaatgagctttaagagagcaagatatatgcattatgtatttatgtaaactgatttggggggtggattttttgcccccagttgggtcatttctgtaccttctcattcaaactgtgagattagcctgatgttcatttaccaacggaacatccacctgcccaagcacacctgctgctcttaggacataagctgctaatgcaatgtttcttaaatgtgcacatgcattagaatcacctggaggcctggccaaagcacagatcactgtgccccacccacagagtttccgatttaggaagtctggaggggacccaagaatttgcatttggagcaatttctcatgtcagaggtttccagacttccttggctcctggtgtcctcaaggcctcagtagtttttgcacagtgcccttcgacagggctaccagacttttctggtaactctgtttctaggccaaaagaaatacctaacagttgcatttattaagtacatagaccgaaacacctggagaagtatttatgtcctaacaacttagcagctatttttaaaaacacccttaaattgaaagaaaaataatattttatttcattaataataaccacaattacttaataatgagatgtctgcactggctggacactgcacagtttctcaaacctgggaatcagatgggttattgccagccttattttctgttccacattgattttcacatagcacctgctttttatcacagcatctgccaaaaatccagctagatatggcctcatggaaaggaatgttgttgacaggacctcatgttgaaagcaggaactactttggactagtagtttgctcagtgtctgacagatgtccagtgttgcttgtgagcctctcaagaatttaaaaaatatcccaagcctcctgtgtgagtttgctacagtgccccagagtgccctggtgcacatttggggaactggggactcaagcattcctgatgctagtttgaagacgccactttgaaaaccactgtactaatggcttcaagagaccagaggaaggagttttctgaacatttttacattttctgtgataatacataagatccttaaaatattgaacaggaagaaatgcagataaaaacatacaaattcaccactaatgactttttatttctatagcagaagaactggatatggaagaaatcagagaaggaataaagatatcagaaggagttgtatgccatcattgttatgaatagtttacaaagcaattttttacaaccttctaaagtcataactaattaaacctggcaatcccagtgagccaggtaacaattattttccatgctttacacacaggaaactgatatataagattaggtgacttgcctcaggccaaagagaggtagatttgttggaggcagaatgctaaaatcacagtatttttgctttcatcaaaaaaagttataagaaactagactaacatttcataacattaaaaaagtccctcaaacttcatagttaattttcacgaaaatcatgtaaggtggatgaacattgagtagcaccattttactaatgagaactccatggccagttgcggccttgtgcaaggggaatgtcagtgaagcatttgagagagcccatgagtggaagagagcagatggcatgatgagtgtgaagacacagagttacaggaagaggaaggctggttcttacctttgaaaatagctgggactctgttcctgtatcctcaggagcattttctcaaaagaacaaaattcaaagtcacttgaggacaaaggggcagaaaactcagcttatgaccagaaaagcgggtaccagtcagtagttctccatctcgaggggtagatgttctgcatctgtttgatgaaatcattacttcactgggggctggaaccaagaggttcaagagggtctattcagacacagccagtctggcatatttttctatttgtacgtatgctataagccacatatgtacacagatatgatcatacatatctttggctcatccacagtgcctgggacagtgagggcctggtgcatttgatgcaggatttttcttggccccttcaacagactcatagaaggggcaccccacctattcggtctgccatgctcaaccccttgcaggagggagcacgtgagcaagcaagtgcaagatccggctggctgctccggctgctgacacaggagcaacttctgtgcagggcctgcatccagaccaggtgtgtcaccttgaggggaatgcagcaacacccaggtaaggatgactgcaaccctaagccccagagggggtgttacagtgctcctttagttctgccatctgcagacttgtattaacagctcagttggccccttgcctcatcgtgtggggtggctgctctgccaacaagggcaaagggctggtgttacagcctttctgagtacctgcacttgatgggtcctgagctcttgtccagcatccaagacaaaggagatcatgtgaacaactgaaggatggtgaaggcagagaatttttattaagggctgaaaatggctctgggtggagaggagaactggagaagggacaggaagggcaggtcgtcttccctgaagtcaggttgtccctctccctgcagtcaggctgtcgtctcctctaatgactgagtctggggtctttataagcacaggatggggagtgcatactgattggtttgtgagtatgcaaaaaaggttaaagcgaagataccactcaaaggtgggcctgacagtgtagaaaaccaattaggaaagggtaggtatatgtaaaatagatgaagggtggggatccatcagaggaaagcacaccaaacaggaagacaagctctcagtccaatccgaggatttaacttgtagcttgactttcaggctttaaactctctttggcttggagttggggtttcacccagtacctgcccctatctgctgaggcatttggctgcctcctgtcgctatcacattgagcagtgcttgatatgttactgaagtgccaggggtttggtctaggtcttgctgttctcagcacagaatgtcaatcactgagacaacaagtattgccagagaagaaggctttaatcaggtgttgcagccaaggagaatgggagatttagtctcaaatccatctcagtaatggactaaaattgggaggtttatacaggaaaacagggaattagggaggaacaaggaagcaatcatgatgaatgaggggtcttgtatctcattgtctggatgtagtgattgagtgagtttcattcccttgagtgagggttgatttcctgaggaaggcactcagaatagacaagtgtaagtttctagttttaattcagagggtcaatttctatgtttattcaaaaacattcaaatatcatttctatgggacaattgggctggtttcagatacacgtcgtcaaagtttttggagcatgactgcaagattctggaggagaagagaagagatgagagattataaattgagtgattgtgttttcacctgtcctgggatatataagatttaatacactaaccagtgatctagatgactaaacagagtacagtatccctctgtatctgagggttcttccccacttgtgagtcaacaaatcccagataaaaatatttgaaaaaaaattaaaaataaaagaataaccgtacaacaataaaagaaatttttaaatacaagaattatttacatagcttatttatttatttatttaattttgaagacagagtcttgctctgtcaccaaggctggagtgcagtggcgtgatctcggctcactgcaacctccacctcccgggttcaagtgatcctcctgcttcagcctaccaagtagctgggattacaggcacacaccaccatgcccaactaatttttgtatttttagtatagacagggtttcaccatgttggccaggctggcctcgaactcctgacctaaggtgatccacccatcttggcctcccaaagtgcttggattacaggcatgagccaccatgcctggcctatttacatagcatttacattgaagcaagtattacatgtaatctaaagatgatttaaaatatatgcgggatgtgctcggttacatgcaaatactatgccattttatatcagggacttgagcatctgcagattttagaatgggtgaggggagcctggaaccaatcccctgtggataccaagggatgaccctatatactaaaatgacactgaatcatgaaactgttaaaatctttaaagtttcaggtaaaccttagtcatctggaaaagttatgggaatgccccggacctgcagtcagaaacagagactgcagtttgtgccccagctttctccctgctggccatgtgaccaaggccattctttaacagttagttttctaagatgtgggtctaaatagagctccaaagtgagatggtaaatgtgaacgcatgccacaagtttttattatgttaccttcaactcaagatgatgcgcatggcccaaaccacaactcccccaaatctgcccctcctccagtccctcattcataatgtagggttctctaatgccctagcctgcagggcagtgaggccagcctgagtaagccctcatgtgtgttataggagtcccaggactacgaagcaccagagctcatacccagtctaaagaaagccactcagccaccacccatgtgccaggcctgagcctcgtctccctggtgccttgtgcaatgtatggcacagtgagagcctggccctgctgtcctgaaaatcttcaccctgtccagggccttatgcaccgatggctgccaagtcagcagcttgagggcctgaccagcccctcatctccactcccagcccattgccattgagactttcttcactgtgtctcacccttgagataaacttgaagttacaactgtcctttatcactcactcagccaactgaggagtgtcctgagatgcaggactttaagttttaaaactgggatggtaggtcatcctatatatagcccaacttaaactctatctccttctaagctagtgtcccaatctctccagttggaaataagtattattttctctcttctttatatgcccacaacattctgactatgcccgtatcttggcacttcacaggtattagagttctttcccaagtgtttctgcttccttcaccaggttcttagcatcttgcagttatggttcttccatcctcctcagtgcctcgctggcactttgcacatcaggggtacttaagagtactttgcataaactgaacaaattaatcattcaaacataaaatgagtaaagaccgaccttacgtgtcataatggactaagtaaacagtgttttagaagagataatgtgattctcagatgaatcaacatgaggataacaggaaataggctgagatttcagcaaaagagaattcttgtgcatcagaaagcagcccttgaccggaaagggtgatgaaaaaaagtggatatagcttacaaaagaagattatgaaagctccactctcaaaatcattcagcagtatcccagcattcatgaatgtttgtttaaaatgaagatttttctgaaataaagggctgggcaaagtaatgttggaggcagtgttcaggcaggctgcctccaggaaacccagggtgccaggatgagtattctccctatttctaccagagcagccacgcctcttcttctttctaaccaaggtaggatgtgcatgtactggctttttcctgtccaagttgtggctgtttaggtttagaagtcaagagcgtgacagtaaaactaactagctgcagatgatgatcttatgttgcagctgaatacttttccaatacaagatttatctggggacataagactcagtgaattaccatttgccatggtcttcactggagaacgatggctacaatctccttcttccccatgtggactgaccatctgctcccaataattgcaaattcgcttccaggcctcataatgtctccctgtgttcttgcttgtctttgaaatgcctcaggcaactgctcttctctccaatggagcagccacaacagctgtgggattcactagggtttgtctctgctccatttctggcagcaggcaaccaccactaagccactctccaaaaaagcctgcaaattgtgaacccattaaggtttaactcctgggggacaacaaagagagctgcctttgaatgtgagctctgtgtgcctcactgaggcttctggcacaggggcttgtcctcagggccagggtgatgcgtagggaaagttacaagcttctgagggaatattttcacaggttttccaaacaaagggttctttcttccaaccccatacaactctcttctgattgctaattaaccaaagctagtgaaaaacaggccatttctgtaaatagactagaagtagtgtgtgtgtgtggtgtgtgtgcacgcgtgcactcgcgtgtccatgcctggcacgggtgatgtgacttttagtatttttcgtctttgtttgtgtttgttcaagcagaccatgaaatgaatgaaagtctgttttgagttcgacaagagataaagggatgttacagggcatcttgtccttctggtaatttttccagtgctcacgcagtcttgcggttgtcctggcaaatcgaatatgttaagtgttttgctttaagttgccctctttcctcttaagttgagagtttccacagtcttcaccatagggtcggttttggtctgtgtcatctcagtgtcctggccgtatctcaactgtcttcccctgtttacttccatggagtcgctatttaggaagtcccttttcagcccatctgccttaaatcactgcattgtttactttcccaccaaggagttttccctccgttggttgcatgccttttagattgagtatgcatttgaagatctagaagcccatacaggctgctggcaatttttattcaggctgcttcaccacttggtgcagtcttccacctagtcaaagcctgccagagtctgctggccttttggaatggttgctgaagtcttcaaagccctacttcttttaactttgcttttgtggttacatatgagtagtttcataagttttgcaatttggtatcttggagttttgaaacaatgttgcattttgattattttatccacaattatgatacttactgtgaggttacgtaccaattagatccttgtcttactcgtgtctaatcaatatttcttatttgttttaattctggcctttttggttatcagactctacgtgatgggggaaaaaagctcttcacaggcctctagtggacatgtagtggaactgcagaaatcttgtattcgaaggtgtaaaactgtggtgtgacccatgtccgaattagcaatcacaaacatgttattcatttagtatttaatttaaagataaatagtatgcttggaagcaaggaagatagggatactggtggaatcaaactcttggttgactaaccacagaatatgaccaggttgtccactgtcgcctgttgtcctctgaactgagtttctttcactaaggagtccacacagtctctgttttataacaggagctcaattttaacttccaaaaaaaaaacactgtaaatgaactgtactcttaattcattttttatcaatgatttttatgaagaatgcctgatattttaatagattcatagtttaaataagaaacaatcagtatgaatgtttcttctcaaaagagttgaaaataatatgtctctataaagaaatacatgggggagtaatgtggtccagaggcaacctcagccttcgccagaggctgcaatccaccagaatccactggggctccctcccagccttcagtgattttccatgagcactccatgtactcttcatgcttctgtgccatgcttttatgttgcctttgcctgaaataactcctcccttccaccacttccccacctggcaaaattcttcatgtccttacaaatccaagtcaaatgttcttttttatttgcatctcccttcccccaccacgcaactgttaaaaactgctctgcgttgtttcgttttacgatcgcacattcaatctatcattatgttcatttgtaaagggcctgtctctttcttctgatgggctttgagcttctcacatgttgtcaggatggtgttgtgctttgcagtattctcctcatcactttaacctcagtacctgacacagctcctggcatctagtaaagactttttcaattaactgatactccttatggtgcttgtcctaggaaaaaatgggagtgagggaagtgtgcctcattttgtctttggtatctaggtttgcatccagcatcttgcctccctgttgtaccccctccatagtcatgtccaagttaaagtggtcctaataccctaaattacctttttcagggtatttggagtataaaccttatctcaaatttaaaatgaaatgctttgccctagtgttaaacaagaacaggaatttcaagcaattaggctgatgagagagtagtttgggggaatggaatgcctagctctaaatatagagttaatgactgtctcttttccctaagaattggactagcttcactatttgtagaggaagtttccatgcctccttttagatttaacttacaaagtattttcaaggtattgatatggaaagtagttctggaacaaattaggtatctgtttaaatccacatatggttgaactacctgggatcgtattttagctatctatgaggacattgagattctgatgagtccatcactgccagcagaccttgaactaagatagaaaagactaacgatggaactttaagggaatggctttatggctagagatctgatgttacttcacatcagagggctgagcaaagctcgcaggttgtagatgagaccaattcaaagcaactggtcactgaggcattttgttatggccatttaaaggttaggaatgaagtttgctttgctgaaaacactcagtttggttttgcttaattttctctggggcagaggttcttaatctggtgacttctctttaaaacttcagaaattataagaacgaatgaatatacatatgccatatgtttaatggagagaaatgtgttaagatccctaaaaatctttaaaaacagttaagaagtactgttttaagagaaagatagatgttttatagtatgagtcaagttaatagactttttacctaaacatcgcttggactagcctgaatattacattttcatttattgtccaattgtctgtttatgaaatgttcttatctgaataatagaagtaaatttgaggccgggtgtggtggcccatgcctgtaatcccagcactttgggaggtcgaggtgggcagatcacctgagatcaggagttcaagaccagcctggccaacatggtgaaaccctgtctctactaaaaataaaaaaattagcgaggtgtggtgatgcatgactataatcccagctactcaggaggccaaggcagcagaatcacttgaactcaggaggtggaggttgcagtgaaccatgatcgtgccactgaactccagcctgggcgacaaaacaatattcatctaaaaaaaaaaaaaaaaaaagaactaaatttgaaagctattgttcaagtatcctaacacttatggcaatagctggcagtagacttttactaaagacttcctgtacttttatgagccaaaaatgaaggaatgattagttggggcaaaagaacaacttatttataaaaaaatgaaaaagcacaaataaagtttgtctctaagaagaaactgcttggagcttgcattagtttgctcaggctgccgtaacaaaatgccatagactgagtggcttaaacaacagaaatttgttttctcacagttctggaggatggaagtctgatatcagcatgccagcatggttgggttctggtgagggctctatgcctggcttgcagatggccgccttcttgctgtgccctcacatggtggagggagggcaagctctctgatgtctcttcttataaggacttaactaaccccatcatgagggccctacctcatctaaccctaattacctccaaaagatcccatctttaaggatgcagtcacactggggattaaggctttaacatatgaatttgaggaggagacacacttcagtccatatcagagcttaatccatttggtgcaagtgttacttcagttatgtagttttctaaatttgtaattaaatgttactattagaaggaaatcacatattaatacgaagagttgttttttttttaattaaggaaaagatttaaagagcacaaagcagtattttatgaaacataaaaaatatatcaaagatcattgtgccaaggaaatgagaaagctaggtgtttaatacctctacgtttatgatacagtgatacttcgcttatccaaaattctgctctgtggtagcatgagctatacagaaaagacctaaaaacaagcagcataaatattatgtaccaaagctcttctgttttattcataggacagttcctggcatctttacaactaggtttatttactcttactttacacgtaatcctaacaagctttgtttctaggactttagagaattaaaaaataaaagttagaaggaacagggggactgcagatgtacagacggcggccagaagtggtgactgacttgttgatagcaatagaggagaagaaaataactgtaaaaaaccagtctggctcaaagaccctgcacagctgcctgaggtcaggaatggccctatttcccatgtatttcccagtttctggcatagcacttggtatatgtttgttgaatgaatgaatgttttatttggtaccaagaacatcacagtacagtgtctgatattcataatgttgatcttcagtgattaagaatatattaaattatttatgtatattccgtttagaaagaaagaaatatatctatttttaaaatattgtcatccaaaaaagttatttttttttaagttcagatattctaatgttatatttttaggtacacacacacacacaaaatcctgttatcctgaaatacctcattcctgaaatattcaggttttactgtcatttgttcctgaaaagaacgggatgatgtaggcaactgtccaactgctgaatcaaaggtcggttatgcttagaaaagcatagttacgagaggaaaatgtacaaagatggtgatgttttacatctcatttgtgttctagtcaatattgctgatgttgttttctgaaggaacagagacccattcaaactggctgaagtactaatggtggatgtagtagtcaattagctattgacaaaatattctaatgtaactctttttggcatgtggtgagattatatttcctctttgatatgaggcatggctatgtgactagctttggctgctgaaatgtgagtagaagttacatgaatcacatccaggtagaagatttaaaagccagtgtgtgactgccatgtttccttcctgtaactgtggtgagactgttgagatgaagtctccatcacgctgtgtccttgagggagtaatatgggctgagcctcactgccaacccttagtggccacaaagagtgataagtacacttgtgttgtatgaagctgctgagacttgggagctatttgttactgaagcataacttagcctatcctgactaatacagactttattgtaaagatacagtactattccccaaatctaagactaggaaagaaaatacagctggggcttgtggcaactgaaatgaaatcctgaaaagatgagagcattatctccatcctatggctacctggtgtttcctacctttgtttctcccctcaagttgtgtattactcttaactagtcaagctgctttctcagcctgcacattatcaagtgtaactgctctcttttctccctaccagggattcaaactgttttgggtcacccaattcaggttccccagagtaggaatctattggctcaatcaagcctatattagggcctcttggatcaggtgtcctcccctactgtaatcaactgtggccatcactcaccaaacctgtgatctagggaattcctaaagctagggagaataatggttaatatttagtgatcatttaatatgtagtaggcactgttctaagtgcttacatgtgtgaacttatttgctctggcaaccaccatatgacataaatattattattattattctcattttataaatgtacaaactgaagcacaaagaaactaagtaaattgctcagggcatacttacaagatagaggcaggatttgaacacaaggcagtgtggctccagagcccacacttttaactactatacatagaattatatatatatatatattgagatggagttttgctcttgttgcccaggctggactgcagtggcacaatctcagctcactgcaacctccacctcccaggttcaagcaattctcctgcctcagcctcccgagtagctgggattacaggcacccaccacctcacctggctaatttttgtatgtttagtagagatggggtttcactgcattggccaggctggtctcgaactcctgacatcaggtgatccacccacctcggcctcccaaagtgctgggattacaggcatgagccaccgtgcctggccataattgtatttttaagtgtatttcgcctatacaaccagaagtgtcttacatatgagcttctaaaatgtctccaggttgctttcagttttgttttatgacagcagtgtaaaaacatcattcttgaaggaccaaagtgggacttctctataaccatgtattgcctgagctgttgtcctcagataactcattaacatctttctccagactctcagacctgccagcacaggctgggtaatctaggacaagttggatgacttccaccaaagttgttcagctgactatcagatcttaactaaattaacaggtggtctgttttcagaaatgaaattcttcagtgatcctgagtagcagatggattcctaacccttcttttcctttgaaagttatcgtatttaccaatcacttaatttatcagcacttcacaggccagtggtccaacaagaaattaatccagtcttaggaaaagtcagcctgggaacaaataagaattacagcagttagtcacgaggacatgtttcttctgttctctctgtgacattatttgttacaaaaaggaattttgaacattttgctggttgctgaacatttcaaatggctgagaatctttagggccttgccatttacacattatgtgcatagaacatatagctatcttatttcttcttcatctctaacatagagggctgtgaagaaaaagaaaaatggaaacccaggagaagtagacatgatgtgtgtcgtaggaaaaggcaacagaaggtgctttgggaaatgttgtctatctgctaatattatatattggatgcttatgtagattgcacaggttctggaattcagaaggccccagagcttggcttaatgttctgctgttgctgtcttgaaattattaataatttgtaaaattgtagcaaaatacacataacataaagtttgccatctccatcacttttaagtgtacagtgcagtagtgttaaatctattcacattcttttgcaatcaatctccagatcttttttcaccttgcaaaactgaaactctatgcccattaaacaactctccaatctccattccgcaacctctggcacccaccatctgactttgtttcaatgagtttgacttctctaggtacctcatgcagtgtatcttcctgtgactggtatttttcacttagcctaatgttctcaagcttcactcatgtcgcagcataggtcagaatgccccttttttttttgagatggagtctcgctctgttgccaggctggagtgcagtggtgtgatctcggctcactgcaacctctacctcccgggttcaagcagttctcctgtctcagcctcctgagtagctaggactgcaggtgtgcaccaccacacccagctaatttttatatttttagttgagacagggtttcaccatgttggccaggatggtctcgatctcttgaccttgtgatctgtctgccttggctccccaaagtgctgggattacaggtgggagccaccgcacccagcctaatgcccttgctttttaaagctgagtaatatttcattgtatgtatataccacatttttttatccattcatctgatgggtacttgggttgcttctaccttttgggtattgagaataatgctgctatgaatgtgaatgtacaaatatctctttgagacagaagttatcaataattttttggcaagaggcctgtgttttcattttgcactgggatccacaagtcttatagccagtcctgcatggaggaatgggacgagagttagctggagacccaaggaggagctgagttggccgaacagaggaacaggaggagggatccactcagatgatcagcaggaacccaactcagagggaagagggggatgcatgtcaaagtaagactgatgcttttgcgctactgtcagtttgcagttctcataagttgcaaaagtttatgatgatgttagtctgccttaaaaagcaaggaaatgtttaccgtgctacaacatgggtgaagcttgaggacattatactaagtgaaataagccaatcacaaatggacaaacacttacatgaggcacctggagaagtcaaacttatagagacagaaaatccaacagtggtttccaggggctggcgaatagggaaagggggagttgttgttcagtggatacagtttcagttttgcaagatgaaaaagttctggagattggttgcataaatatatatttaatgctactgaaatgtacactttaaaattgttaacatggtacaatttttgttaggtttatttcaccacaatttttttttaagttgatgacgagtgttttcatttcagtagtccatctactactgaatactcttccagggcttatctatatggatatgggggtaagttaactattgtaatgaatgtaaggactattgtgaactcctctaactgctccaacgatattcagtaaatctctcatctgttcttgcagttctctataactttgtatccctccattcattttatagaaggcaaacattttctgttaatataaaaatgctattcttttgttgttctgaattatggaaacaattaatgacatagtgtaatccattagaatcagaacctggatgactttcagtcaactgttttctagagatatcaaatattaaatgcagcctttattttatttatttatttattttttgagatggaatcttgctctgttgcccaggctggagtgtagtggcacaatcttggctcactgcaacctccgcctcccaggttcaaacaattcttctgcctcagcctcccaagtggctgggactacaggcacccgccaccacacccggctaattttttgtatttttagtagagacgaggtttcactatgttggccaggctggtctcgaactcctgacctcatgatccacctgcctcagcctcccaaagtgctgggattacaggcgtgagccaccacgcctggcctaaatgcagtcatttttataagggatcatcttcacccttatagctaatattcattgtctacaaccagctgatactcattctctagaatctaaaataataaataattagagttatttccatgaatttcagatcaatgtgtttcatgaccctgaggaaattcattcccttattattgtgtaaagttttctagccattcagtttgctatatcagctagttttcacatgtgttctccatttgtatgattcaggtgttttatatttgaatgcctattatgtgccagcagtgctctacccactgaagatatatcaatgtccaaaacagaaaaacatccctgcctcatcaagtttttaatccaggaaaagacaggcattaaagccaaaaagtgagcaaccagtgtgaaggtgaaatgtgctgtggaagaaaaaagttaaagcaggaacaggcgtctgattgtaactttttgataaggtgctgtgggtatatcatggaaaagcgttcctctacccatcagtatttcagtctggaatctgcagttgtctatttttatacttttcttctcttttcttctttctttctttctttctttttttttttttgtttgtttttagagacaggattttgctttgtcgcccatggtggagtacagtggcgtgatcatagctcactgcaaccttgaactcctgggctcaagatcctcctgccttggcctcccaagtagctaggactacaggcatgcaccaccgtgcccaggggtcttgctatgttatccatgctggactcaaactcctggcctcaagtgatcctcccgcctctgcatcccaaagtgttaggattacagctgtgagccactgcacctgacctatttttttttttttttttttttttttttttgagaaggagtctcactctgtcgcccaggctggagtgcagtggtgcaatctcagctcactgcaagctccacctcctgcatccgacctatttttatacttgtttcattttgcactgggatccacaaatcatgtaaccagccctgcatgggggagcaggatgagagtcagctggagctctaaggaggcgctgagatggtcaagcagaggagcagcaagaggggttccctcaggatcagcaggaacccaactcaaagggaagaaagggacacacatcaaagaaagattggtgtctttgcagtacttttccctgctctacagtcatgccctggaactgtggcgtactgcatggtgaccgtctccctcagtccatggaaagttacttttatttatttattctgagatttatccaccccttagcatcttacatagtaccctgtaattgtatttcacaatagatatagtaaacacgattgttatatttttaaaattagaaagggaagacgccctgtagatttccagggcccttatttgtagagtcatccaagttctaggtttacctttaggttctcctttagaagaaataatcttacaggtattctctgttttttcagtgccgtgttgttcagcataaccaagcatagaatgatgtgacctaattcgtatttatcacagagtatccttccctgtctttttaatatcaaaatcttaatgctgagtttcacaaatatataaactactatctgttcttcacagacaactgaatgaaagatatgttacaataatgccatctgaatttatatagtactctgctgtgttaaggtatggcagcatttcttataatgttctatttaacaaggaggttaaacaggttcctatgagtcagacaaatgaagtgaaataggcatcataatgtaggaatagtgtgggctttggaattacatgctttggagtgagaactagatttgaatattgtcgtaccagacccctattcacttcagtagagatggcaccaggttcaagaggctgaaggagagactcaagagtcagcaaatgagacatagggtttattgagaagaacttacatgcagagtgttccagtggtggcaggctggacaggagcacggagaccaccttcagaaagcatgcaatttatgtaccattttcacttacccttcacctggaaaccttcacttaacccaaaacaaagggtctgactccccaggacagcccacattccatgggacaggccgtgggctcagatgttcctcatagataaggaatgaatctctggttggccactcctggattccttagcttggaactctgaacacgcattcctcttaaaccatagggtaactctcagggtgttgctcaagctaagctgttgctagcaggtatgtttgccatacagtaaaaagttggctacttccgtgtaacttttgacaccattgaaatctatgagcttttgttttctcctctgtaaagtggaataaaatgagatgtgtgtgaatttgtgtgtgtgtgtgtatgtgtgtgtaatatagtctgctccaagctttgccatgaagtagacactcagtaaatgttcatttcccttgtctttctcttttaaaataaatcactcgcctgatttacctgtcctgctagactgagggcttcctgttggaaagaaccgtgctttgtttatccttgccccagcagagactctgagcttatagttttttcagtaaagctgcatttaaaaaacaattttgagcttaacttttaaaatatttttcatgaaggtgtttatttctggcttggtgcattcttcccagagggagcatcactctcctcccttgctctcttggaggttttatcttgtatcttcctgttttggaagggctttctgatgccagcccagtgagctcatgcagcgctaagtggagaaggccaggccgcatggtcctccttgacctgagaaaatctaaggcccccttcccctgtgtgcttgcaccacacgtgcagtcagacatcacagcagccactctggcttcctgcccatgaaataaatgctctcagtctgacattgctcagtctgacaagagacatatttgacaggagcaggttggatggagagggttttgaagaggccaagcagtggaggtgaaaggcaggaggcaggaggtgctcacaccatggagtcacaagggtggggcagcctcctcactcatccccaagtggcatgtcagtacttagttggcacatgccatcaaaaacaatgagctgcaagagtagaaatgtctttcaaatttcatgtcctgtgggctatgataggtgtcatatggtgtcatgccagatccctattgactccagcagggatagtaccatgtccagaggccaaagaagagacctgaagccagccaacgagacatagggtttattggggggacttacatatggggcagtccagtgatagcagactacacaggaagaccactactgtttataaaaagcatgcagttatatagcatttttacttagcaccctccacctggcaacctccatttaacccaaaactaaaggccttgattccctgtatggcctgtgttccaagggatgggccagggattcgaatgtccctcatggataagaagtgaaactccaggttggccactctcagattccttagcttgggactccaaacacacattcttcttagacaatgcggtcattctcagggcatgcttcagttatggttgtcaggtgcctctcctatacatatggtcaaatgttaccaaccatatatttatttaaattttttattgccatagatttttggagaataggcggtgtttggttacatgagcaagttccttagtggtgatttgtgagattttggtgcacctgtcaccctagcagtatacactaaacccaatttgcagtcttttatccctcacctccttcccaccctttcccccagagtccccaaagtccattgtgtcattcttatgcctttgcatcctcatagctcagctcccacttataagtaagaatatatgatgtttggttttccattcctgagttacttcacttagattaatagtctctaatcccacccaggttgctgtgaatgccattaattcattcgttttatggatgagtagtattctatcgtatatatataccacagtttctttatccactcattgattgatgggcatttgggttggttccacatttttgcaattgcgaattttgctgctataaacatgcatatgcaagtatctttttcgtataatgacttcttttcctctcagtagatacccagtagtgagattgctgggtcaaatggcagttctacttttagttctttaaagaatctccacactgttttccagagtggttgtattagtttacattcccaccagcagcataaaagtgttcccttttcatcgcatccacgccaacatctatttattttttattttttttattatggccattcttgcaagagtaaggtggaatcacgttgtggttttaagatttgcattccctgatcattagtgatgttgagcatttttgtatacgtttgttggccatttgtatatcttcttttgagaattgtctattcatgtctttagcccactttttggtgggattgtttattttttcttgctaacttgtttgagtttgttgtagattctggatattagccctttgtcagatgtatagattgtgaagattttcttccattctgataccaaccatatttttgatcacaaaaagtttcctgttctatctatggttttaaaatggcctgcactcaaatacttcagggaaatgatactctgccttccttttaagatgcctagaaaatgagatttctctgcttgttctagtccccactccagtaactcttcagtcacatttaagccatgaagcagccacatctccaggtgatagaagtgaccttgaatatcatgagcattattatgtctgagcatcctggatccaaactctgaactacatcataatcaaaagaacagagtaaaaaaagttttcagtgtaaaaaataagtcatttgctatattacaaagtgaaagaatgtttataggttatgaggggatgctgtttggagagttgccagaggttgaaataggagatagatcttcactgtttttgctttgttttgtagaagtaaagcacttgttagcctttgagggttaagaccggctgggcagagcagagcccaagctgcaaggatggggccttcagcatgactccaacaaggcagaaacatgtctgcagatgaaacctcaggtcttgtaaggaagaatccttatgtgaaagcaagatcccaccagtcagagactagcaggctcagtgagaggtgcttatttccccccacccccccccccaagtactcattctattcctgaattttctgatgcacttacctctaagctgggcaaagcattttcttgttcactaaataaattattttgcaaggagcaacagtctatgtgtctgaggggaaaaactacagtagaacctaatgcttccaaaggacttaaacaagattctgtttccctggaaaccaagtcctttcctgctggttgtacacattttttgcaggagcacctgtgaaaggagatcagtagcatctgaatctcttgtcagtgatggcccccttgaaactcacaatgtctgtggtgttttgaagcacattctggttgttttagaaactcatacactgcacagcactgggaatatttggttttagctaccattgcaggggatgtgtgtgtgtgtgtgtgtgtgtgtgtgtgtgtgtgtgtatgtgtgcatgtgtgtgtgtatctgcatgtgtgtgtttgtgtgtaaggtgatggaaaagaaaatctgggatttattaaaagctaaggtctttaataagttctgaagtcactgaaaggttgtggagctggcagatgcacttatcactcggcgcggatgttcctgcatttggattactgggagcattatagtagagcagctaatcttttgtggccagtgctgcttgcctatgttgataagtgtgattaacaactttaaaagtcaaatacgttagcaaatgccttatagctgccaggaatgcttgtggccacccacgctttgcagcaaaatgagaagtcagtctcaggagcttaggattcctagactttttagataagtatgcctccaagtttggtttttaagtttatttcaacccagtcatgtaaagttattgttagaaagcagtcagatataaaaccaaaaaatgaagaatgtgctttttgtttgtgaggtttaaagagatgatgctcattacactttcagaatcctctttaagtctgctttctccttaaatttcaaagtgaactttaaaagagatgctagatttttagaatatttcatcgcacagtcgcttgtgatgcgaaccccgaatgaaagtgaaaactctagtgtatatatgatttgggtgaggccgggagaggtgaagtaatcttcaaaatagtggaagaaatccagcttagaaagtgatcagcctgccttgccacgtgacctggggctttgttctttccatactgcagcttccttgttgatgcccattagcatcttaattaaagcaggccctgtgctaagtgttataccaaggatttctggatttctctgcccaggattaaagataccaccattgaaaatttaaagtataagctttgatatacaggtaaaaggttagtagacagttggggtgaaaggacaagataagcacagaattagggtaatcaatcctgaagaacagcagtgccagttgcaagaggcaaatccaatcttgtcttgccatgagcacaatgcatgaaattggcttgccccagcaggtagtttatgctttctgcctcactgttgactttccctggtctgcggctgttgaatgccagaacttcacatactttctctacctcgagagagccagagtaggttccattccttggcaacagaaacaaagagcagactctctggaacatcagacttgtaggaaagatgctgatgtgatggagattttgtttatcccttatgtccttctgagcctctcttgtgaacatagttaattttgtactacatgattttgtcttctgttttcaatacgactccccagtgcatggttgactctttgccgacaagattttttttctcccccatttctctccctctccttttgggtaatataagccagagtgtataactcttagaattttacaaatattgacatagaaatcctatatgtgcagtgaaatgtccacagagataaggcattgccgacattttcaaactgtacctgatgtggaatgaaattcttagcattggaattttatgtacccagctggcattactgttacagttcattgtcagagccctcatgttacagatgtactgtctgatttttcttacggaacctttttggataaagggagttcaaaaaatcagggtcaataactcaactagcaagtacattgccttgatttgcttcaaaacaagaacgtagcagagataaggggtaggttgccttgatctaaaaacatgatggtttgacaaaactttcctttttaagcaatacttgctaacaaaaaggtgaaaatgtgtcattttataaggaaaggtaacttttttctcagaaaaagaaaggcaatttaataatagcagaaattagatgacagattgtcatacctgtttaggaatgtaaaattctggaaagggttttgcgaagagattgtttttcaaacacactataaacatgagtttctttggttctccacattacctggaatgcttgcgagtgaaattgagttggaggcatatgtagtagcctgagaacctgagaacctcaagttgcgacttgaaaataggctccatgaccctagagactggaaagtcccagagtcctcctcatgcacatctgcacctgcccacacctgcctgcaggacccctgaggattaatacatgttgctgctcatgtaggctctgggtgccagtgtgcccaagcaactcagtgtccaaatctgaaaggttgacatttctattgctgtaaataagaataattcaacagtagaaagtggctttattttctgcttaaaatgggagtagaaaacaaggcaggcatgctctggatatctgcacatatgctaaaggaacagttggtcacgaagtaagacacttaaattctacttaataaatgttttcatttatgagtttgtgcgggttcactcacccatcttttctaccacactgctcgggatgtaaagctattggagaggtacagagggacaaatctgtcagcttcagggggacaggtgagccaccccaaaaggcatgcttctgagtggtgctggttccttggtctggtcccctgaaaccacacttttgactaaaacagtcactggggttccactgagctaatttgttattagctttcttatttgtttatttgaaaatctccaagacatattgtccaatgaacagagtaagtctgagaataatacatatattatgattctgtttcagtgaaaagcaattcttatgggtgtataacatgggtatatatgtacaagtatgtatagacatatgtgtatattttacatacataagatatgtgtatgaatatgtgtcatacacacacacacacacacacatacacacacacacacacacacagagtcagctctctctgtccatggattccaaatctgtagattcaaccgggaattgaaaaatatgttattttaaaaattgtgtctatattgaacatgtacagacttctttcccttgtcattattccctcaacaatacacagtagaacaactgtgtacatagcatttacattgtactaggtattataagtaatttagtgatgatttaaggtatacaggaggatgtatgtaggttaaatgcaaatactatcccactttgaatcagggacttgagaatctgtggattttgatatctgtggggatcctggaaccaatcccccttggtgtctgatatcacagatatcaaaacccacatatataacaagtgtgttatatatgcataataagtttggaaggatacacaccaaactgttaatagtgactacttccaaggagacaagtgaaattagaagttaggaataaaaacaggcttttacttttttaggctatgcttctgcattatttaaatattttcaatgagcattatttggtatcattaaaatatttttaaaagatattttaaataatatttttattttaatatctttcatgttttatgtaatatttttattttaaaatatttttaaaataatatattaaagattttttattagctactagagtgtgttagatattctttgatttcactttgtgaagataaaaataatttactaaaaaggaatgatcctgtcctatacaataactatattttcatatttataatgatattcatagcataatgcaaataacgtatggtacatttccagtgagtttttgttttctcattcctttatgtcaagaaattggtgaatttcttggtatccaagatctaaaccaaaatatatgaccaaaagaaatggagaaatggtaacaacagggcttgaaatggccgattctgatgtggaggtgccctctttagaatgccagctaaactgttggtctaccagattttgaatggttgattagatgctagcagcatctgcaggatcgcttaacctaagtgttaaataacacacaatatcgcaccctatttgctcaagtatttcaaattgcaggcattaatacaattagcagttcttacagagaattcttaatttcttgatttgtggttaatcaaagtcaatcttttaagtgtagtcgtaatcacctatattttaaatcacctgtgttttattccattctaactatggaatgatagcatgtattgaatgcttatgctaagctctgtggcaagcattttatgtacattaacgcactaaatctgtgcaacaaccctaagatgtgtaccattattatctagtcaacaatgagagactgcaagtaacttgttcaaattcacacagcttgtaccgtcagagccaagattacaattcaggcatttgggcattaagtgcagtttttttattgcactgtaaagggagcacactcttatccatgaagtcatactgccctcactggctgtgaaatactgtgttcttcatttactcttgccggaatttgcaaattgtctgcaacctgctactttgtaagggctcctcccttgatgtgcagtaagttctgcttcctcagtgtgctctcccctctgcagagctgatgtttaatagacctggctctttgcaagaaagaaaacaaagtccccaaggagccatatttattgcctctaggatccttcctaccttgccccttcaaagaacactgcggctgttgtcgaccccagcgtctgctgttgaagctgcacacccactctgtgcatgaagctggaactggactctgtttttttgtttgtttgtttgtttttcaagacaggatcttggtctatcactggactggagtgcagtggcatgatcacagctcactgcagcctccacctcctaggctcaagtgatcctcccacctcagcctccccaatagctaaaattccaggtgcatgctgccatgcctggctaatttttattttttttgtgtggagacagggtgtctctgtgttgcctaggttggtcttgaactcctgggctcaagtgatcctcccacctcggtctcccaaagtgttgggagtgcacgtgagccactacagcttgtcttggactccgcttcttgtatatggtcattcaagatgtcctgtcattgaaaagaaagggaatgatgattgaaatatcggtccctcacttaaggatggcaggactgacgaccagcagatctgtcctaattgttgttgctgtgttcagtttatgaactttcactgcacttacacctagatattgcttggaatggttaattggcttcttaggccctggaatttggaaaaaaaaaagagagagagagagagaagattcagacatcatgctttttgctttgccatctggtataattcttaaaggcatttttaggtccccaatatgggtagtgttgctgtttgttcctttccaatgctgattggctcaggcacacaggttctgggcttttgattatgaaattgatcaaggctggatgaggcagatttctggcacctttgagtcagtggttgtaggcagagacaccatatacatttgcgtaggttgtacactgcacagctctaggttgtcctggtcctggggaacgcaggtgccaatatgggggtaacacacaagtcctgaggtccccacccatgcacattccactccccaatattttccttcctttgccataaattgaatctctgtctaaaacttctcttctaggcatacttcctgaccactagcaatctggtgcttatcaccaacatgtgacaacagtagtcttgtagctgtgtgtgtattttaaacggctgcaaaagtatttcactatgtggctgtaccataatttatttgtaagttctctattggtgagcactgaggtaatttgcaatcttttgcaatgaaagatgctgaaattaaaacttgaatatgtgtgtacacctgtctgcaaatacctccaggaaaaattcctccagatggaatttcctaagacatatctccctggactcacatgtctttctggttgcctctagcactcttcctgttttcaaccctgtcctcctagttcagccttcatgacctcttgctgaaataattgccatagcctcctgagtggagccatctgcctacgcttccctttagaatccatccttaacatggtttctagctctcaccgctcagactgtgttacacctgtgctctaaaacccccaagggttcataattgctacctgagctggtatgaactccccataccctctcccagcatccaaggccatcccatatatggttccgccccacctttgatgactcatttgcttgatttcccccacgtgttccctgtgcttcagcagcaccagaaggttcctgagtccccaagcttgccttgcctcctgtttctttgggtgccttagagctcactccctacttggaagtgtccttctctctcctgggtcctccctcatctctgcctgtgtaccctcatgctacaaccccgccatgttttctagattctcccactcccactccccaacctagactccttccacctcccactgtcctcatatcctgctttaggtgataatttcatttcatgtacccttgcagaccacctgtgccagagagagctggcagcacacatcctctgaagtggctagcacggaatgtcttgcacattttaggaggttttttaaaaggatttattagataagatcttcgcagttgacaaattctcttacccaaaattggcataatcctttagcttggggagaagagatcacacacatgaaactattatggaagtagggaatttcccaatatatttagtcaagagcacagaagctcattggcagtgaggtgccaggcagggtaggagcaggagcagcccctataatctgccttttgtgggcggggcagggtcacagatgcctgtcacacagcctgcatcgagcagggcctgctggattaaaaagctgacttctggccagctacagcaagcaaagacttgcaacaccatatgggaagaattgacccaacaatccatgtgctttcattaaagggatgtttacagacatcctggttcttgactcaagttcattgtcacagaatgacgttctcatggaggaagtgggaaaggggtggagttgaggggtgagtgtagaaagctggacgaaatcaggggaccctgaacaaaatctctcgtgttacttttcagttactcagaaagcctctctctctacaaatccctacaaggttgagacacacaggcactctcaaccttgaagtatctgattttacaacttcaaactcaggcttctcacaatactctatactccctctcttagagtgagtacctcttatctagttcaaagtctcattcattctcttatttgacagactccagttgtgtttttcttgcctttaaggagctcactgactaatggcagatgccagttctagggttctattgagtgagagtggaaggagaactaaggtatcaaacttttgctattcagccccactctgccctatgcttacttcgtattctccctcactgtggagttcaaacatttaaaatctgagtggctgttatcctcagcatgcactgtatactctgcaccttactcccggaatcctttcatctttagctctccttatcacaggcagtggtagtttggtatcatcctctgccagattaaacatgtatatttatttaatattctctctgttgttgaaaataacaatacgaatgttgcataataacaacaaagttctttatcatcttcatttgatctgctgtcatctgtgaggtctccagagcatactctgtgcctttcatgttcgaggacactgccgagaaataaaactgagactcgaatccagatcctgtgactgtgaatcctagtacagtattccaacatatagccttagtttaggaacactcactttttctattcatggtaaacgtgtggcctccactcactgataaggtgagattaccatcgagcatgcagtatacgaaagtctacaatgcattgtttgtcatgctcacttacagagcagactgattgttccacagtcacctgttcaaccccacttggtagtggttaacccagagaagcaactgcctctcatctggaacctgaaatgcatcccatgcattctcctgattcaccaagttcattggcagtgtaaatacaagcaaatcctgttgccaactgagggtgtaatgtcatcagaatgtgaaggatgacctgagttttttaaggatacacaattaaatgtgcactgattttgttatatcctattttggcattttctccttttctgttttctccttggaattggtttgcacagtattaacagattaaaaattatttatgggtgtgtgtgtgtgtgtgtgtgtgtgtgtgtttcagtcatgggcatcttctttcgagtcttattaggcatggaaaaacctaagcttggtttaaaacacttcttcccttcctgtgaagttttaggctaacttaaaatgggatgtgttatataaggaaggcacctgacactagcggtgggggtgcctaggagaaggagcaccccccttggtttgtgatagactggcagcgtttcctctggtatgtgccagagcggcagagccagttttaaaaagaggatttataggaaatccagctgtgagttttcgtttttttctcttagagctggaggcggggccaaaaccaacctcaaaccaggcacaccattgatcaggctagaatgatgtggaccagtctcacagacaacagccaagcacagaggaaatattagctggcagagataacgaagagaaaacactcggtgacagatgcaccatctgtcagtttctgaggagcagttttcaagaaagctgaaaatgaattgaagaagagaggggttttgtttgaaaggtacagcacagcctaaggacaattttaaacaaagtaagtttgtgttccatagaaaaagaggtcgtggtggtgggaaagacaacagttacttcctatgtagattgtgagttttgtcattgatataaaaagttttctttgtagtggacttgatatttacaacattctcttaacaagaacttgatttaaaattaaaaagcagtgactgtcattttggctactcactctagaaacatttgcaagttacagttagatttattttacttttatttaatctcagagagaattgttttatctcagactacagatatagataaggccttccttccttccttccttctctctctatttataacaatgggcaaaattatttgtatctttcctcaaaggcagtttattaagaaagcgacccacctttcagattgacgaggttggcagtaaatgctttgtattagcatgcttaattccatgggctacgttacttaaatagctatgaatatgacctggacttcctacgagccttccaaataatgttattggtgttgacatcatttttaaaggaagctgcttctggatcttctgtagtttatctttctcagaaagtctgttaccctctttcagaacataagctaccatatgaaacaatcctgctatttatgtttaatacatttttcaacggcttcgttttcaaagttggacttgggctgttggtaattgtatgttacatctaagtggtttgcgttcgatgtcatatgtcgcatgttttattaggccaggattcgtctaattccaaggggatctaaagcagtgattgagaatgataagattctatgagcgatagcagaaagttttcagggggctcacaggaggtcctttattggaaaaagtcaattcttttacaatttacacaggcggaaagggacttattttgcatctgcattagcaggctgtctagtccaaaccagaagtggaagcgctggctgtaaactcgccaaagtagaaaccactcagtgttatggcccaatatggatgtcagagctctggagcatgtgtgggaaaatggccacaggccaacgtctggaatcatttatcttccggtagagctgagaggagaactgttttatgcgttttgcagaaatccttgctgattgatttcatttacatagagctggtgcagagactgatggtgaggacaactataaatgggagagaaatattgatctatttctgcttttcctgacatcctggtctcattagtgttcttagcacctttgaatgagattatgccgttactgacaaccatatggtttctacggggttctttccacgcgtctcataagaaatgacacatttatgtcttttcttattggggaaatcagaaactgaaagttgaagattttgtcgtactgtcttttcattagcttagcctgtttcctacagtctaaatgtgaaaaatgagaggaaggaaatatcagtagacagagttctttgtacactctgtgcaacctatgtagtcattgagagatgtgcgtctgatactctttgtgaaatactggaacatactgttgttgtgtagattcatatctgcatgtgaaggaatcatctatgccaaccagtatgttctgcatgagctaaactcacatgtgctgacacatgctgacatgtgacaaggtagcatccgcacctgtttttctaatgtgtaaaagaattttgccagcttctgacagtacccacgtcagaccttatggagacgattttaattgatttcaaggaccgaggtaacagtcagaagccttggatttcagatactacctttatgctgcctaattttgtgaccttgaggaagatgattaaccttttgatgaatctaattcactgcttacaaatataatgaataattatagccatttttgtctcccagagatatttcaaatgtcagtaagacatttataatgcatcttgtgctattagcttttggtacgtatgccattaatgaaattgcctccactctcttagacagaacttctgcattacactgaaaaagctaaaaactttagcctttaaagttaaaacaaaattaaaaacaaaattctataatcttatgtagtaatacttttgtttataggaggctgctcttgaaggtatttgcatctattttttttctctttgtagaataactatttgattttctcatcaagattctcagcattgtgtaagactagtcatttcctcaaacaggttgaactttaaaaaatagggctaaaattggtgtgatgctgctttgatttagtatggttgaatatatgtaatttttaaacttcctaatgtaaaaaaaaatggataatagtgcagattaaggtacctaatattttctcacattttatagatacatagatataccatacaaataaatatatgctaatcttcatatatgcatatacccacacacatccacttcatctttcaaaataatccagtaaaactgatagcatagcagcatataagatatgaaaagataggagtgattactgtgttttcattttaaatccttttcattttacatgatgaacatgatcacagcttagtgtactgcaaaggacatcagaagccagacctgccagtacagagaatcaccacgcaccctgttctgtgaacacaggtgtgtggtggcccctagaatctcgaaatatggcagccttgggagccacgccattcaactgtgctcttccgctgcattgtgggaatcagaatgtgtgccttactgtagcacgaggtggttgggaggcccatatgacataatgtgcatgaaaatgctttgaaaactttcaggccatttaaagtcactaattgaacttcgacaacttctttgctgctggaatattcctttcttccctttcttaataaattctgcccgtcattcaaaggcttctcttagctcttttttgatctcaaaggtttctttggagcccccagaggtccctctcagaaagaggaagtgagcgaattttgccacccgtgtccctcctgccccacccaccagatgacttcactattacactccatgttttcacacctccacgctctgcccagttctgtccctgtgctctgctaaatgttttctctaccacttgccaacatcctcctcctcctccaaagctaccttaagcatcacttgcctttgaaaccttctccaccaccattctttcacagagctagagccttcttcattcatggttccaaacttctaatcaaggttttatcttattctacttcattctttatttacacatcttccttcctccctaggctccgcaaagacaggccaggtaccatgctgctttgactccctggtgctcgctgtagtttcttatgtctggttggtgttcaagtaatgtttgtcaagtgaatgagaaagtcagtctttccataccacttctttgtggggtcctgtcattacacaccttctgggacagaaccctggtacccatttttgtgtctggaataaattgtcccttatggcataacagcatatagactgttgtcagctgggaacctgagattgcaacaatgcaaaaccctacatctaatcaccagcagattaactattaacctactagtcctatctgaatcctactaatcatagttaggtaactaaacattaaaactatcatccatctgtctctattctgagagagccttggcatatctgtgactagctgtgttttaaaaagaaaatctgaccatctttttgaaaggcagtttggcagcatttatcaagatcctctgatccagtaattctcctaggaaactatcctaacgaaatggtttcataaaaatgtagacaaagctttctgaacaaagatgttcagcatgatattatttataaataatatgaaaaatggcaaataagtgaccagtattacttttataatcaaataaaaattcttaagaatccaaaggttgcctgacagattatgtactaattatgttgaccataaggcctccatttttaggttctttacacagaatcaaggatatacttggaacaatcaagttgagcaacttcttaccatgcttccaattttactactctcccttctgtttaaatttagaaaatgttgaaaataaggtaacctttgaggccagaatttgaaaattctttgacagaacaataatctgagtatcagaaggggcctagaaggcctgcctcaaccattttcatttaaaaattgactgcatggagagctggagattcaaactggtttaactttgctcttgagctgaggtttaaaacaggtaaaaagaaaatttgagtctacttgttcaaatactatgaagaaaactatgtaaattgtggaagttttttggcaatctctcatttaatctctttttacatggaataactggcagaggtaaagccatgttatcatagtagattctgcatgttacattgggataaaccacaggaataccggaaataatcactgacaaaaataggttcatgtagtcagttgaacacgggatttgatggggccatgccactgagatacatcatccatcaccacatctgtgctcagtgtgggagggtttctgtttccaattcttggaataatacttaaagtgcatccccactaataatgccacccgctgaagctctcggtacaggggccagagctaaggattgctagtgggcaggaacatttccatctcatcccaaaagtgcagagaagcacattgcttctttaagcatatttctattttttattttttatttttttatttttatttttatttgtttatttatttgtttatttttattttttatttttgagatagaatctcactctgtcacccaggctggagtgcagtggcacaatctcggctcactgcaagctccgcctcctgggttcacgccattctcccgcctcagcctcccgagtagctgggaccacaggcgcctgccaccatgcccggctaattttttgtatttttttttttagtagagacgggtttcaccgtgttagccaggatggtctcaatctcctgacctcgtgatctgcccaccttggcctcccaaagtgctgggattacaggcgtgagccaccatgcccggccctttaagcatgtttctaaatggtcctgttcagttgtgttccatgtgcaacaacagagtaagtgggtgcaagtcctctgcttcagagagttcactgtttaaaaggtgaaggagtgccaacttccaaagtgaatagaaacacaataatacatatatgggtaagtcccccagtagggcaacagccaagcacacatgcaatgtcggtggcagcaggttaggtgtggaaggagcaggggaaagtggagtcctgagaaattcactacagggaacttaagtgttaatgaccggagagtaccttgaagtggtctcgttgttggtgacgctttggaagactgaagcagacttcaaggggctggcacggtagctcctgccttgccaagggcttccacatacagatggtgggtggcacagggacgaataggtcatttacctgagcttgagctgagccaggctggttaggggagctagatgtgaatgacagagcaagcggctagctgaagaaagcttcactatcttccagccccaggaacccttaggggatggcagggaagggcatgagctgtgtcagcagaccacagggctagaaggcagcgtgtttggttaccttcagcctctgtggggcctccccaaagacctgtttattctgcactcagcaaagggcaagaggatcctatctgaatttgttgctcatgggcccagatttcaaacatgctctactgcctcagcaaagattatgccataaaagctacttggaattattggttctctactccccaaaggaaaacaatgatttagaacagtgtcctgagaaccgctgttcttcccacatgtgcttattatactgcatcctggaccattggtactgggcccggccaatgactggccatatatatacattacgagacatgcctaaggaggagaaacccagcaagcagatgagatacaatttctcaaactaaccataaattactccatgaaaagaacccttatgtaacactgaggcatcctgattagtgttctttgggccttgcaagtacctgaatgaaaccacaaaatagttaaacaacaatattgggaactcagtttcaataaaagctgtttatttttagctgaggatcaaactccaaaataagtgacctctctgtggcaggcattctagcagagcagaagttatttttatctttagagtttcttgtaaagtcttctgcttcatgttggcttaaactatagctttctgtttcttttcggttttgctgacattcacttatttggtgttggtgtattacttctacaaaggacctaaatgcttatctcactacagttctcctcctccaaaatgcacagctagtgacattgtatacttaatgccaacaaacatttattgagcatctactgtgtgaaaggaactatgaaaaggagacatataatgtcttttcaagaatattacagtcacgtcttggggacagatatggacacaattcaagaaagaatgatttttgttgtaatcaggggcttaaggcaatgtgctatggggcacatatttaaatccaattcaaagaatggaaaagctttatgcatgatatgaaatgtggcctggaaacatcaacagatttcagtagaaggtaaagtaggaaacagatgctcaagatcaaaggatgtatgtttaaaaacacaaagactttaagtgtgtaatgtgttcaaaaatagatgagtgaacctcagcgtgactataccttaggatgtatggagagatcactgcattgggaaaggcgattggaaaaggagatgggggctagaactttttaagggttttagatgctatttaataaatcatatgtagttactgacaaattatgaggaaggtggcgattttcaacttgtaatttaggatgaatattttggtagaaagtgcattagagaagatgcagtagcaccatttataggtccattgcaataacccacctgtccatttaagtatatattcattagatatctactgtgtgctaggcccaattttagactatagaggcacaggaatgagcaaaataggaaaacaaagtttcctgactcgtggggctcatgctcttgtggagaagacagagagtgaatagcataaataaatgaactatgtttattttagtgataactgataaagagaaggaataaaacagggaaagggggtatggaggtgagggagaagggttaatttctgtacattttgcaatatatattcaaggtaattaaggaaggcctcttggagaaagaacttgagggaagacctgaaggaaggaggctttaggcagggtctctaaacatctggggtaagcctgggtcaagcagaggagacagatagggccaaggctctgatgctgggtgagcctgggatgctcacaagttgactagtgagttgggcagtgtgggcagaagagggaaaaggagagaaacaaagcatcccttagtgactgtgggcttggttaataaagaataagtcaaagacaatttagatttttttcctggatggcttaggttgacatatttggtgttgaaacagcttttcttttgttttgtttttttgagacggagtctcactctgtggcccaggccggagtgcagtggcgtgatctcggctcactgcaacctccgcctcctgggttcaagcaattctcctgcctccctcctaagtagctaggactacaggtgtgtgccaccatgcccggctaattttttgtgtttttagtagaggcggggttttaccatgttagccagtgtggtcttgatctcctgacctcatgatccgcccatctcggcctcctaaagtgctgggattgcaggcgtgagccaccgcgcccggcctgaaacagcttttgtaagatggccttggtgacctcatcaaggaagaggggaagtcagctaagaattagcagccagggattaggactggggatggaaattcagtggcaatgttttggattacctcctgggaggaacaggaaaaggatctaactacatactaatgtaaggacggatgagcagggtgttggttctaccatggcttgctgatccgttaggcaagcatacattagcacttactgcgtcagcagcagcactgtgtcgaatgctgggcagaccgaagtggaattggctcgctgacggagaggaaagagaatatttataaagtttgttccttcatcagatctgagagaatgagatagcgtaaatatttaactctgacaataagcccacttgcgatacaaacaagttttattgggctgacgcttaagaggtctattgaaaacacacacacacacacacacacacacacacaactctcttcctttgtctatagagataactcaattcacaccaaatagctatattcttcaataattaaccctgcctaaatctgtctatagaactgagttttcaaccagtacgcttacagggtgcctcacatgggatatgagtgtgccctgaattggtaataggtgtgctgaaaatattgacctcctcagtcttgggctggctgagcgggacctggggtgaccaaaggcttgagcttcccatagcctagtagcttatcccagcatgtagtacaaacacaacgtgtgtgccatgtgtgaaaaaggctgggaagcaggcagtgtggccaccctatattcatttccccggcacagtggccccagcctttgttgaatatacactcatatcagtaacaaaatcttgagcagtactcccaatatatctatctttatgtattttataagttacatgcagttctactgtcattaatatctcaagtcataaaggccaaagtccatcaataattacgtaaatctctatttcaaatagtcttccagacaattttacactagttcagttggcttcttttctggtctaaatctgtgttcattattgctgccttgtagaagtgactgttaacagggccagtactaggagtaagggaatttcagctttgtctctttcttgttggctactcattgctggtaattaatattttctctttgtggttcctctgcaagaatctttttaagttgcctctccattctgttaggattagtttggttaaagataagcaatgtagctcacagtctctcaatcgagtccatgtcggctgccgcacatcatgatgtagggcagtactgaaagcaagcgtggaggtaagattgctggggtcaatcctctctactatacaatcgccaccctccctcccagaaaccactggcaggctggcagctccagtgagggcgcctcctatcatatcctgatattgcatactggcataacaatttgtttctttaaaaatatttattttatttgtatttattattattattgttttttgagacagagtctcgcttcattgtccaggctggagagtggtgcaatctcagctcactttgccccccaggttccagcgattcttgtgcctcagcctcctgagtagctgggattacaggcatgcgtcgtgtcaccacgcccagctaatttttgtagtcttagtagagtcggggtttcgccatattggccaggctggtcttgaactcctgacctcaaatgatccacccacctcggcctcccaaagtgctgagattacaggcgtgagccactgcacccagcctaattctttaaaaatattttagaatattttaatacgaaattttaaacacagataacatttctcatataatcatctgaaccctattttggagagcattgttcttgtggcctctaagtgtctattacctcccttcttaaccaaatggagaaagcttttagttgttatgtgtgtcccatctgccaaccacagtacagagcactcatttcatcctcacgaccaccctttgagggagaatgattgtctccattttacagatgaaaaaactgaggctcagagggtttattaacttgtacaagttggcattgcttgtaagaaagagagacagatttgaaacatatgatctttcccatcttccttccttcttaccgccttccttcacttagggcttggggtaatttccgttcttgtgtctaaagaactaagtcctagaaaataatgaattttcagatctcaagacatgctttacgataatactgtcgtgggtgctacgtgtcggcttcctggctaaaattgcagcatcgttatggctggtttctgtccatgcggcaaatctggttgctatggtatccttcacatagaaaaatatttgtcagctccaggtggctggaacaccacacaggcttactgatagtgagaatacaagcaatgattcagtgaattacaggacagtctcctgagagaaaaatgtggtccccggggactttgatgaagtagcctagagatgttcactttgtatttttcccgctacaaaacttcaactttagttggttgagttacagagagagtggctaaatctgcaaagatgtcagtaacaggggattactgaaatagtgttccttcctgtgggggaatatatattgcattaaaataaatgaatgtgttgacctagtaaaattaaattgccatatccaaagtagtggcagattaggcattttaattgttggtcattgatttaaatcatctcctgagtcagaatgtattctcattgaacatgattacatccagataatgttttcttccagtaagagggaaagaacaaaggaaaataaataaaacacagttcactagaatctcataaaagttcttgcacaagaagtgaagtagcatgggaaaatatgagttcttttacaaaaacaactttttccttgaagtcactgcaagattgctgttcacataacatattggtatgtgtatatgtttatacaagagggggctgcaggcccaggaaaatgtaaataaatcaaagtctctatggtagctgtggtcattttaaaaaatgactaacagcatatataatctcctttcaaaaaaacagtgagttgttcgtttctgattttttaaaaatccattttcactttctccaaagaagcccatatttgagggttgagaatcatttttcttttcctcccaattcttcactgctttgaatttgttttatattctgcccaatacaagcaaagcattatagtattgaaaagttttctattaaaaaacatgacaaattacatctagtttatattaaagtaatttcattctgcactaaataccttaaaatatgatgtttaagtataaacttacttttaaatcaaaaacaaatgctgattaaccttttaaaaatattcttaccatgaaagaatgtacatttacaagataatgtaaatcagggatttttttttaagattcagtcaaaatatttttttaatgaaaacattaatcctcttagtaaactgaatttcatagcagaatgtttccataatgaatattaaccatctctccttacttaaattatttaccaaaattcatttaatacacaatttttaaggtttttttgaagtgaagtatatttatggttcaaatatcatcaaataaaaatatggtattaggcatgtgctgtgttcattgccttctccgtgtgacttttctgctaagtttagtccattgaatctaagtccagattgaggcaagaagagctagaagagtatgcatctacctagcaaatactctgtctttctttttccctatataagtgaaataagctctaacactccttgaggtctctgggatcattctggactagtttgtaacaggaaaaaaacaacctgaaaacctcagcttaaagggcctttttttgtttcaactctaaaagaaaaaaaatgcataatcctattacacttagttatcagcaccatttgaaatcctgactaccttgataatcaccatggagccgtgtagcacttagctagtagagagctaaattcaattaatagtacagatgactggataaacctcctcatttattttactgatctctacagtttctctctcctgtcctccaagttaagatcttttttgttttgttttgttttcctgcttcaaataccatgtcacagccaacaaaaacaccacaggaagtcagctctgagcagcatggctttgaggaaaggtgggaggcattgggcttctgtatgtctgggtttgaatcctgacactgtcgctggttgtgttcacgctttccgactggtttgtcgctggttgtgttctaagcttctagttgctcatctccaaaatggcaacagtaatgtctacctgagtgtcatgagggtgagagataatacagtaaagagcctcgagttgtgttctgtctgcgtgtttgtccaacaacaaactattatgtgacgttttcattgttactgtttctcacctcttaaaaagctcttaaagaccattctgactggaaataatgttcccacctagaaccttctgcaaggcgtcaagatctttgatggttcaacttttccttctccttctaatcactaacaactttcattttcattaagccctgctgtatagatgatctcttttcttactcctcatactacatgctgctgtggtgaacatgtgtatttagtggctgattaaagtatgaataaataaatgaagaaattatgtgaggaattgtttgtcctttcttcagttgcatttttatttataatttataccctccttcttttaaaaagatgttttaaaagctttgccattttctcatccacttattcccatttagttatgaatgagggctagaatttgagcaaaagctgtggtatgagttatagcatcccatttgtgaccttgggcacctcattgaacctccctgatcctagcttcttcctccataagatgggaatggtaataccttttttttttgagacagagtttcgctctttttgcccacgctggagtgcagtggtgcaatctcggctcactgcaacctctgcctcctgggttcaagcaatcgtcctgcctcagcctcccaagtagctgggattacaggcgtgcaccaccacacccagctaattttgtatttttagtagagatggcgtttctccattttagtcaggttggtcttgaactcccgacctcaggtgatccgcccaccttggcctcccaaattgctgagattacaggcatgagccactgcgtcccactgggaatggtaatacctttttaaaagctcttgtgaggattaagtgagccattgcacataaagcatttagcatcacatctgacacctgatatcaacaataacaatgcagatacctttaagcagaatatttgaatggcatatgcatatgagaattagaaaaacaattgaatggctttcacaggtcctataaactttcctcgtacaacttatatcagggcaaatactcctgaatatgcattaagaaacctgcaacattctcacaaattccacaaattcaacatattccagtaacaactgtggatgattatgattaattaattaaggaataagagaaggaaagttgtcgatgtactgttttagcttctaagtagcatattccctgtttagtaagtactgcaattaaagccaatgtttatctccaaactacaaaatgcaagaagctctagaaatgttcttttgttttttcaatagtaactatttcatgaattgccaacaagttttaccatgccactgtgtgcctaacaccgggttaattgctgtgggaactgccaaaaaacagagactccagctcacagactcctgtaacctgatttcagagaataccatccaaggccatgtgcaccaagggccagattgcccggctgatttgcaggctggctgcagtctgaggccatttctccagctgttttaataactgtcttacaataactgactgccttgcaaaatgcagttttatttatctcccaatatcagaatcctgcctgccttctcatttttattagaattggattacaaaacagggagaaatcaacatgttacctttaagaataaaattgaaaatgaacaatcagttgaggttgatgtcagggacaaagacattgctgaggctgtggtcttggatgtttagctagctgtgtcagagaccacagtatgaaatttataaaccatttggattagagctcatcaaccatgctttcctagcaaccaagtgcaagggcaatcttaactttcctacaatgttcatgtggatttttctggattcagttagcctgggtgtggcttttgtctataatcacatagccaggacatcggcatgtggttgaccttctctggagtcccattacatttttccaaagagacattaatgtcaccgacttcaacacaacatttcatcttagaaatcacaggattgtagagcattaaaagcattacaagactctaaaagagccctcattttactggtgagaagattaaaatcagatagggtaaagttttgtgcccaaggtcatacaagtagctagccacgttgttaattaacctttcagtaacaataatagatggggtctgtgaccagccaagtattaaatcgttttttaaaaattaaattaaaagcattcagaagttagttaacttaccatctaataatccatagtgggccaatcataaaagcttcccaaagaaaaatacacttaaaaagctgaaaaccgcgtatatagtttttgacatgaccttactttagtaattgtttatgtcgtaacttattaaaataaacataccttgtaaattgtttacaaaatcccaacatctttttggaaatgagtataataaggcattgcagtaatacttggtattttgtttttgtatttttgaaagctgatattttgggttttttttgaatgctggtatttttaagactgtgtaatttatattcagtactttaataaacgggtgtagtggccgggtacggtggctcatgcctgtaatcccagcactttgggaggccaaggccggtggatcacaaggtcaggagttcgagactagcctggccaacatggtaaaactccatctctgctaaaatacaaaaattagccaggcgtggtggtatgtgcctgtaatcccagcaactcaggaagctgaggcagaagaatcgcttgaaccctggaggcggaggttgcagtgagccaagattgtgccattgcactccagcctaggcaatagagtgagacttggtctcaaaaaaaaaaaaaaaagaaaagaaaagaaaagaaaacgaaatgggtgcagtattccaacagtacatcatttatttttcatctctcatggtggtggtgttaagaaccacatgcttaaaaacccttggggttttgttttcatgcctggctcaggaaatccttaaaatatattttattattttttttgagacagggtctttctctgtgaccctggctggagtacagtgataggatcatagcttactgcagcctctacctcccgggctcaaacaatcctcccacttcagcctcccaagtaactgaagccacatccgggctaaattcttttcatttttttttgtagagacagagtttcattgtgttcttgaactcctggccttaagtgacccttcctcattggccttccaaagtgctgggattacaggcatgagccatcacacccagcctatccttaaaatatttttaactaaaccagatttagggtaaaataaagcccaaattggtattcactagccatgatagacctttagccaaatatttagtcatcaattaatgtgaacttcctgggtgattatagggtatctagtataatgagaaagttgttttgtcccaaaaggggatcaggaagctaaattttaaaataacataaatctagagttaagtttgggatcatcatttttacaatagtatataaaatggcttagagtgggttgcagttgaaagtaagatgctgtttcaggtggtacatttcaatcagtgacttctgctgaactcctgctagaaactgggatcacccgggcaaggatgaacacagggaggacacggggcagaggaccattttgtacatgagagagtaactgagtcaagcagaaaactgtacttagatgaaattgagaaaggcgttgaagtttctgattagcgaaatagctgtgaactgggccctgtcccacagcaagggcacccatatagaacaggaagggcacacaaacaggttccttctttgtgggagggaggttcatacacagcagcaagatgaccagctagaagtgtccagaagtactcctgctagcctatgaaagtgccatcggaaggactgaatttgtttaggaattttgaaaggacgacaaaccagagagtcccttccctttcctcctgctttccctccttcctccgaaaggaggaaggagggaaagcaggaggaaagggaagggactctctggtttgtcgttcccttcctgccctcctgcttcttttcctgacttccttcctgccattcccacttcctcctttccttctttcttataactgaaagttggttatatctagccattaaatactagttttaaaagatacagccactttggagattctaaccaaattataaacatgctttctatcacctctcaaaaaatattaaagtaataaaaaaagctttgtttgtagttcttccttatggttttatatgaagcatcgagctattcatgacactacttttaagcaattaaaagaaacaaaataaaacatttctaaatgacaaaagaaaagcataaatacaaagtgtgagagtcattgacttatacctgacagacactaaatgtctgctctaataagcaataacaattagtttaaaaaggaaacaccaaatgtcacttcacagcttaagcctagaaagcaaagttagccggaaaataattacaaaagtctaagggatttcatgggttttgttattaaggcaaagtgtcttttcgtttgtcattttcaccaactaatctgacagattctttatgaagaaagcacagagccaggaaattgtacccatctggtcagtacctgctcagaggatctgatattaaagtctagatcactccaaactgctttttcaatgcatttcattttctagaagtgacgaacagtgaaacaaacctattcagtcaattgaaatagttatttcggggagaaaattgaatcctcttcaaaagaagctgtttcactatcttagtgtggtgagtattgaaagttggatggtttccatgaaaacaaaaatggacataaaagacaaaagagtttgtgagtgatatttacagtgaagttgagtatgtgtgcatgtgggtgggtgggtgtgtgtgtgtagcagcagatcataaccagaaatttttctcagaattaactctctgtgtccattttaatttttgttgtatgactcattcaatgttcactattcccataaatataggccatacacctactgttttccaggcatatgtggccactgggggttaaagaaggttgaggttcctgtccctaaagtgtttatcatggtaaccaactaaatgtttgtttcctactcacattgagggcagaagatactgcatcacttccaggcctactgaagttccatcacctccacatgaagcttctaggtcacctgggcactggaacatctgctgtggctaaagaaggagagccggtggcaggtcacatggcagattcacccacctgcctttggccagtgctctttcccatggcccagcaaccaggaaggctagaatcagagtccactcaaaggtctatcccatagtcagccgggttttgccacaacattatttaaagatgcttcgtttaggttgggcgcagtggctcatgtctataatcccagcactttgggagggccgaggtgggcagatcacttgaggtcaggagtttgagaccaggctagccaacatagcaaaaccctgtctctactaaaaaatacaaaaattagctgggtgtggtggcacaggtctgtaatcccagctacttgagaggctgaggcacgagaatcatttgaacctgggaggcggaggttacagtgagctgagatcatgccactgcagtccagcctgggtgacagatcaagaccatctcacaaacaaaataaataaataaatttttttcttttaaaaaaaagatgcttcatttaattttttttttaccatagtaaaaatatccttttattaaaaactgatctggaaagctaagactcatgcactacatttaatgaatgaatggttagtgacaaataaagatagaagtctcagtaaaatgcatgcccttccaagccctttcttctgaacaggtctcaggtttgcccaatcagacttttcataaatgtaagactgatgaatttgctttttatttctttcactctccaccctttctgaagttgcagataagcagtagaaagtccatgagcagattctggaggtaaatcaagtattaactaatgcacaattcagatcatgactgtgacagcaatgattatctcaaaaaaatcaaaagtgggcagttctcagcaactccttgtctgaccccgatagagcgggacccttccccctctttccctgccttcccggcaaccctctccctctgtcattctcttcacatcccccaggtcaatgctcttaaacagaaacggaagttaagccacaaggttagaggacaggaagtgactcaatgattccttgggggtcaggtgtctgggtagtgagagaaagaagggagagaaaattccagattagaaaagtagcccagatgggagagtgatcagggcaggaatttcagaaacgacaatgacatcagcattagtggtactcctccactctcctacacaagcacttaagagcgttgctgtgaactacttcccacccattttctttgcaagcctaggaacgcggggctttctggcagatttaacaggtagtttggtggtgtctggattgtgctaatagaagccattataccaaagataatttttaaaacctagaatttagtaaacaagggttttttttgtttcattttgttttgctattttgagattgttaatctcaaatactctcaatttgctgatttcattattgtgttaggacataagtgagataatgaagtggataattaatgacatactctttaggatgtaaataaaagccacactccacagaaaaaagaagtaccataaagcttaaaagagatcacgaaccttagtacctgcattatacaatgaggatagttttcgtaccgaggaaaaggaaggaagtctcttagaatcatcatctttgctgcttttagtcaactgtggaatgttttaaaactgtatttatggtcttaaagggcatgtaagaaaatatttggaaatttcaagcaaaagattaaccactggaattatgatagaaatcgcactgtttctttacgagaggagagttctgttcgctactaaaagactctgttgagaatgtgaatgagtggaacataccccaccttacattttagtcctctttaggggtttgattcattagaaagtgtgtggttctttctattccaaacagaatccttttctctgggactttattttaaggctgtgatgcaaatctttggtgttcctttttaatgggaatgaaaacaatgaggaaaggaagtgtggaggcttggaatctcagctgaggcttcgcaggtcactggggagcagtgaggttcctctccactgttagcaaccggaaacatgagagaggactatcatctgctccttgctctgaatttctttgaacctccatgctggaaccctcctcagttctccatgcaaacgttaaccaggcccctttgtggtgcttggtgctgcgctggtgcagagaatgcaaagacactgtctgtggtgggaaacagaaaagcagagtgaaccacacattccagcgccggggtaagtgctggatcagaagggcatgtgggtacaaaggatagacctttgtgaacttgttacttagccttgcatggcctcagtggcagtggtcaggtggtctggaaggacatggcggaaagataaaactagagctgggaatcagagaggcaaagaggaaaagaattgactagtcacataaagcagaagaagaatgtcattctagacagtgggaaaattgcctatagggaacagaggatgggagttggagggtcgattttaggaaactttgagttgtttagcaccattgccaactatcagggatgtgggcagttgagacacagaagaatatcagggacccaggctgagcttaagaatttcatagtgtcctcggaaatttggatttttctttggagagatttgagaaccatggagaattctaagcgaaggagacagtgatcagacttgggttttgtctctgaagttatctttgcatgatgttggtagcactcctaaaaaaatgcataaattgccttcaaaacataagatgtcctgctattttatggaaacatatacaagaaagtctttattttccagcacttcgtgttgctgagcagagattcttccttcatcccgtgatcttaagcttagccaacatcagccactgatggcctgtgtgcgtgtgtctcagttctttaagggcagatacctgggtccatcataaatgtctagagtgcagtcagaatttacctgaaccccacattttctggcatacatggaggctgctgttgaaaataaatagatcatctctctgaaaatgagatttatcttttaaatttacacctgagcctcttcagcaaggcagcatggccaagagtgtttagaagctacaggacagtgcattttcttggagcatagattttcctcaaatttgaaggaaagctttgttgcattaaaagaagtatgggcatgttatattccaactacacataggaggaaataaataaatccattggaagtatctgtttattttcttctcccatttgggtacatcagtggaaattgtgaaaagtattcatttcggttaataataatagctccaatttttaagtgcctgctctgtgtcaaattacataattcattttaacaaatgtgaacataacgtcaagttcaaatccctgtgacagagaccaggattgcagcagtaaactaaatgctcttccttgttctggagtttctcacatccttacaatgactcagaagagtatatataatgttgtgcacattttgcagtgaggaaactgaggctttgagatgtaatgagacttgctcagggacccatagagtaaacccacactcagccagctccccatggccaccttcctctctgaaagatttttttaaaattccaacttactgtctctttccccttatctgttcccacctttactttatccactagagacatccatttcagaatccacttttctttctctgaaaatcaacaacggccatcaaccatcagcagcagcagcagcagccgtgcccatatacaagcttgtttgtatcttcattcttaacaacagccatggcaaccccaaccaccacagacctgtccctactgttttcaaattcactgagctcacactgtaactctaaaagagacagaagtcacagttacatctaacaggacaagtaagaattcaagatggccagagatcatagagtggaggtggctataattatcagaagggttcaggaaaggtttgttggaggaggtgtccaacaagctacaccttcaggaaggagaagtttaaagtagagagaaaggctttataggcaggcccgactagttcagtgccccaaaaaactcatcccattacatcatatatttttcctctgctcctgagaaccagcgtagtcatagctgaatgtggttacatttcaagggaaaggaggcattactgaactgcaattaaaagcatccccacatctccaattccccaggaatgccttcttggactggctggatgattcccttggaggtgtgaatggggcagcctgggggaattgggtttcctccagggcatattcagggagattttgggtggtcctgactggaccaggcctcattcctgctcataaggtgacctaatcctttgttcatcaccggaactgccctccttctccaagttcctccagattggagatgactcccctcaccaaatctgacttcccagcactattccaaacccacatttggaagacctctaagcttcatgagatttcttgttattgattaaggctggggtctggcactcagcccaaccacagccccagcaatagtagcatcagacttctcaaacagagtggaacagaaagctatgaaagcctggcatgtgcccttcagcctctttacatcagaccaagagagaaaaaagagagcaggagagctttttcagggggcagaagtttcctttgccaaagatctttgaccagcagcaacgtgcaagtcctttgcagggaataaatcaatgggctgcagtccactctggcttgagatttatgcagagcaagaaagtcactctcagctcctccttaattcagcatgtcttgagcacatgctgagctccgagcactctgctaggcactagtggtacaaagagtaaataaggcaacctctgccctcaaagagctgtggtctaatgggggagagagatgtgtaacaagaacatttcagtataatctaaggaccataatgaatgtgtgaaagtccagagaagagccgagctaacctgggatacagatgatgtcttcgctaaatcttgatagagataaatgtgagcaagtcaggaggtaaatagggagaggaatgtgacagatggagaggaaacagtgtaagcacaggcgtgggatatgcaacagcagcctgggactggggatctccgggcagcttcacgtgactgcacgtgagccccagaagcacacagaggccaggcaggaaggcactgtgggccgtggtgatgggctggtactttattctgcaggtgacagggagacgtgaaggagtttgaaagagaatgaacatagtttcacgttagagattcaaggaaggcaagaactgaagcaaggagagctattgggttctgttgcagaagtcctggtttagacaaaatgagagtctaaaccaagctcgtccagcccacggccccaggccgcatgcagcccaggatggctttgaatgtggcccaacacaaatttgtaaattttcttaaaacattttgagattttttttgtaattttttttttagctcatcagctatggttagtgttagcatattttatgtgtggcccaagacaatttttcttattccaatgtggtccggggaagccaaaagattggacacttctgttaaaccaagtccaggagacagaggtggggaggagggtaggagtttaagaaatatatttgagtcaaattcagcaggtgctggggttgtgtagtgagaatatggggactggaagagacagaatgaatctaagaagaccctcaagtgtcagactcatagaactgtgttccatttttacattaatatattttaccagatgcatctcatacagctgagtgttatctagtcagtgttttaaacgggtgatgaagtcagtggatatgactattaattctgaataggaaagcatagaacagaaaaatgtcagatctccttgcatacataaagtgcaactattgttttatgaaactttgttttagtctatgtgtgtatgatgtgtgtacatgtgtggtgtgtgcatgttcacaactacatgaagtttatttctgactaaagattgtgatcaaaatatttgaaagtcctgggatattctttttctatggttatgattggttattctcaggtatgactgactatgcctcagtcaggttaagatgatcttaaaaagcgagaccgattcttttgtgggaaaacagggaaatcttttctcactactcttcttccaagactaaatctctcattactgtgcgcacttggaactcctaaagattccatccagagagaaagggaaagattgcagccagcagaagcaacaatcctagtcagtgccaggacaatgtcaaatgccccacccttcagaaaacagtagcaatatcgagatacacagacattgctgcccacgaatagccatgtccctcagaggcagaatcagaactagaagaataatgttaccttattttcatatggagcttacagtttgcaaaggactttcataatacattttcccatatgtacaacagccttgtgagtttggaagaacctgaatatctgagagatgttttgggtgtttattggccttcagatctataaatatttttctcttatagtcattcacccattcagtcaacatactaaatgatagccatttacaagactctaggctaagaacatgagatgtaaagatgcaatctggtttccaatctggtaatgtgtacctgcaatgtcaaaatttaagaggatacaaaatccacatatttatttaaggatgtttgcagttttacctaagacatatttacagaatccatgtgcatgaatatgtgtgtgtgtgtgtgtgtgtgtgtatgtatgtgtgagtgaaagacagagatagaatatctatgtctccaaattccaaagtcagaaattgatagcccacgggagacagagcaggacaaagctgatatgccttaggcctccaaggggcatagtgttatcttcttcttgggctaagggagagcaccttagaggtagagtaaacacacacatttgaggaaagctgtgtaacctcaggaaaaacaaaaaacacacaacaatgtttgcatacaaagggtttcccaggcctctcaattatatctaaaaaccccaggtaaagagctctcggtttatgcgttaaattgagcaagatagacttcatctaaattttttaaaaaattatgtgtcgatatttacttgttccttattttagagaagcaaaagtttcaaggacggatttctaaattttccatttggcactaggtataattcaagcagtcatggaacattaattgtaaccattatatgcataagagcaacacttcctttgtttttaaatgtaaatgtatttaagtatttgaaaggtatttgaattactttccccgtcacctcctcacaaagcagatccctgaatatacacctagcatgtttctcatagtgagaatgaccttaggaagccgacctgggagattcatgacctcttgagatcaatgaccttggactccacattaacccacaacttctcccagtcattagtccacaggaagcccatatcccttgctcacaatttacttacttgttgagattttttctcataacatggaaaaataatcttctgaaggcatttcccttaatgaagcccacatgtctgatacagatttctttcccaaggtcctggagtgtttggttatgttttaacacatctttgcccttgagatccccgcatatcaggcatgtgattgctaatattttacttattaactggtaagcacgttgtaaaccataatcgcaatactgtcttccccagcctggtgtttatatcctaaaagtaacagcctcttaggagaaggctcttactgccattatcctaaggtgtcatatttctgaatgtgtccaaatgtcacatatccaaagtgtcacatctcatttatgactctcattacatcttgttaaagagcactgcattgtgtgaagcatggcttcctgagatacagcttcatttaccagaaagagtatcatgaaacattctgtggactgcaaaaaatgaattgcatgttagatacttgtcgtgtaagaatctccaggcaggttgatgggtgccatgtgaccccaaggacctcctgcaggcacagagggaggagcatgagattctacttccaagaaggcagtgagttcacacgaatctcagctcctaattcatctgggggaagaagatgggttgtttatggcagaaccatgtggctaaccttcttctgccttcttctgaatctcacctcaactgcaaggcttttcctggtcatcttatccaaaatgccccctcctgctctgagacccggaggatagtgtcctgttctgcagggcttttgctttctttggttgtggtagtgcctggatgggtctttgtctatccctgcttggtttagagacctacagggtaggacccactgcccacagccttgcattcaccttcagcacctaccagcaggctttcacaacaggggcacccagcaggtgtctgttgaataaataagtaaagacaaatgccttccacttctgcataccaaatgaagagagctgagagaagagaagcagagaccatccatcagaaccactatcttctaatatgggaaagtaacataagcacctctgccctagtaatagtagcaaatgctgtgctccaggtactttacagaaatgcaatcatttaatctttacggcaaccctctgaggtaggtactcctgtttattcccattctatagatgaagaaactgaggtatgctagaattaacctacccagggtcacacaggtaatgagaggtgtatccagaattttggactcacttctaactgcttgatgccgtatttacccctcttgtgcccatctggttcaattatgccctcaaataaaggagtattttctaaaaacattgacaggttctttttaaaaagttaatctgtaaaactaagtatatgtattcaataagagtagaaacttgagctttattccagaaacagatatgccattggttaagaacaaaatgaaattagaatgtatcttcattgtaaactctctttaaagcaataacatgaaccctgtacaaaagtagtcttgccttaaagagttgctcttttggtaaatttgctagttttacaaatttggatcatgttttgcttttgattatttgaagaattttgggagtcacatagactccagatattcatttagtcattaaaacaagatgtggagattttctttatttggtctagtttgttttgttttttgagtacaaccttgaaacttcagcaaccaggaaataccaagttattacataaagtaaaatatatctttgaaattgtctaaatacatatgcagaaggtcaaagacaagtgaaacagctgttacataaaatctccactttccagatacctaagacattcaagaaggaagaggtgggaatacggtccaggaccttagttttgaatttcctggctcctgttagtttaagatatccctgtagcatcatttaaacacagttctggtacatgaataaacttccatttggaatttcctttttgaagtctgctgagaatataaatcaaaaccatatgagatgtgtcttaatccagaatgtgaaataacatgagaaatgtcaacccagaagtagtccctgaaatacgttcaccaggatgcacgttctggtgaaattctttatttagaatgaaagcctccaaagaactggatttattatttttaacccatgattatggcagcctgaattgatgaaagaagatactttttaaagtaatgtcagtagaaatgttattcaagccacctagaatgtttgagaaggacatctgttgacataaaaagatgttcaaaatgcattgtcgagtgcaaaagcagattccaattttatttaaagattatgtaaaatagatagtatacttagcctagatacatgaacacatcttcataataaaagaacaagagacgttatgccaacaaaatattgatcaatctctaggtggtagaattatggcaatatcttccttccttccttccttccttccttccttccttccttcctttccttccttccttccttccttcctttccttccttccttccttccttccttccttcctttccttccttccttccttccttccttccttccttccttccttcctttccttccttccttccttccttccttccttcctttccttccttccttccttccttccttccttcctttccttccttccttccttccttccttccttccttccttcctttccttccttccttccttccttccttccttcctttccttccttccttccttttttccttccttcctccctccctttctccctccttcctcccttcctccattactttcgttttctttttgcttatatttttgcttagtaacagaaaattgaaatcatttatttgattttcaaataataagcatagtgccttcatttgacagccttcttgtttatcacatggcttgacatgaatgctgctaaaatccagtgatatccccagctcagctggtccttgagttgactttgacggatttgccagccttgcagtatgccagaattgtgtaactagcatcaccaaaatcttacaatagagcccatttgctggtactttagtcatgaaaggattggttgcatttttaaatggctgatttggtttgtgttttttccttctattcgtacatttgccttgatttgactgtgtgtgtgtaagtttttcaaatcttaggtttagattttgctactcttacaatcagatttcatttaggaattttaagccacttttatctcttattcaaatctattcttacagaaaatgatctttttatacctgaattcagtgagtatttggcaggcagattagccaagaccgtcatactgactttattagtaaaagttgtcatattcctcaaagctagccagggaattaaattctattcatattagacaaggtagccacctggacctccatttagaaatagatgtatctttacatagcatgtacttctgctgtttcctactttgtttttaaacatcaaatgtgaagatcctcaattaagattttgtgacgataattataaaggcccaaagagttctttaaaatttgaagttatctgctatacaattttaaatattccagaatttgtaaacttctattatattaaacttttaaaacatttttatagttgatgtaactttcttaaccttttggattacatttgtggcatgtttatgggatgcctcaattaactttaatctgagtatgccgtgtgtttagattgtagcatgatacaagtcattgatgcatcactgtgcctgatgacaaaagggagttgcagcataggaattaagtttcttaagtcttcagtggagaacttcatctcttccatcccaaatcaagtaaagctatttcaaatacctgaactcattttaaatttccttctataaggaatatataatgtcaatatctattaacaaactgcaaataaaaatcccttagagagcagacttttaagctcagcagtatctttgaccttgaagagcatagggaaaaatgaatctatcgatagctgtaaacctagtaacaatttcatttcttgaatgtaatctttattcctggaatgagtgatgcatgtttagaaaatcattcatactgccaatgctgttgcctacgttcagcagacaagtagaaagggttccagaaaactggcaaagacacgttgaaaaatcctagtaaatattttatttacactctgagccagtgccaaggaattttttaagaaaatacatacaatatcaagttttcatgtatactcagataataggattatacttgagctgtggaaatcttttcctggaattaaattaagcaagaactagttttgattgatccagatatgacagttgctgagaagttacatgcagaaagccttgcagagggagtcagaagcttcagccaagctgtatctatcttgccatgtcaaccccaaaaggagcaaaggaattgaaaagggcctgcagaagtattggagtgactttatcctaacagaatctgtgctccttctttcacctacatggcaaggttttcccctgctatcatgaaatcttcttgggtaattggagtaccaagagctaaaaaagagttgagcaaatcaaacagcagataacctcttacaagcatagacattcagaaatgtctgaaaagatacaggaggagtttgcatccctaaaaacacgcatttttttaacatttaaaaaagaaaaatcttaaagcaatgtaggatggaagagtacctgtcaaaagctaagaaatctgacttcctagtggtggtgggatttgtccaaagcagttgctcttccccaggcaagaaatcatcagcatgacacagagtgagtacccacaggcccttctgatactggtcatttggccaattttgtggaagttggagctcggctctgagagccaatatcaagacagcaacctggactcttgttcaccacctttcctacagaagctggagaaactgaattagagagggagagacaatctgcagaatctcatgcacttgtcccaagaagggttactgaagactctactggcttggtggttcaacatggaggtgttttggccaatgcttgcaaattatgatgctctatctaattgtctggtcaactctgtgttccctgccttgcatttcagttgcttgactgactccatcttgaagaatctcttgggatttagtggtaggcagtggctccacaacttcaaaaagctggggatgtatgcatgcagcctccctgagaaataccacaagcgcctgattggaacaatctgtatcaaatgaaagaggagaataaagaactactctgcttcatggaaaacttgagtcaaaacaatctggtcagaaactatttggctgggagagcatctattttctgctttctttttctctcagattgactggggtttggggattgtaaacatttttttctttttaaatactattgggaatacaggcatggaaaatatatttctgatgagtttcctcattcacttgcaacggagcttttgattttctgtggtgcaaatgtgtatatgagcacacattcacacacatggatgcatgtgaggattgtttacaacattttttggaattcatatagatcatgcactctaggcagagaagcagaattcggagcagaaatgattactgagactatgttcatctctacaccacactaacagacatgcaacaacagtttccgcttgagataaaggtccatagtgccttccatatgcctcatctatagagtgaatagctggcagctgtgttacattagcttacgctagattatgccacttgaacaaattgcccctcaagttgtagtggcataaaacaagtgtatttattgcttatattacatgtcagcagctggtctgctgtttctctgtccccagtgtcatcattccaatacctaggctgaaggaatatctcttagcctcatggtaaagggaaaagagcaggaaaggtggttgggttaggggatggctcttgagatgtttttctgaaactagcacaggtcacatctgttcacatttaattggccaaagtgggtcatatggccaagcataacattagtgaggtgggaagggtatgcctcctagttgcaggagaactgcacatggcagctggaaagggcagggcgtcactgtgggcatacaaagaaaaaaaaatgcataagtgtgtgtgactatatagtatatatatatgttaattatatatttaaggctaattaaaaattaacagtaaatatgtgtaacgtatttgtttacgtatatgtcatatgtcgtaatatctatggtttccccaaccaggctgaaaaagactgattaaaaataacccttgagtgacgaggaataaacctgcttaggtttattctctacttagctggagaatttgctcgatcttcttttactctaataggaattaagtgactagatttgctatgaatccagcttccagaagatatttcaaggcctaggaaacaaggcttatgtgtagaattggtgaaggaattttatgtctcaacacatctctcattcttgcgtttgggaaagaagtccacataaacagagctgagagtctctgtcttgactgagtacaggtaagcgtgatcactctatacgggtcttccaggtttcctcttcctattgctgtatacttgctgacagtcagatattttattgcacatcaaggaaaagattgcctcaaattatggatagataaagtgggtgtttataagttgatccactattttgaatattcagtgattaataatcccaaattcattccaaataacctgtattttagttcctcttagtaacttagaaaatcatggaaagaaaatgttatgaatattaggaaaaaattatatttggtatacaattaaggtcttttacatatcaaaataacttaacatataattttaaaagtgcaaaaagatatatcctgatgccataccatgggatgtaaatcaaagtctgttactactaaaaatctgacattccttcctgtatctgtcactaaggttataaagccctcctggcaggattatggtggtagcgtatggttctatgtaatattaatgattgcatcattggtatccatatatagatgggatggataccctggcattgattttaacaaaactggcttaatgtatggccaaagaaatacaccttcaataaatacggacttcactagagaaattctgtctgaagacaaaggagtcattctcctgaagtagtaaagttactaatgaagctaccttagccatataaattatcctaagccagcaaccacaagcccgttgaaatgttaacacctttgatatactttaatagtgataatttcatccactgcaggcatcttgtggtggctgagtcatcctgctatgctggtacccgtagtcttttagaaacagggtgcccaccaaataggccagtttaaaggaaaagacaaaacactctactcaagcctactttttcttaaatcccatgacgatcacactctttcttttccttacttctcttaagtacttttaacgaacatttaaaaaagaagacctatttaaattggagccagtttgtccatagaaattcaaggagatttgtaggaacaacataaatacatgtgctcgtatgtaatgatttcataaactttccacaatagaacagattctttctagccagctacatgtctgataataataaattttaatttgggcctcatttgaatttttggtcatttagaaaggatacccaatacctttcagtgagctattgaaaaagtatttgctatgctgagaaaaacgtaaaacaaaatgtacatacttaaaatgcttagccaagagaacacactgttcccaagcatgctagaagcacgctagacacaccagcttaaaaatacaatgaggttgtaatgtgagatgaggcctgcaaacctgggcagcaaatttgctgtgctcactatgtttcctgacttgcctgaggtcctacagagccttgtccacagactgtctgtagctaagagactacattaaagaaacagcttgtaaatctcttttaactcccatagacttccagccttctccaccgtcagtctacactggtgaggtcctattgaactcttttctcttggctaccttgatgttataatcttcctacagggaaatgcaattggcagtattcaaaaatcaaatatttaaaaaataagcatcattctcgaaacaaagtaaatttcccattttttttacaaataagatcattatataagaaaatattcgcaatgtattcttaagtgaaaaaagcagtcaaccaaagatattagcatagtactgttttgacagataacatatataaagttaggtgttcataatggggcaagagttgacttttttcattcattgtgactttctctattaggaagttttcaacactgggcatgtataattaagaaacatgataatatgttcatgtgaaaacccacatcggccatggtttgtttccacggtgcctttgttctcatgcccatggtagtgggtgcctccccaggtgctagcaagagcttccctctgctgggtctgtctgaggatagtggtcacatcatgctcaaagcatgtgtaaggcaactgaggcaaagccagtgactttgccttaagtggaatcgcagatatatggctgaatagcacgggtagcaccacaccaaccactgaacttactgagtaaaacagtgaaaatgtttgctagaccaggctaccagtggaaacactggatatctcccttttcaaccagttgatttcagcccccaaatgactattggtctccttagactaacagggatggggtgctcttaagaatcaggtcaccttatgtgggtggtggtgatagggctagggagtgtgcttggaggcaagaggcgtcagccctacataaaccatgtagaagaggctccttgcagaaagaggttccgttatcagaatacgtagggaaggatgttggacagacaaaaatagatacctgccagagagcaaaatgaaataattattacatagaatagttacaaaaattacatagaaatcttttcataataccaagctgaatggattggattttcaccagcaaagcagcacagtaacctccgtagagattggtgggcccttctgtccaggtccactctctggtttcactccacactcaggttttccatgagacagctacagtgagctgaggctttgccttgcagccctggagctgctacaggggtgggtaagggtagcaaatggagaacaaataaaactgtcaaaatgtgattttaatagctcttaatgcttttacataatattatgctggctagcaagagaacaataaaaaagagtttttcacacttttctcctcaaatgtcatttaaatctcattaggtagatctttgtgaaatgatggcactggcaataatgattcctttttagttctccagtcattttggccagtggaagggcctggggaaaagcattagtatttggctgattggtattagtaggggccatgaagaattaataaaaattgtaagacttttttacccttcccccctcaattggatgggcaaactcagatttgataggggttaattatgccagattattttgcttgttttgtcactagctggtaaatgagagttggctttgtccttaaattgaggtatcaagatgttgggactgcagctagggtgggggaatatgaaatgagggtgtgtgtttgagagacatttgggcaaatagaatggcaagttgggtataggaaatgatgctacacgaggagtcacctgccatggctaggacagggctgcttctaatttatgatatttactcattgcagttttgttgtcatttaagcctgaggtctaaaagtttaagtgcctgcccattaaagcaaacaaaaaaaatcatcttatttgaatgattgatttatctgggttctggttaaaatttggttattcatgtatgtatctgaataggatttcagttcgttatccatgttgctgtcataaaaaatgaaatgcagctattatctgaggagccttttaaataaaatttccctggctagcttcagccccattgcactgtccaaccagaattttaagttccaaaaggagtgttgttttcaaaatttttaaatttttcatttttgtggggacatagtaagcgtatgtatatatttatggggtacatgagatattttgatacaggtgtgcaatatgaactcattacatcatggagaatagggtattcatcccctcgggcatttattctttgtgttacaaacaatccaattatactcttttagttatttaaaaatgtacaaataagttgttattgactgtagttaccctgttgtgctatcaaatagtaggtcttattcattctttctaatttttttttgtacccattaatgatccccacctctcctccagcccccactaccctcctcagcctctggtaaccatccttctaatctctatgtccatgagttcaattattttgatttttagatcccacaaattagtgaaaacacgtgatgttccaaagggagttttctagaaggattcctggctgcccacttcttctccaccatgttatccttttcatcttcaggatctgagctcaccacattccctgggctggaggggtgcgaactctttcataggtcacttcccactctctgtctttgagctttctaggctgcagagcccctgtcttgtgggtcttccccatttgttcttcatggcctggctctctgggactgtcttgctgaacactacattttcattgtagtaaaggtaataataaaacagaaaaaggcataggattcatgtaatgccaagagaaaatataatattctgtgcttctctccaagacttgctgactcataattaggtttagagcatgtctagaaattaggtgttttctcgttactatccgctgtattatatgggagcgggaagcaaatctgagcttgaaaatctattaggcagcactttatccatgactcaggagcaactcaccacattttccacacgttacagatggaatgtatgttttcctatttcctctgaaatacttgtgtggttatcaaagtaggaaccttcaaatacagactctcaactgggtactaaatagaacttttgagcaatgcaataattgccttttgtaccttcccagaggaaagcccaagttagcccaggcagcacaattcagctaagctgtgttttgaacagcagttgtggaactcagagactccttttctgatagaaatgctttcaatagcttttctttccagcttggttccctggatgtttctgaaccatgtgtccatggcaggaatgggtacatggtaggaacatgctggtcacacttaagtggaaaaccctcacacaagagacaaatctcaagcttttgaaatcatcagtccctggagtaacagtagattaggggatgacagaagaggcaggcgttccggggcaggagccaccacaggctctgtttccttggatttaatgacaaagttcaatctagatttaaccagatctgtggaactaggcggtagggttttgctcttcctggtgatgcctgagtaagatctggcctttggtctattttcctaacatataccaaatagctctggcacatcaaacatcttactgcacagacactgagctttcaatgttgaggtacaatcgcaggcccagggtgatgttagtgtagatcatttctgtgcagtgatcccaagaacgccctgtacactccagctttggctatggggaaaaattagcatcatagtaaatggaaatacaatgacctgacagggacccatcctaacagcggaggaaagggccttggtaaagacttgtgataataggctgtttaattttgtttggagagactggactttcaacagatgaacttctttccccttggattcatatttgtctaacagagttgtggttgggaaatgatccaggattcacaaggtcaaaaagtgacctggttcacatactgtagactcctcctatctcactccacagcttccccaggcaggtggtccggtgggctgttggtgcatccacaccaaaaatggtcacccaagggacatatcaacctcttgggcttggccctcagaggttctggcaggctcatcaaactcaagtctcaattccaaataatcaactttcctcttctatgccgcactctacagcttgaaatcattccaatgtgcttgattaatgaacattttgttataatgcatggggaattaaggctattagtgaaatttttaaaacaataatacactggattttagctttttttcatgagaaaatacattttcataggcaatctagttgtagtctttcttaaagttatcccaagagtgaaagaatgaaggaatgttgaataaacatttttagcctaatctttggaacttaaaaaaaaaattccattaaaaaaaaaaagaattgtaaagaagaatgccctcttttcccctagtgccctggttccctggtgtataaataagacatttttccctgcctgaaattcagcctttgtcttctatgatctgtggttttgttattatccacatacttatggatctacattgaagattatcttagcagacacataacaaggacctttgtattacccgctcgttttccacccactcccgggtaagcctacttatgcagacttacctggaacaattttgctttgtaataacttgcacaaagctcaccagtgtctccatgattaagaaggcagagtactagggtgcggctgtgggactcacaattttatctctcttgtgtttttcagaaattgaggcaaaagaagcatgtgactggctccgtgctgccgggttcccgcaatacgctcagttatatgagggtacgtcagcccttcgcttcgctcttacacagagaataaatccaaaatgaaccacacgtatcctgtggtgtgttttgacttccagatttttttttctcgcccattttgcttcgctttctttttccctcggcctttttgctatgcccaggggttatcctgataccaatttagaaatgaatatcacttcccaggcccactttactttctgcttcccactactaattcccatctctttaccgcaaaccccaactcgacgttttccttccagcattctgccatcagcagcttttctgcacttccttctttttctccttgtttttcctttactactctcacttttcttgaaatcacaatgaactcactgttaaaaaacttcctagaagtcacaaaattaattatcctgaaatttctgtttaattctgtttactttatatgaaaaatgtcaagatataacatgaatcagatgttattcttccgagttttaggtaaggtgtcttattgctagcattacacttcctttcattgatttttttttggttttttttttgtttttttttgagatagagtctggctctgccacccaggctggagtgcagtggtacaatctccactcgctgcaacctccgcctcctgggttcaagcaatttcctgcctcagcctcccaagtagttgagattacaggcgggcaccaccacacctggccaatttttgtatttttagtagagacagggtttcaccacgtgggtcaggctggtctcgaactcctgacctcaagtgactttcccacctcggcctccctaagtgctgagattacaggcgtgagccaccacccagccttttcattgattctttaattgacagttaatagacatactcatgtcccttatatctaaagttataaccaaagcttttaacttcttctcggattgtccttatctagtaatgaactagtcaggaccccaacaatgagcaggtggcaggctcaaggccatttacagaggatttgtttctaacagtgctcattgcaaaggtgcaggcaggacagggggtggccacgaggaacggtgcacagtgcaagagcccagggcttgtagtggcacagctgtcactaccatgagcccaaagggacaggccaaggaagagagtgccagagcccaggaggagagaggagcctcaaaccagaccctaggaaggagcacagctggcaagaggcagccttccatgaaaaaaaatcacaagtgtctccctccctccctcactagccgagcaagacagcttcactctggaaccatctgtaagtcactcacatgattttttttcaccagaaggggaattatgtctgtttccaactcatgctaaaatttagatacccttagatttatcatgactggcaaggtgtagacagcacaaaatacaagatgagataaaggaaaaagtggcaagtcaatgatagtgacccagcatggttacatttggctatgtcctctattccaatgagctgcagattgctacctccatgaacgaggtacccagaattcacaccatgttctaaatattgcctgtgaccttcaaagctggcatgaattgtctgttggagggaagtagtgttcgaattattctttttggatagaatcaatttgagtattttgctgatactccagagtgataaagattttgctactaaaaaaaatttcagatgatagaactttgggtatttttggaaatttcctttttgaaggaaaaaaatctgccaaattaagtatttcgtgaaaccatcaagatagacgccagtgacctacgtgttaggtggatggtgaaagcacaaaagctcttctctgaggccacatccacctaagactgtaataaggatgagctagaaaaatgcaggcacttagtgttcaatcctatccaaggtcaagcacttgactatcctcatatttcgcacttatattgtactcctaaaagcatttacagtgatagcaattttttgctctcttaaacattcccaacaatgatgatgggcagtcactgctattaaaatcagtggcttttacagaccttgaaggtctgaatatgttggtgctcattcagataaaacaaagtacatcaacttctttgtctttctctctcagattcacaatttcccatcaacattgtggctgtcaagaatgatcatgattttcttgaaaaggaccttgtagaacctctttgcaggtaaaccatgtgaagtatttttgtttctttccactgttcagtctgcaacaggcatcactatactgaagggcgagctcagctattcggcaagtattcactgagtgcctaccatgtgcctgacccaggtgcaggttctaaatgtactactgttaatgagcatgatcagtttgtgttttcatggagcttaaatcctagcaggggcctttggacactagattaggaaaatgacagagaaagaagagagagagagtgagagtgagaaaaagaaagaaggagggggaaagtttatttcagagagtataaatgctatggtcaagctaaaacaacatggggatgtagacagtgattgggggtgtggatgggtcagtagagggaagaagcatgagcaggctcagcatgtgtggtgagggaaggctctgaaaaactacgagtgtgtcaaacttggctgtattttttgcaaagtcaagtgattatctcctcaaactcgtgtgtatgaactcaagtaattgtagcaccaaactggcctatttaagctattagtttgtgatagatagtgtaaggagacaaagatgtatatatggataatttcttccccttaaaacaacgtattatcttgttgaagaaactcagttgaagaaatgaggtgtgaatacctgagcaaataacaattataatttgggtaataataaaagatccaggaaaagctatattcctgaagaattaaatgctgcctgagaggtggtgtgtctgtaggaatttgaagtttcataattaaagccctgaagagaggtcagagctgaagataaggattagttatgggagatgagtcattttaccaaggccatacagctagtttagggccaaaatgaccttaaaacccagtattcctaatgctaaatccaatgttctttctagtatattctgcatttgacataaataaggtagtagtttaaagggaaagtaatgattagcaaaacttatgaagacaggagcgatcaacgcacattaaatagtgtgtaaattacctaatcctaggcttgctgaatcttcagacacgtatatacataatatatttttgtgtcacaaaccagtcactctgtgttttctatatgaagagaaaataggtttgtgttaagaaatgatctctgaatgttcaagaaaataatactatgggcttgcttacatgggtggaagagcaaagaactcctcaaatcataaatgacaggactaagttatttggacgagaaaacaaacaaactcaaaatgacatttatgagagcttatgaagtgaatggatgatttggttgtgattctgtaaaggtaatgaattggaaagacagtgtttcctcttctgcatgtctaaggtacacagcaagcaggagcagattcctcctcataagcattcactccactcagagccatgtagccagcacttcgtcctgagttttatctctcagttttaaccacatatttttttgctagttggctttttttaatatttgaaaaattatatattattttttcccattgaatttttgaaatgttttcattaagttgaggtataacatatatatatgttatatatatatgttatatatatatgttttatatatgttatatatatgttttatatatatgttatatatatatatgttttatatatatgttatatatatatgttttatatatatatatgttatatatatatgttttatatatatatatatatatttttttttttttttttgagacagagtcttgctctgtcgcccaggctggagcacagtggtgcaatctcagttcactgcaagctttacctcctgggttcaaatgattctcctgccacagcctctagagtagctgggactacaggcatatgccaccacacctggctaattttggtatttttagcagagatggggtttcaccatgttggccaggctggtctgaaactcctcctggcctcaagtgatctgctcacctcagcctcccaaagtgctgggattacaggtgtgagccaccgagcccagctgaggtataacattattgatatggtttggctctgtgtccccacccaaatcttatcttgaattgtattcccataattcccacatgttatgggagggacccagtgagagataatttgaatcatgagggcggtttcctccatactgttctcatggtagtgaatatgtctcatgagatctgatggttttatcagatctttctgcttttgcatcttcctcattttctcttgccaccaccatgtaagaagggccttttgcctcccgccatgattctgaggcctccccagccatgtggaactgtaagtccaattaaacctctttttcttcccagtcttgggtatgtctttatcagcagtgtgaaaatggactaatacaataaattggtaccgagagtggggtgtttctgaaaagatacctgaaaatgtggaaacaactttggaactgggtatcaggcagaagttgaaagagtgtggaaggctcagaagaagacaggaaaatgtgggaaagtttggaacctcctagaaacttgttgattggctttgaaaaaaaaaaatgctgatagtgatatgaataataaagtccaggttgaggttgtctcagatggacatgaggaacttcttgggaacaggagcaaaggtgactcttgttatgttttagcaaagagactggtggcattttgcccctgcccttgaaaggatgatttagggtatctggcagaagaaatttctaagcagcaaacagagcattcaagaggtgacttgggtgctgttaaaggcattccattttaaaaaggaaacagagcataaaagttcagaaaatttgcagcctgacgatgcagtagaaaagaaaaacacattttctgaggagaaattcaagctggctgaagaaatttgcataagtgtcaaggagccaaatggtaatccccaagacaatggggaaaatgtctccaggacatgtcataggtcttcacagcagtccctcctatcatagacctggaagtctaggaggaaaaactggtttcatgggccaggcccagggtccttatctgtttgcagcctaggcacttggtgccctgtgtcgtaggcagaaggggcttgccttgtctcatatgagactttggactatggacttttgggttaatgctgaaatgagttaagactttgggggactgttgggaaggcatgactggttttgaaatgtgaggacatgagatttggaggagcaagaggtggaatgatatggtttggctgtgtccccacccaaatctcatcttgaattgtattcccataattgccacatgttataggagggacccggtgggagataatttgaatcatggggggcagtttcccccatactgttcttgtggtagtgtataagtctcacaagatctgaaggttttatcaggggtttccgcttttgcatcttcctcattttctcttgtcaccaccatgtaagaagggcctttatcctcccaccatgatcctgaggccttcccacacatgtggaactggactacgtccaattaaacctctttttcttcccagtctcgggtatgtctttatcagcagtgtgaaaatggactaatacatatatatataaagtaaaattgactattttcagtgaataggtctttgagctttgacaaatgcctccaagttgttataaccaccaccacactcaacatatagagcagaccaggtgttgtggctcatgcctgtaatcccagcactttgggaggctgaggtgggtggatgtcttgggcccaggagtttgagaccagcctgggcaacacagtgagacaccattcctaccaaaaatacaaaaattagctgggcatggtggcacacatctgtagttccagctacttgggaagctgagatgggaggatcacttgagcccaagaggcagaggttgcagtgagccaaggttgtgccactgcactccagcctaggtaatagagcaggactctgtctcaaaaaaaaaaaaagatataaaacagtttcctcactcccaaaatttccctattcctcttgttagcagcttctactcctactcccaaactctagcaaaccactgatttgttttttgtacctatagttttgctaaaatatcatacaaatgaaatcaaacagcatgtagcctttttagtatggcttctttcacttgttataaaataataaaaattcatttatgttgctatgtgttttaatagttcattgctttctatttctgaatagtcttgcattgtatggatgtcctacggttgtttatccattagccagttgaagaacatttggttgttgccagtttgggtgattataaacccactctaaacattcatattcaagtttttgtatgagcatttaagttttcatttctttgatgtaaaatcctaggaatgggatcgtgggctctatatgataagtttattttaactttataattaaccaccaaatttttccaaagtgaaatattatcttgtactgccattgacaatgtatgagagtccttactgctccacatctttgttagtacttagtattgtcagtttttgttttgcttttagacattttaatagatgtctggtattaactcatttgcactttcttaatgactaataatgttgaatatgtgcttatttaccatccatacgtcttcttttataaaatatctattcaactcttttgaccatttttaactgtattgtttttcttattgttgagttttgagagtttggatatgtcctagatatgagtcctttgtcagaaatgtgttttgtaaatattttctgccaggctgtagcttgcattttcagtctcttaacagtgtctttcacagaacaaaagtttttaatttttctgaagtccagttttacctatttttatttatgcttttaatgtcatatctaagaaatatttgcctaacatagggtcacaactatttaccctatgttttcttctggaagtttcataggtttgtgttttatatttagacctatgatccatttttagttcatttttatagaaagaacaaggtgtgagtcaagatttactttttgtatatcaatgtccaatcatttcagatcaatattgaaaagactatactgtctttactgaattacctttgaccatgtatgtataagtctatttctagactctctattctgcccccatttatctatgtgtctgttctttcatcaatgtgacactgtcttgattacttaggtaagtcctggaatgcaatattctgagttctttaactttgttcttctttgtctgctttggctattctagtgcctctgactttccatatacattttacaaacagtttattgatatttattttaaaaatcctaaaggagttttgatttggatttgtggaatctctgtatcagtttgttcagaattgatatctcaacaatatttagtctttgtgttaataaacacagtatatgtctctatttaggtctcctttgattttttcaagagtgcttgtagttttaagcatatgagtggttcacattgatagtatctaagaatttcatgtttgtggtgttactgtaaatgacacagtgttttaatgtttgtcttcagttgcccattgctagtatacaaatttgtatattgtctttgtatcctgcaatctttctaaaactcactcatgagttctagtagctttgtagtagtttcctgaagattttaagtctaaaatgttaaggaaaaaatacattttaaaccaagaataaaaattctattgcatattttaaaatcaggattgcaaggacaaagattgtctctgattatgcagttctatttacaggatgatataggtggcttagcgggccaagctttgactctcaaacatgtgggtgttgaatccttatccacttgctgctgcatgtgatctgagatgccttgactacgttatgggcttttccatcaaagtctatgctttaacaacagaaagcatcttccagacatatcatagggatgagcaagtacaattcatgtgaaatcattcagagatataaagttcaggataataatactagtgtcgtccagaaaaatcaggaagtcttctcttgtagagcacatgacctgtcatgatatagcccgtagcaggattcgtccatacatacccccaaaggcattaccacatcaccgtggaataaggctgcaatactagacaccacagtgctcctgataagggcccggcttgtataaaaatggttagagtggcaggaagttgttataactggaataattcttatggcagctatgtctccaaaaatattacgaagcaagaaaaacatttggctggaggtgtgcgaactgagattctcagggcgtaggagctgtgtgtagaacagaggccaaaggagtagtcatacccggggtggatcaaaggaagaagcagaggaggtagacagatggaggtggcttggctacaaagaagtgtggagtttctttcccttcctcttgagatccaccaagacacagatttccagctttgcaaaagcagaaagcaggcagaaggaagatctccagtccgcggggaacggcagcacttttaaaactttgagattgatgagtggttaattagaccctcagccactcctatggtaagtcatgatggatgccaagacagcagtaaggggttgtgattttctttgttttcttccttgtgcaccaaagacacagagatggagctggtctcttgttttatttttaaagctttgtgggctctacatttcatgtatgtatttgaaatgctgagctagtgcagatcataaaccgaatcacagccggagggcaggcagcttctgccaggtaggcagatgaagatgggagagtcaaagagctcccgcaagtgttagccatgacaagaattccactcacctttggtattctgcaagcatctctcctgagtagatagatagtgaatgccctaggtcccaatttactcttgagttgttaagcagtgttaccttttttgattggtttggaaatatgtattgtactaaggatatgtctggcagggaggaccaaggcctggctctgaggctctgaatatgtaaatgtgtagctttctcttgctctctctctctctctctctttctctctagctctcattttaggccccagaaactagacacatttgctgtctttgcagaaggtgtgacctccagaatgacaaccatgtctctctgttgcttcagcaaggctgcatagtagacactccataaatgtttgtccctgcaagtcaggaaagtgcactttttattaatgtaacaaccacaattgtaattgtattctgatgttttttattgaattcttaattgaaaattattttctcctgtaagtcatgagaagctacttggaaatctaagtacctaggtgagctcattgaaactgtaactttatcagaatgtagggatagccaaggtgttaaaatagtttacagagtttgtaacctttaggacaaattgcagtaaaccaaagctcctgaatgaactattttgaaggagaagtactatgttaaatttgcattttggtttgcagtatttgctcaggctgctgacatacagccccgatgctcaagatgatctctgaatttctttctttgtttgtttgtttttaggcagagtctcactctgtcacccaggctggagtgcagtggtgcaatctcagctcactacaacctccacctcacaagttcaagcaattctactgcctcagcctcccaactatctgggattacaggcaccaaccaccacgcccagctacattttttgtatttttattagcgatggggtttctccatgttggccaggctggtttcaaactcgtgacctcaagtgattcacccaactcggcctcacaaaatgctaggattacaggcgtgagcaaccatgcctggccatctctgaatttccaatttaatgttaggccagtaagccatttgcataatttgtgttttttaataaatactaattaattatagcacatgcaaaacaagggcattcaccttgtttgatagagctaaggaatcggttaggattatacagtatacgtatcattgcccttagtatttaaaaggataataaataatgattttcacatggggcaggggtggggattggaaggtagtgttgacaaaaatggtatctacaatttatctacacatacaaaggcccatacttgattcgagtatgttgaataacattaataatattaaataattaaagtctttatgaatattgatattttaaatatttttccttttagaatatttatcacagaaaatgtacagtattacatttcaaattattatgtcctataataaataataagtgacaattaactgatttcttgggcaagtcattgggagaaggatatgagggttacatgatcaccacagtcacttccacctttaaaatcttgagtctataaataaatacagatcccaataaatcattattttatttctttaaaacacttacaaagtgcttattatataccaggcactgcatttaagtatattgcaaatatttactcattaaattctcatggtaacactgtaagataggctcctgtctgttttaagctcttcagcattcttgactgtaaagatgggctgttaacatcattccccctttacagaggaggaaactgagaaacagaggggtaaaagaatgtgcccactaacagctaataaatggtagtaggaattacccagacaagaacacatgacatttggatgggcttgtttgaacttttagtttttttaaaaaaactaaattaatgtgcagaaaagccatcttcccccttccccaccccactctatgaaccccactgcaatcttagtgttgccagtggagccatttcaggttcttgtctttgccacacaaaagaatttgaaagcaagaccaaagtgaaaatgtagcagatttattgtagagcaaaagcaagaacacactcaagagaggaacagggacacgctcaaaagaaggagccgtgcccaacatggccagggctcacgaactagatgaataggtataatgaaggcttggaatattctatactaagggaatgggttttccaggaaattgatgggcagttttcggaattggaatgccacccttttattgactaagtattgttaatccagaaccgccatggcgttagctgcgtgataggagtgggatgcccttacccatggaaattttatggtaatgggggcgtaatgcagccaaggtttggcagtcattcatttgcataatttgtgtttttaaatatatactaattaactgtagcatgtatatcttgcatttaccctgttgtggccagtttcttctttgttacattcttatctgtgcctaaagcaggatggctgctgcctgtctttattggtacagcctgttgtaaccattcctttccactaggaagtgggttcttgcactaacctgtttggccctatttgtattgcttttagcttcctgcaagtaatcatgtctgttctctggctagctgtctgcctcactagtctatagagtttggggacaggcttgaggtatagtcaggaacagacataataggttcaaagataggggattttgctagtatatattattttgtataaaaaatgattttatatatatttttaatggcctcttttgtgatctttttcaaccaggtactcaggatgacttttatatgcctaagctttcaggaagaatgtgtaagaagatacaaaatcagggaggagattgaggggaagagagagactttatattcttgttattcacttctctatgtatatttcaggtgtttgtattgcattattaaaaacattagcaatgttttaaaaaatgccttgccttgcagatgctaatggctaacatttagtgagtgttcattatgcatgaagttgtgtgctaagctctttacattgatctcacttaattttcataacagcctatgaataacaggtgttgttcagaattgagggtgagctgagtcctcctggtttgagcagctgggtggcagagatacccttccctgaggtggggaacaaccatgaaggaggagcgagtcaggagggaagatagggtgggctgaggtgttgggtgggtgaggtgccaatgtccagtgttcagtagggtgcccggcccggagctggggatggagatgtgaagtcaccagcatgtgaggaggaaggccctgagagtgcatgaggtcactcagggacagctgggacagtgaggagaggactaagagtggatgccggggaatcctctctacgggcaggcaggggaaggggaaggaaagaagccccaagtgaaaagaagccccaaggaaagaagccccaggggaaggggaaggaaagaagcctcagtgtgagtgaggggtgggctcctgagcagccggttcccgcgcggctgctttgctcagccttcagttcttgaccctctctcagaaatcgctagtcatgaccctcacttgaagctggaccagttctcactagaaaaattatctggatctgatgcaattattgtaaacagttacaataaaaagctaaggacaccccactcaattttccaatacaagcacatgtgaatataaaattggtctgaaattccacaaactaaagaggtccaagaaaacctggactttttttttgttttaagttctttcccccgggccactttggccatcactttttattgaatagccaagagagcctatgttcttccttgaagtcctgatgattaaagcacatagcttatttacatttattttcttgcacaagctaaatgaaattcacacagttccacatagatatcgtgtccctggacagcatacatatacttaattttctttgtatagctagagccctcaatgtttaactgcttttcttccacacctcaactaatgtccaggggcagttcttttggggtttatggactggaacagaggtcagtattcctgctgcagcctgaccactcggcagaacatcagagggaaaagctgaacagaggtgtggccttccctggctgcgtagtggcacggtgacaccacctgctgacttctgacttctgactgtcctctttctttttcctgccccctgcccccagtgcgcccgacaccctccctgtggatggcctgtgattgttgaaaggccccaccctcatggagttacataccagaattgtctctttggcattagtatatccatctctgctctccagaatctgcattttccaacagtccgccagcatggagacctttcccatgccctgcagctacagcccgaggaggaggagctgctccctgacttgcctttgatccctaggttaagaacacatcctcagtgacttaggttcctgaatgtcttggagggccccacccggaacactccccagcaggccgggctaggacatacataggagcctgggtgagaagttcaggctgctaggctttaatcagaattgtctgtaagagttgaactcatcatgcccctggttgttatttctctcaagcctttggcaggaatattagaagtatcacaggaaactggtcattaaatcaacacgagagacttcatgaccagtctaaagtctggcagtttagatgtcaaatgggaatctaaactacaaagaaggagagagtcctattgttttcctatacatctgtaggcagagggccgctgggtgtctctccaggcttctgtttcagcttgagtcaaacgcccctgctggtctgggcccgggcacctcccagccaccctgcaatactcagggcacacaggctgcttaacatccctcccggcacacagtcgcccagcgtttctctggtccttcttcctggtccctccgttcctgcactcctggccatcctcccaggccctgggcatccctctctggctcttttcctgtgtgcccaggcagtctgtgcacagctcgattttctgctgacgaccgccttacttccattagggtctgctgaccatgcaagggactttctaccaatttccaagtgctcaacagtggggatggcatcttagtcagtggtatatcgtgggtgcttggtgtcacatggccttgtactgagcaggacttccataaacatttgttaaattgaactggaacctggaagaaaacagcctgtcagttctcaaattacttgatggcatcttcatgttagagaagactatgtggtgataaattcttcactttctcctcaaaataacctaaatcaccctccttcttagctagacattttaaaagaatgtccatgcctttcctaatactgccctcatgaactgctcaatccaaaaagtgtttttaggctttatcacttactctttcttaaagatttgatacagccacccaattactccctcctttttttaatgctcattctgttataggccacgggctcttcggctccccatgtaatacgggaattaacgcgggaccaggcacatttcccagactaggcttttatttcaaggcttgtgcttgagcacaagggagacagcagaggcccaaggatcctccagctagtttcccaaaaagagctgggagggattttttttattaggcagagaattgacatcggaggaggtatgtgggctgggctgggcaaagcccatggtgggtaggggatgagtaggtcacgatggttatcttgagtaatgggccaccttgaggtctggctggaggcaacaaggctgtacattagttgttcctcattcctttctgaggtgggacactgcaaacttggttcagtgtttggtttcctaaggccagttcctggagttctttaagtaaaagacagggtaaaactttataagagcacagaagaatggctatttttttttttttttgtatgactgaagcctcggggttagcaggtatagtgtcagcaaagtagtagcatgggttttgagaagagaagaagaaaaaaaatgaaaaaaacatgtgaaggaggagcctctcaccactcccattctatctcaattccagggtcctaggacaccatcttcagctagttgttgtcgactcctacatctctgactgcaccttccctgaacctggctcccttccttggcccatgccttaaccactgtaattctccagagttctggatttcccctggatgattgactttaattattatgtatcttctgtgtatatcatccatatgtggaccattcccaagtgggtctgaatgtgacagggcccctaaaatttaacatatccaaacatgagcatgatcatgatctcccccatatcttagctccctgtcaacttccctatttccctgtttcctctgtgtttaacggcatgttcagcaaagtctgaaatctgggagtcatcctctgtttctgcctctctgcagcttccacatcaaccaatggccgagtctctgtcttcacgcagacatcccactctcactccccttttgcatctctctgccatctctcccctggactattagaaccatgttataattgtttctctttagttccttctctatcctgctgccagttacatttctaaaatgcaaatctatgttacgctcctgtctaaatccttcagtagctcctcattgtaccagattgctcctaacatcttcatttgaatcctttgtgatctagcccctgcctgcttgtccaggcttatccctcaatatggtttgaatgtctgtcccctccaaatctcacattggaattcaattcccagtgttggagttggggcctggtgggaggtgttggctcatggaggcagatccctcatgaaaggtttagtgtcatcttcctgatgttgaattctccctcagttagttcacgtgagatctagttatttaaaagagcctggaaccttccccttttctatctctccctcctgctttcaccgtgtggtatgcacaccctctcttcaccttctgctgtcatggtaagattcctgaggccttaccagaagcagaggccaacaccatgctccttgtacagcctgcagagccatgaaccaaattaaacttcttttccttataaatcaacccagtctcaggtattccttaatagcaatgaaaacagactaacaccccttttcatatatttgcaattcctggattataccctgctattttgtgcctatttttttttcctgtaattctccttgcctagacagcaaatttctcttaatccatcataggtatgctcaaatattacctcctctgggaggcgttgtccctatgctctcagaaagtgagtagcttcttctctttttaatcatgtttctatcccacatgggaccatgagattctcaagggcagggaccatatctttttaaatactgtattcccagcacctaacttattcctggtacacagcgcactgtcggatgaacgaatcttggcttcttctcttcttgttgactttcccattagaacctcaagtttcactcttaaaatgagactactatttcacatttgctagcgtattagcccttctcaaggattctgaagacaacagtaaaaattaacaggttgtggcagcagtatcattatcttctgaaagggtcaaactgctgtgtttaggttaacacatgaattcagtttgctcaaaacatgaagaggacaggcttcatcatgtgccatgggttttctcttcccatggagaaagtagagagggtatggaaacaagtgtttattgaatagcctgtgctgggtacatgacataagctctcatttcccaggccttcctaaaatttttcttaagtagacaggagcagataaatcacatggcagaaagaagttctagcttggctgctcactaatgtgtggctgccttgagcatatggtcccctcagagactttatcttctcatctgaaaataaaagcatcagtccaagtggtccctagtgttgtccaggatctaatgtttccttagcaaacattatctgaatggattggctctgagccagggcctgtactaggcatgaagaatgcaaataagatgcaactcatagcctgtcatactcagtggtggagaataattctgctatcctgactatacaaggtctattgtaactacttaaagtcaatcactgattggacctatatgaacaaagcatgctcagttcaaaaagaaaagcctaccgagcctatcatgtataaaacttccttctaggatttatggggattagaagaagaataaattatggtccctgtctgaatcaaggctccaatccaatggaggacacactattcatgctgcaaatacattctataattgaaattttcatccatgcaggaacagttttccaaggaaccagtattagaccaactcagattatctgaaggattttatattacttatgattaagttaaagggaagcagatactggggctaaatatttgtcctaaatgcagattggcttcactcacacgagaattttgcagtggttttgataaagtgtgatgaatacttccactgtgacatattcttttacttgaggcagtcagatcttaaagaggcgtttacatctgtcagggatatgtttcatccaatttgtattcttacagaatctagccattgtttattttaccttgtgtaagctaaatcacaggccaatgctataccgtgatgggaatatgtacctagtttcagacaaccatagactattttcccctttggcttatggcaagattcagaaggaagatttggatggttgtttgaaatctacctaaaatgtctaagatgtcttcagtgatgatgactttgttagtaggaatggcaactaatgagcaagtaaaccaagaacagaagacacatagataattttacatcagtaatttcaaagtccaaaaaatgaaattgttttaaatgaataaaaaaagacttcatttttaaaaattgactttgtttcttagagaatttttaggttcacaacaaaactgagcagaaactacagagagttttcatatatagcctgttcccacacaggcacagccccccgcccactcactatcaacatcccccaccagactggtacattttctagaatcaatgaacctacattgacatatcattatcacccaaattctccatagtgtacattagggttcacacttggtgttatatattctgtgggttttggcaaatgcatccaccattatagtatcatagagagtagctgcattgccctaaaaatcctctgtgttccacctttccactcctcctctccccaacccctggcaaccactgatcttttcactatctccacagttttgcctcttttagaatgctatatagttggatcatagaggatatagccttctcatactggcttctttcacttagtaacatgcacttaagtttcttctatgtcttttcatggcttgatagctcacctctttttactggtgaataacattctattgcccacatggaccacagtttatccattcacctgacatatcagttgttttcaagttttgaaaattatgaaaaagctactataaatacctacgtgcaggtttgcatgtggatgtaagttttccattcatttgagtaaatgcctagaagtgcaatttctcgagtatatgataaaagtgtatttggcagtaagaagctgcccactgtcttccaatgtggccataccatttttcattcccaccagcaatgaatgagagtttctgttgctccacattcccaccagcatttagtgttgtcagtgttttagatttttaccttagatatgtggttgtatctcatggatgttttagtttgcaattccctaatgacatgtgatgttgagtgcctttttaaaggcttgtttaccatatattcatctcctttagtgagttgtctgttcagatgttttgccctctttttaactgggctgtttgtttccttattgttgagttttaagggttctttatatattttagctaatagtcctttaacagagatatcttttgcaaatatgctctctctgtatatagcttgtcttctctttctcttgaaagtttttttctctgaaagaactaagtagaagtattgaattttaatgaagtctggtttatcagttatttctttcatggaccaggcctgtggtgttgaatctaaaaggtcatcactttattcaaagtcatgtagattttctcctatgttatctttttggagttgtatagctttgtgtttacacttaggtctatgattcattttgaattaatttttgtgatgatataaggtctgtgtctagactaaattttttttgcatttgaatatccacttgttgcaacagcatttgtggaaagactaccttttatccatcgtattgcctttgctcctttataaacgtaagttgactctctttgtgcgagtctgttttgggttcctcattctgctccatttatctctttgtctattctttcaccagtaccatactatcatgattactatggcttcataggaagtcttgaatttggatagtgtcagtcctccagttttgccccttcattattgtgttggttattctgagtcttttgctccttcatataaactttagaatcaatttgctgatatccactgttttggttttttgtttgtttgtttgtttgtttaaaactggacattttaaatattgtaatatggcacctcttgaaatcagatcttctcttcccagggtggtcattgttgctatctgtttaatgaatatctggaactaattctctaaagtctgtatcccttgttgtatccactgaagtatctactcagttaatttagtaatcagcaaatgattggacagagattttcttagataccttcaaccaatccctcagtctttgctgagcggctctttgtgcatgttacaatatggcttcagcactgcagcagggaattgataactctgccttagccttgatttcctgcttgtgcagatcatcaaggtcagctaaaggtggaagattagggccagctcaggtctttcctgggtatacacacagttctgcacatgtacttggccttctagattcctaggaatacattggaacttttctaagtcccctatggacatctcattctcccagatattctttttaagctttttggttagcatcttgtttggctcaactgttattaccatttcaggcaactgccatgttgactaattactactgactgtctttgacaaacaccctgggtataagctagtttcagtaatgatttgagtcaggttaaataaagacaagcgctgtgaactgggggttttcagggaattcccagacagctcagataatgacaattctttggtaacggagttttggggaagctcaaacatgttcttccctctccagtggatgcaaggctactagttttcacagctactctgacggtgatgctgttgattttcaaagctcctgaaaagctggggaaaagggcataggaatagggtgggtttgaatgtcacaaagctcactgtccttacatatgtttaaccatttttcttaaatagacacttagtgttacttagtttgttggaagcccatatcaatttacagctttcttaaaaagttgattttgacaatatctgccagtacttttgttgattttatgaagaagtggggttttggaggttttcacttaacctttttcactgatgtcactcacttgcattattttttattcagctttatttaaatataatttatattccaaaaaatcaccaaagcatacaatttgattaattttgtgaaatgtacagctatgtaactatcaccacaatcgtgacataaaactttattttttcagctacagggtcctactatgtcacccaggctggagtgcagtggcgtggtctcagctcactgcagccttgacctcccaggctcaagtgatcctctcacttcagcctcctgtgtagctaggactacaggcacgtgccaccatgcccagctaatttttttttttgagatggagtttcactctgtcacccaggctggggtgcaatggtgcaatctcggctcgctgcaacctccgcctcccgggttcaagcaattctcctgcctcagcctcctgagtagctgggattacaggcatgtgccaccacgcctggctaattttgcatttttagtagaaatggggttttaccatgttggtcaggctggtcttgaactcctcacctcaggtgatccacctgccttcacctcccaaagtgctgggattacaggcataagccaccacacccggcttaatttttatatattttttttgtagcgacagggcctctccatgttgcccaggctggtctcaaactcctgggctcaagcgatctgcccaccttggcctcccaaagttctgggatgacaggcatgagccaccatgcccagccgtgacacagaacatttttgtgacctcaaaaagtcccccagtgccagcatttggcaaccactcatctgtttcctgtcactacagttttgccttgcctgaaatttttttgatgagtggaatcctgtagtgtatgctctttgtgtctgggttcttttacttagcataatgactctgagattcatgtatagtgttgtatgtatcaatagttagtgccttgaattgttgagtattccattgtatggatataccacaatttttatatccatttaccagctgatggacatttgggccatttctactttttggctatcttatgattaaagctgctatgaacattcaagtacaaatctttttacagcaaaaaaaaaattataaaaagtataaatctttttgtggacatgtgatttcttttatcttgcataagtagctgagagtggaattgctagatcaagtactaaaaatatatctaatttcataagagactgccaaactgttttccaaagagactgtacgctttggaagtttcagtagttctgaatccttgctaatacttaatgttgtcagcgtttttactttaggtattctgttgtgtagtggtgtctcgttatgattttaatttgcatttctttcatgactgatgatattgaacatcctttcatgtcttctcttagaagtatctgtttgaatattctgcccatttgaaaatcaggttgtttgacttgttactgagtttaagaattctttaggtgttctgtatatgagtcctttatcaaatacatgttttgcaactgctttttccaagtagagaagcaatttgtaaggtacaggcaaacatctgagtttaggggcaataaaaggacccagagctataaagtcaaatctacttagagtcttcagctttagaaaataataaataaacttcctgcatgtgtcagaaagtataaagcatattcgagtctgtggtatatagaagatgattcctttgatgtcttgtgtgtgtgtcgtagatcaaaagcttttccacagaaaagcagaatggagtgttttgtttgtgcttccaaaccctaatggaagaacaagttcactagataagttcattttataaataacaggcaatcctcccctaaacaaacctgttacagagccaccaaatgtgcaatatccaccattttttttcacttcacacccactcttaggtagacatgctaacacacgtggaacagaccaaagagacaggctgagagcctgccaaagatggtctcagatgagatgatcagcttccaactcagcattgcctgctatatctgacactaatgaatgcgtagtcagagggtacattggaggtggttgaaaatgaggagagtcattaaacgtatttcagtcggtgagcgacgtgagaaaaagttgagaaatagaactggtttcagtgtaaagttttagaagtggtagtgaaaccaattaggaggctgatgcctgactcttgataaacaacgacaggagactgaattagggccaaaggagaggcaagacttcaaagacatcatagaggtataattgacaggatttggtgatcaacgaatgtagattgtgaaggagtagagcctcaagatgacattattttctagtttggatggcccattggtgatgctcttagtcaagacaagacagtacgtaggagaaacaggttttgaagagaatgcagaatgtgactctggcctcagatgagatgcctgggctggagacagaggactgggtatcacttgagtctaatttatgttaagattcttcagtaaggccatggagagtaaaaagggatggacctcagtctgaattctaacaaaaaaattaatagttaaagggcaagtactgcttcgtggcaggaaggagatggtgtccagagagatgagataattcataatcttgaatgtcaaggatgaaaagaatttcaaggaatgatgggtactaatttgtgactattgctattaataggtctttgctaaaaagaagccattgaattcaatggttagaaattcattggtcaaaactggaaacaagctgggcgcggtggctcacgcctgtaatcccagcactttgggaggctgaggtgggtggatcacgaggtcaggagatcgagaccatcctggccaacatggtgaaaccccatctctattaaaaatacaaaaattagcctgtgtggtggtgtgcacctgtagtcccagctactcaggaggctgaggcaggagaattgctcgagcctgggaggcagagtttgcagtgagccggagattgcgaaactgcactccagcctgagcaacagagtgagactccgtctcaaaaaacaaacaaacaaacaaaagaaacgactggaaacagctcaaatgtccatcagcaagagaataggtaacccaattgtgtgtcttcatactcaggaactaagctgaatgattattggtatactcaacaacatgagtcaatctcacaaacgttgtgttgaatgaaaaaacagtcactcaaaaaatacatactatataattctacttacacaatgaccaagaagaagcaaaactaatctacggatgatagaagtcagaaagaggggctgggcacagtggctcatgcctgtaatcccaacgaaatgaaagaaatgctgggtaacatctttgagagtccagctgagggtgaaaatcaaaatgtatttattagcacaggctgccatgatggaacaccatgaccgagtggcttaaacaacagaaatttattttctcacggttctggaggctggaaagttcaagatcaaggtgctggcagggtttggctcctggtaagggtcctgtgacctgtagatgtctgccttctcactgtgtcctcacatgcagagagagagagggagctctctggtatctcttcttacaaggacactaatcctctgggatcagagctcctccctggtagacccctttacccttaatcacttctttactccaaatcaatcacgttggacattcacatatgtgaatggagggcttcaacgtatgtgttctggagcggcatagttagcctatagcatgtataattcagcactgtgatgtgagttattttctacctatacccaaccacctgagatcaggagagaagatacacggttgtgttgatccatatttagaggttaacgggatagacttgatgcaaggtcaaggtggcaaacgattggaggagatagtgaaagtatggctaaaatgatcagccatggattccaagaacagtggaaagagaagccagaaaagggctgggtttagattagggaaaaggcagggattggtaggcttagtggtagagtcctctcaggtcaggaggctggagcacaaatgggaactactatatagcataccttctgtgggtgcagtactgtcttgggacataattggttgttcctgcagtttcaactttactggaaataaaggaggattatcaaactggagagatttaaattcattagtgaaagtaatcatcacatttttctttccttttagacgactaaatacgttgaacaagtgtgcctcaatgaaacttgatgtgaacttccaaaggaaaaaggtaggtgcccacaccttaataagaatgtggctatgccagtgaatgccaggagtttgagatcaatctgagcaacatagtgagacccttgtgtctacaaaaaaataataataataaattagctgggcacagtggcttgtgcctgtagtcccagctatcgagaggctgagttgggggcattgcttgaacccagaaggttgaggctgcagtgagccatgatcatgccactgcacttcaacctgggtgacacagtgacaccctgtctccaaaaacaaaaaagcaacgtgaacctaagcaaaattttgaaatgcctgaccatccatgtgtattctccatgtcccatttcatcataaccacctaaataagtctattataaactaagactgaaatctatttgttttacctttcattttgctttctttttttattagagggtttgcgtaaagatgtaaaatatctcggtgctttatggtgatctttcagaagtgtccgttgtaaatgtcaaccccttattagactcaaatgcttcacagcagtgagtagattaaaagttcagaaaggatctgggggtccatggcgagtgacttctggctcattttttccagtagtgttttatttcatgcatgtgtcaagatgcccccactatcaggcagattcagctgataatgtatgagggggcccagggacggtgtgacaagatcctgaactctggctcatctttcaccattctccccactgtgtacttgtctctagccacaaggaattcggttcagtccgaaaagtcactaagctccctccccatcacaggacttgccatgtgctgcttcctctttatggataagactagagatttgagttttgaaataaagctgtactttattgaatatgtactgttttctaggaactagattatgtacttaccacacattatctcatttaatccgctgagatgaggcttctctgttttctctataaggaaggtaaatcttgaacaggctaggtcattgcccacgatcttgcagctagcggcggagcagggtttctacctcggaggtgtctgattccaaaaccaaggctcctagccaaagtgctgtacagcctctctttttcactgaattgattctttttaggaaattcagaattagggtccttaactacttttttcatttaacatctctactacgtagcaactcaagcctccatatattttgaaggatcagagaaaaaaatctttgaatcaaaagaaagtgttcttggccagttgcggtggctcacacctgtaatcccagcaatttgggagcccaagacaggtggatcatctgaggtcaggagttagagaccagcctgacccacatggtgaaacccgtctctactaaaaatatgaaaattagctgggcatggtggcacacgcctgtagtcccagctaatcgggaggctgaggcaggagaatcacttgaacccgggaggcggaggttgcagtgagctgagattgtgccactgcactccagcctgacagagagagactccgcctcaaaaaaaaaaaaaagaaagaaaagaaagtgtttttatcctggtctacacagagaaatcattaaagccaaaggattttaagttaccccttagtaacctaatctttgaaaataactttaatctgaatttctgctgtaaaataacaccaaaaaaaaagaagatcaaatgaattttagtggacctcaccttaaaaacaatttgggatttgagctgggaaccaaagctttaagctgaggaggtaaaacagtgaaaaacaatatccagagaaatattaaaacatgagcagtttgtccaggccaaagacaaatttaaaatgtgggaataaacctcccaacagctgtctgactgaatagaccccttgagaagcatacacactatttgaagcatgagggtcagatgttgttttgattggaacacatggttcctattaaactgaacacagccatgcctgtgtgtctaaagtgtggctcctcaaatggctggtctatacagctgcctataccgaccattagctgcactgcatcacaaaagaaaatgccaaaaaactaatgacatgagttgtttccacacagtggagtgattggatttttaccctgtcaccagcttttcaaaacccagaggcgagatgggcttgaataacatttgtttggctctttgtgcgttacctccacaaaagctcctctgtaaattggtcacttcggtattctgaccttaatgtagtctttatatcgcatctagtggcacacgcccttaaagcccctgcttagctataggcctcagaatgcatgcacttgaataaaatattgcttttcatgttgtaaattggagagttatggcctgaattttcaaataaataatgctgacatgtggtctccacctacttatgaatctcaataatgaccagaatccatggccagattgaagcaaccacttaggagacactgttgtgacacccgtttctgtgatcttcctcttacacaagccatagactttatttaatcccttattttactgtgaaaaaatagaaaaaaaaatgaataggagctaagactaggccaaatgatcacaaatagaaaaggagacttgagaatcgagcaccccgtgaaaagctccagccaacttcagtatttatttatttggaagaaaaataaggcagcgggatttcctctaggtaagtccccatgttaagccatccaagaaatagaaatagaatccccacctccaatctgcagaatcccagacttatttaattctgcagaaagtcatccccaagtagctaaactgtctggggtcacaatcattgtgccttgggactgccggacctatgaaagggttgcaggtgctggctcagcagtttgtagggatagcaaaagctgacacagggcttcctccccaccaggcactattccttgtccttaactccatgtcacagttgcataaattgaagggcttggcacttgcccaaagccacacagaaatagcagaggcagtacttgaatctgggtaatctggcactggactgatcctcctcacctttcagagatattcagagacaaactggagtctgggtgagcctctagcccttggcctgacacctgcaagggtctcatgtttcctcagcaatacactcaattcactgtgtatattgtttttataagaggcatggttcttgccatctgtactaaagtccacaatttatttattgtcttcatggcaattgtgtttaatcctgtagattttggtgggctgacacaaggaagaatgtgaaaagtccacaaataggtgatgatggtgatgaaggctttttcatgcctggttagccatacacctttcttatacatgaaatgccacttccaaagcactgggagaaatgacaacaccgctaccctcccacaatacagtttctaactgttttgcagaagagaaaagggaccctttaaggattcgagatgaccttccctgcctctgtaagagtcaggtggaggagtattctcgagcttagctgcacgcctcactggaagactaacaacccagccaagagcatttcaggagacaggacaccagcacttctgccgcctgcagctcgggctctccactcccgcggcattcccagcggcccattcctgcttccaaacaggcaggcccggccacgtagctccagttaacgtctaaatttctatgtgactatggatgcgttgccttttgcagctgtggattcgtgtgggttcctgtttccagtgtaaagatatggccaaattccgtcttttgaaaaaagcccttctttatggaatgtctggttggcatctgtctctgaggaatatataatttcagtgaagaatgttctcatttttagaaaaaaaaaaaaaaaaaaagccaaacagtggagactcatctaaattaaaaacaccaaggcacacacaaagtagcttttctcgggaaaatgtttcttcctcattattacctacaaaattcgcgcttgctccatgatgacattgaaatcccctgattaaagtgtttatgtgattcagcttctattcaaagtaaaagccagagactgaagactccaattaggctgtttattaaatgaggaaagagaaggacacatatccacatgggactcttacctttcctcttacctaggaatatgtctcaagagagaaagagcagcttccaaagaaggttctggttgaacttataattttaataaggctctctgaaataatgaccaaaggtggaaagcaacacagaaaccatgactaattgccaccttgcagccagcacctcctggcctggatgccgtcggcatttcagaggcactgcagctgttgacaaggggcctggccccccacccacccctacttcccactcccttgcacacccccgcatctcccaccaaatgagacacctcctggcaactccaaagagcagtcagatgagagaaagtccatcattcacttggctggagagtattaacagccttgaattgcaaataattacatgcgaatgtcctaaaactgtagggtatttgagttggaaggatctttggtcttattttccaacctcccactcactcactgcaggatttgcttcttagtgcatccctctccctcacaatttgctgagccactgtttattataagcttctcaacatgacgagctcttcacatggcaaggcaatttattttattctacagactagaaaggccttccatatgataagctaggagctgattccttctaatctggcccacctgaacctagcttttttccctggtgaagcacagaatatggatttccccattcactcagaagccctttagctctgtcctccagaacagggaatcagcacactgctgctcctgctttcataaataaagttttattggatcaatagctacgcccattcatttcacaacaatggcagagctgagtaggtgagagagagagaccttatggtgcatacacctaaaatttttatgatatggccctatacagaaaacacttgcagacctttgctcaatctagaacagtttctcaactgtcagtggtgagtgactgattttcttattttatttttttccagtctgccacagactaagatacttttgtaaaattcaatacaaatgaattattagaaatattaattttaacaaattatagaaaatacaaggcttaatgttttattgttaggctcaactgacacaaaggtgagtactgataaatataatcaaaacaaatataacaggaaataatgatgcaggatttttctcaaccccacttcatcagccagaaacttctgtgcctggcaggggcccctgcttctttgttcctgtcaccctgctctgtggcctgtggctccctggctgacccagccctgctgctgcttcttggcgccagcaaaaggagggctgcagcttacaacccctttcgaccccactgttcagtaggtcccaggttcttgtcccacatcaaagaagaatgaggttacactgacaattaaagggtgaggagggtggagaagaatttttattgagcgacacagcagctctcagtggagaggggatgcaagggtggtcccgaagttgggtggttttctcccctagtgtggctgggtctgggcttttataggctcagaatgggggagtgcctgctgattggtttatgagtgtgcaaaaaagctaaaagaaagacaccaatcaaaggtgggcaagacagtgtaaaaaaccaattagggaaaggtaggtatatgtaaaatagaggaagggtgaggatcaatcagaggaaaacatgccaaatgggaagagaggttctcaatccagtctgtgggtttgtagcttgactttcagccttcaaactgtctttggcttgagggtggggtttcaccaggaagctgcccctatttgcctaggcatttgactgcctcctgcttctatcaatagaaaagaattacaaaaactgttcagatttttattgaaagtgtgcgtatatgtgattaatacaaagaatcacaattgtgctcataccatttttgttgttcatctgtcataactgaacaaaaagtttactttaaaagagaaatccctcaaattaaatgcctatatgcacactttgaacaagcactttgactgcaaatgtataagatatatataattttttttttttgaggtagagtctcacttcatcacccaggctacagtgcagtggcgcaaactcagctcactgcaacctctgcctctggggttcaagcgatctcctgcctcagcctcccgagtagctgtgactacaggcatgcaccaccataccaggctaatttctgtatttttagtagtgatgggtttcaccatgttggtcaggctggtctcaaacttctgatctcaggtgatctgttcgcctcggccttccaaagtgctgggattacaggcatgagccactatgcctggccataagatttttaatgtgacaacaagtttcttctttgttatctaagttaagtgggattgataacaatgttactcatgggtaataatgtatatctaaaattcttttgtttgagtaccagtcatcgtagggaaaccagtgaagaaaggttttttaaggcaagttaaaagtttagggtattccttttcacttactactttagggtattccattcaccttttattcaaaatgaggtaagtgatgctatatttccaaaattcatcttcagttcttcatctctagccaattcttataattataaagttataaatgtaaattacctgtgaaacagtggattctgtacattatacactttggtttatggtaagcaaactaaccttgaattggcacttgttgtaaatcagattgaccacacaccagtaccatgcagctgtcactcataggactcaccgtttgaatttgactacacccagactggtctttaccctgttcagtaagacaaatccactgattgtgagctcagatagcacagacttttcaaatggtgacaaatggttttacttcttactctcaatttctgtatctacctcattaaagagcaagtttggggactggcagccccctgaccacactctgagtagcactgtctagagttcctcatttctaaatcaagctattagttctttcaattgtccaccccaggaggttgtggttcttagatccttggccattctgattactcttctctagaaatgtaccccttaaaatgtggagcgcttagaaagaacccattgttcctgatatatgtgaccagtgcagaatgcaatgggcactgaccttttgagtcttgggatctatgctctggtcatgcatcctaaggttggtgtctttgttcagtagccatattacatggttaagtcacattaagcttacatctgccagaactctcaagactattaatagcaggaagggctgttgaactatgttcgttttatcctgaagatcctgtaattgatttttgaagttagagtcattatattttacttttatgaaattttatcttattaacaggtcatccttcacttctgttaagctctacacacttctcaatattgctattctctaacaacaataactagtttcatctaccactttagggtttatatggtattttcacatatagtcccatttggttctgttgataaatcatgctagacatgtgttattattgttttcattttctaactctgaaaactgagtctcaaagaacccttagcaaatagcctaataccatctttacagtttaaaaacaggagttccggcccattcaagttactcttaaaatgatcataaccttgagacatgcttccttcagttatttacagtcttttagtcacacgctttagaggagttactcaaccagttactgacaaaactctctgtagcaagcttgtccaacccatggctcacgggctatatgtggcccaggacagctttggatgtgccccaacacaaattcataaactttcttaaaacattatgagtttttttggccattttttaaagctcatcaactatcattagtgttagtgtgttttatgtgtggcccaagacaattcttcttcttccaatatggcccaaggaagccaaaagattggaccccgttgtgtagcatctagctagtgagccatattgtccacaacgtgggaacctattttcagttgtgttgctgaaattctgatgctccatgtccctggtacgtccatggtttctgagacaggagaataaagttagtttgatgtatccttttctttataaacacatctgactcctagagatttccattttacatttctaaataatcacaaactattcattgttaacctcaaaaattatcaaacagatgaaatctgataatctcttttaaacaatcagtacacttccataaataccactggagagtctgaaatgtgcctgatgctctgctgggtcccaagtgcgtaaaaaaaccttaaactctactgcaatgtgtttttcatactgcagatcatggccccttggtaggttgtcaagtgaatttggtggatcacaaacaacatttaaaaaaataaaataggctaaactagattaaaaagtatcagaatacaaacaaacaaggataattacttaagcataaattttttttttttttgctttagtatagtctgtatgcatgccctgagttgtgatggaaaatacattttttgttgtgtgtcactatcaaatagtttgaaatatccatcattagtgaaagaaacagacacaaccatttcaataccctttggaacataccatgatcgttgtaggcacagggtgccaaagaagactggtcgttttttttctctgttgcattttgctttctattgctttggtttttgtttgtttgctttggttcaaacaacctaaatactgcaaaatttccctgagctgttttccttttttcccaggagtttgccactttttcacatgccttagttgggctgtaaatatcttcctgttggccaaagtgagtataataagctcttagagaccagcagacagggccaggctttcccttcccaggccacagtgcccagcttggcatgtgttcttaacctaaataaaggagtccctatccaactagtatgtggtgtgctggcatcataaccaggtttgagagaggtagttggggccaacactaaatgttgtagtttctgttttaaaatatctatattttctttaaagtcatatcctttttttttgtcttctcaaaaactgtctgctaaaagggctttttcatagtccttatttaatatcaacttctcactagcttcctaaaatgcaatacaaaaatccaataagttcaacgttcagcctatcatggcaccttgtgtataaatgaccctcatatgtcagttttcattatatcaatcacaggaaaagagggagtagaaagtactagtaggaaagtatattttgagtcatcattctggagtcttgccctttttccacttgtacaattacaactttctaaactctttcatcagagctttatacaacttttttaaaactcagactcatttttcactgtgatctcaagctgtaggattcttttttgtttctttttgtttcctttttttaagagacagggtcttgatatgttgcccaggctagactcaaactcctagactcaaaagacccttccacctcagactcccaagtagctgagattacaggcgtgagccactgtattagtccatttttcacgctgctgataaagacatacctgagactgggttatttataagtaaaaagaggtttaatggactcacagtttcatgtaagcaggcctcacaatcatggtggaaggcaaaaggtacatcttacatggcggcagacaagagagaaagagagccaagcaaaaggggtttccccttataaaaccatcagctctcatgagacttattcactaccacaagaacagtatgggggaaccacccccacgattcaattatctcccaccgggtccctcccataacacatcaaaacatgggaattatgggagctacaatattcaagattagattttggtgggaacacaaccaaaccgtatcagccaccgcacctgacttctaagccatagaattcttttctgtaccttggctttgtactcgctttcactttaaacttgaatgttcaagtttgtcatttagtcaaacctacacggaaactagattttgaaggaataaacaagaataggaggatccccacaatgattaactgtgcatctgcttaggtttccttaaaaacaacacactgcaaggttaaagggagttaaagtggacgctagatacataaaaagattagtaggcaattgaacaaacattgaaagatacaaataagcaaatacctctcagtgagggactgctgaatgcactaccttctttattctcttcagcaaacctatgaggcaagacccgcttcaatcttataagtggcagaaacttactttagagagggtaagtagactgtggacagtcacctagctcttaactggtatcactgacacttggaaccaggtcttaaaactgaacacccaggtagagtaaaataaatttaattcaattcacaaaaaataagcaattattatgtccttggcattggacaggctatacatatgaataaatatgtttatatgaataatgaaacagagaaacacaggtcttgctcttttttatttttttgagatagtgtctcactttgttgctgcggctggggtgcagtggtgccatcacggctcactgtagcaggcccggctcttgatgacttcacctgtaacaactgagagtggaggctttcaagcagaaggcttctaagctgaaaaaaaaaaatcatatgattcgatttggactacactgtggaaagctatttagatggggaagatgctggagacagggtttctcccacatttttactgtaacagatccagagagaggtggcaaggcctacactaagagaatgagagtgaaattacgaatgagggaacagatttgaaaatcagttcagaattaggtcttggtgatgtgcttggtgaggatgaagcaggatccgatgattcagtttatttcagaaggaaatgatatgctctaggtcaaggtctgcgctgggcccaaggctatgcaaagctaaaccaggccatctctggcctcagggaatgcagatgctcccctctcaggggctgcaaattcaggcagaaaccagacacctagagtcaatgtgtgaggcccaaagtgtaagacagtgccaagccgcggggacccactgcagccacacagaggtgtgcgtcctgccaacggcattctgactcggagttgattccacagaaaaagacgctcatgcagagtagccggattggatcacaaatagcgatctccagaatggctccctcatctctacttaaagaaattcagtggttcattttgctgttaccttatccagggaatacacgataagaatcaagtgcaggggactaaaataaggagtgttagctttgagatatactgaagctgagattcagatggggcaagctggaaatatggtccccggggctcagtgaagaggtttctggaaagaagtaagtgccttttatggcagagttgagttcctttgtgaaaaagaagactgcaggtgctttatatttagaccgtctagtctgatgtaattataccctctttataatcagtcagggaaaacttcttagagaggaaggaaggaggcattcaaaacctctttgaaaatgggaaggaagaaagtttggcaagttgagaagggtcctctggccactgggaggaagggtatgtacaagacagtgcaagtggtagaaggacagcttagaggtgcccaagaagctcacacctgtgcatgggaggacagaggggagggaggtggaggaccacacagggctgccctcagagcacccagagttcctgcttcagccacgctgtctgctaatgagcattttccttggtgctctgcagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggtaggtggcatgcacttgtgaaatgatttttcatccatttcatagtaattgtgttctgtttatttctttaacaaacatacacagagtacttactaaatgcctgactctgttctaagtgatgtatgtgattaggaattatttgaacagaagtatgacttctgtacaggtatcatggtgattgaatccatgtgaactcatatttatttgtgcttatcctttattttgttcctagttttatccaaaaatattttgagcttcttatgtgcaaagcgttatactgggcaccataggcagggaatcctggataaccaatacccagttcctaggcaccgactcttcccctgaccttcctgtgatgcgttcatcaaaatgtctcttccccaaattttacactttttttgctcctataagaaatttctgaggcctaagatgtgtactctgcaagtttgtttttgctttaaagtgccaattacaaagtacatcaaagctgacctacaaagaccgtttcagaagcaccatagaaaaatggccctgtgctgctgggtttctggttgaggcaagggtgtgtcttgtggttcagtgatgtgtcacctctgtacctctcatcttcgggctccatctcaatactgagcaagatatagagtgtagacacatggaagacaatgagaaaattttctacagccctagacattcgacagctctctccctctctctctctctgtttcttgctccctgtctgtatctctctctctttctctctttgtctttatcgctctacctctgtctgtcctctgtctatattgctctatctctgtcttccctctctctgtctcttgctctgtctctatctttctgtctctgtctgtctctccatcctctgcctctgtatctctttttgtctcatctctccatctctccatctacatctgtctctctcttttctatctctctgctctctctgcttctgtctatatctccctgtctccgtctctttcctctctttccgtttctctctctccctctgtttctctctctctctctctcacatacacacacacacacactcactcacacacacactgtctcagcttgctctcaacactttgggaacaaatttggaataaacaaacataatatttcctctatcacttatttaaaccccctaataaaatggataataagactttttccagatttatctgacttggaaaaatcatgtcctatgtttattctgcacacttgtgtcttctgttccatttgctttgcgattttctttgctcggctgctatcttgattagctgcgtgtaccttggtgatgtcccgtgtttcccgctaccaagtccactttgtgactggcttctctgatggtctctctggtaaaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtgcgtagcacattcacctaggaggggatccttggctctagagctaagtgtgtgattgcagaagcttccatgtttactttgtgatatctgaaaaacccattcattgccttcactgatgatctcctggacataaggcatgagctctgccgtagcctcgatgcagtggaccctacaggaaacattgctctatttgtagttctcagttggtttccagggaaggcagtcaggctccaagaaaggaaaaagagacaagtaaagggtgattaattgtgaacagaggaaataaaaataaacttgccataaaataatcctggcagtttgcacagaaacagctgtcacttgtaccttctggcctgatgcaaagcttaccacttagagcattgattcattcaaagagcatttaattcttcaaatacatttctgcttttatttcattggcaaatagaaacaagaatatgcagtaaaccttgtaataaggaattgacagaagcatgttagaacttgaatgtggacctattgtagatgatttggtgggtttgaaaaaatacaaaatgtgtcagtaattgttctatgttttatattatacatatttaaaaaatcaatggtgcttttatgaaatattttagaaggttataaattcatggtcaaatcaatatatgcttctgtattaaaatgtcctttgaaaactacaactggctctagaaaagtaagatagagccaagaaatattgttcttcttttctcccttccttttcctccaaccccagccagatttcttcttcctcttgtaatttttaatttgttttgttttgttggggacttttaagtgttcagcacttgagaaataagtctatcacagttaaattggaaagttgtccacttgacctgaaaacagagctacaaatacattctgggaacgtgactcatgctgtttagtagctagagatagcaagcaggcaagggccacacagagcacagcagtgtcctgtgattaatgcagagagaatgttgaattcaccccgcatctgttgggtattccaacaaaagcctggcttccctcatgcttgcttccagagcctcaccccacagtgtgacccaggaggcttgcatgacctggtttctgtaaattctaggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggtagggctgtaacccccccgctgctgccccaccacccccaaccatgggattggattgaggggatgtcagactgagtcagatctgcccaatatcaggcaagacatgcctcaccaaaaataaaaggcattgtgacctttatgtagcaatatttaatttgaacaagacatgtcctatttgaggatgtttcctcattggcaacttaaatgatgacctggagtgactggggaaagttgacgttaacagtttgttcctgggatgtctaatttgcaatccctaaaaactagagttaagctatgtactgtactgcatttcctttgtaactattatttcagtgccaccattgatttcacactgttcttttatccctattatttttgaaaaagaattaggtttttcatgcctccttttattaattctttttttttcctttgaagcagcatcatgaccaggaaaacttaaaccaaacacagatttatttacatcttttaaaaatgtgcaagtaaaatatgaacaaaagtatcagctaagtcaaatatcccctcattttatagagttgattcaatgctgaagctaaacaaaatattcagagatttgctgcctccgagacttttggggcccaccataatggtggactgtgattaaatccagagtgctgtccgtcctgtactttacaaaacaaaggctttgctcctccaaattaacacccattagcttcttagacattctgtccaaaataaaagttgtgttcttaattgataaattgcagccctgaatagtgggtatatttccaggcagctattctgtaatagtccctgttcatcatactttttgatgccatgcagagaatctgtaccaacctaagattatttgtactttttattgatttaccctggtccttgggctcagtgggcaggaatgagctggctagtgatgcttgtagagaccccaatactgagaccacacttagaatcaggctggtctcttggtgaaccagaaatcaattttcagtgcagaaaaatagcagtaacttcttcatttgaagttgtctttgactgaactgaatgtgtgttcccctttgtccctcctcatttttaatttagagaatctgcacataacatttttccatatttgtatgtcatcgcagagggtgggatggctgctgtcattgttgtgaggatggctgtttagttttgagaaatggccttaatagcttgcctcttattccccagaaataagggtgacaggctacttttctagggttctcttctttgacagatgccccagcatgaattgacttgtgaatcacatcccaatagagtcagccaatgaatctcgttacttaagcaaacattttaatttttttaatcttagaggttttactaagaatacacattattcaaagttaatgtccatagctataaaccattcctgccccccgtagcttctgaataatgtgcagtgccaatatcattgctgttagtggggccagtctctctttagaagcaaaagtcttatcagtagagagaaagacacagggcaccaaaacctcttccacccctgtgtccatctcaggtcaattttttaaatctgggagaatgccaagatgaaaaacagtgtgccggcaaaggcttggaggaagaagactcatttcaagatataaatactgattctaaatgtaattaaaatgaatagagccacgcatctcgcgtcagtcacatgggagaatccgtaggacatcgaagggactttcaccacagtcagtcaccaccttataatgcacccagtcctggcagggcttccagccttggaatgtccctccctttccttgtcaatgtggtgtgggaagcacgcagagaccacctctctggctcctgtgaaaaaggaaggtggtaataggaaggaaaaggggagaactagagaaacataaggaatcaaaacctggcttttccggagatttcagagcaagcaagagctagtaaaagcgaatcaatcagaaaagcgaggggaaaagagtgaaaagcaaggagagcaacaccaaacgaatgttctttcttcgccaacagcacttctgtggaattgaaaagattccagtctgcccaaggccttgagatctcagcctcaaagctgcagaagacgagaacatccgcaaataaccccttctatgccacattttaataggaagtaccaccccatactctcccaaggcattgccccgagtctcagggagaaggcttcctgcagtgcgatgggcccttctccccgtgctaaacactcgcctcgcatataagcactcattgcagttgaccctgccccacagagcctgacacattgccagccttttgtcttccacactcctgcatgcccagcagtttctatatgatgcaacagagtgtccatgtttgcccttgcagctggctgtgggtgagatgaggaagtttagccttcaattatgaaccatttgtattcagacatagtagtgtgtaagaggagccttgctttgttgtctgagcttttatttctgccctaaatcaactgtgcacagaatagattatacctattcctgatgaatatgaagtcaccgcagtgagaggctgaacctgcaatgctcagaataagaatctgctgcatactcttcttatgaatctttctttctcaagaaaaccaaccttccttcattagctgagcacatttctaaagaagaggaaatggaagtcctgataaacatcattaagtcccgaaaaagattagcataaacaggatgccaagagggagatttaatattattcagatggaatgtgaattctaatgcaccactcatgctcagcctctcctcctaatagagcagtaagttttaaaagcctaatcatgctgggaagactcttagtactcagtacaagtgtccctgcccccgctggctgtttgtcactttttctgttgcctgcctcagataaagtgagcagtgctctggggctatccagtgaaattatccttgagtccttgcttttttttttttttttttttttttgagatggagtcttgctctgtcacccaggctggagtgcagtggcacgatctcagctcactgcaacctccgcctcctgggttcaagtgattcttctgcctcagcctcctgagtggctgggatttacaggcacgcaccaccatacccagctaatttttgtatttttaatagagatagggtttcaccatgttggccaggctggtctcgaactcctgacctcaggtgatccacccgcctcggcctccctaagtgctgggattacaggcatgagccactgtgcccagctgagtccttgctttttcatagctaggtttttaggtgaaagacaacagaaagaagacaggaaaactagaccaaggggacactcatcactcgccttttatcttcaaaaggaaatgagagatcacatacaagagagatgcttataaaatgaactctgcattgctgatggccattctcccctttctcaagagggtggctgggctgagctttaacagtagatgacagcaggacctgttatgccatttgtgggaccagtgaaaagagaaaatgtgggatcacttgttcataaatcattgagaatttcaaaaccaagacagcagagcattaaactaagtgtgtgagaccctgtgtgatggcccaggctgcccgtccatgggtgacagacacaaaagtgaaggaaaaacattatgccctcctgggatcttcctcataacgaagctgagggagctggggctgttgcctgcccatccactgtgatcagaaggatgagcaacagggcaggtatggtggctcacacttaaaatcccaacactttgggaggccgaggtgggcagatcacttgaggtcaggagttcagggccagcctggccaacatggtgaaacaccatctctgctaaaaatacaaaaattaggctgggtgcagtggctcacgcctgtaatcccagtactttgggaggccgaagctggtgaatcacctgaggtcaagagttctagaccagcctggccaacatggtaaaaccctgtcactactaaaaatacaaaagttagctgggcatggtggcaggtgcctgtaatcccagctactcagggggctgaggcaggagaattgcttgaacccaggaggcagaggttgcagtgagctgagatcgtgccatcgcactccaacctgggggataagagcgagactttatctcaaaaaaaaaaaaaaaattagctgggcgtggtggtgcacacctgtaatcctagctacttgggaggctgtggcagaagaatcacttgaatccaggagatggaggttgtggttgagctgagatcatgctactgcactccagcactccagccctgatagacagagtgagactctgtctcaaaaaaaaaaaaaaaaaaggatgaacaacaggtttcttctccattttttatgtggaaaactatctcttgtcaaaaattcagatcaaatccttgctttggaaactttttttttttttttttgaggtggagtctggctctgttgcccaggctagagtgcagtggcacaatctcagctcactgcaacctctgcctcccaggttcaagagattctcccacctcagccttccaagtagctgggattccaggcacccaccaccactcctggctaatttttgtattttttagtagagacgaggttttgccatgttggccaggctggtctcaaactcctgacctcagacaatccaaccacctcggcctcccaaagtgctgggattacaggtgtgagccactgtgctcggccaaaactttctgaagaagaaatgattattggaaaccactcgttgccgtcacagtgtttttctatgaggatcgagaggggaagctcttcttctggtctcaggatctctctatgccttagaaagaccatcttctactcactgtgcccagtggctttccacagcaaccactagaagccccatcccaaaatggcttaaatgacaggaaattcatggtctcacaaaacacaaacaaaaagtcaggaaataggccagccatggcggctcacacctgtaatgccagcactttgggaggccaaggtgggtggatcacttgaggtcaggagttcgagaccagcctggccaatgtggcgaaatcctgtctctactaaaaaatgtaaaaagtagctggaagtggtggcaggtgcctgtaatcccagctacttagtaggctgagacaggagaatcacttgaatgcgccactgcactccagcctgggtgacagagcaagactccgtctcaaaaaaaaaaaaagtcaggaaatagaacggttccagggttagctcaatcatcagctcatcaatagctttgaagagaggttctttccatctttccctttggccatcttcagctactataactggaatctgatttgagaccaccttttctttattaggtttatgaaagaaaattttcctgctgtacttccaacaaaaatccacagaaaccaaaatatatatatacgtctatatttcccatgtcccctagaagacaaggccagggcaggaaggttattgtcagacttcgaggcagcacaataaatccctgactaccctctggacatcctaagatctcagtcagaaaaagcagctcagagcccacagctggagagctgcagacatgtctaaaataattaaaataacaatatttgctgaaacgagaaagaaatttggaaaccaaacaatacaaagatagcatctctgggatgtgtgtgtgcacgcacatgactgtgtgcccagaaacagcccgcaagacacggtggacaaaagaggaacgtgctcgacaatttaaacagaaacactgtctgctttattctttttgtagatcctgatcaacatttctctgctgttaaaaaagtaggaattcttctcaaatggaataatacctgctcatatgaggataaatatttgtgagtcacactgaagtatttaccttcagggcatctcgattatgagaactctcgtacagcacagccagccctgtggtgtgcacagtcctgggcctccttccaaaatcagaaaagcagaagatgtaaacaaatcggagatggatctcaccccaataatcactcacctgacatcttgaatttttttctcttttgacagtacatgctttctttccatgccctttgatgaaatttggagttgttgccagttgaaggaagataaatattgtctggattctttgtggcgaatcatctaagtatggcaaaactgtgcattttctagacattccaaactttaagaataaaaaagaaagtaactcatattttaagtgacaatattatcagcctgaatatcctgatgtgtgggattagagcgataaaccttggaatgcaaagaaatattactaagaattctgtttttatggccacaaaaagtagcagtgtataatttcccctgtgatccattcggctgacatatacaaaaacctgagtatgctctaatggcttggaatccttcccctgctgttaccacaatttaaaagaatgaggactgctctccatttgttgcagcaatcaggaaagcctttgtcacatacccgaacttgggtggaggccggcctggcacacagagtgatcagtaagacgacctgtattaggctttcctccaggtataggggggatgagcagtggctgacactagtggccactgtctacctgaccagccactcaggaaggttctaccttgctttgcagaagtgggccaacccatgagccactggggaatgagagctgtgaaaattgagggttgaagcaaatcaactccctataggcatttaaaaaatagcagacatattatttcactataagccagggtgcccaggaaagttcagttcctttttgaatagcgggtaagtccagcacagaaagttcctctagagggcctagagcttaacctgccccaccattgcaggatcttcattcttgccgggctctgctctgcctcactcattctcattagggccactctgtccttgatgccttaatgctccatttattcatcaagtaggggaggagtctagactctaagatgaaaaaggcatgatatgacaatatcttgaggtctgaaaaaaaagccacccaggaatcattctcactagagccatagcttactgcataaaaacaaacaggtagaaaagtaagtgccaagaattccaaagaagaaaaagtaaataaattccttaaatcaaaatatgtacttatgatattagtctgtttcatgaacatattccccataaaactctcccctgcaggggcactggatatggctgtttatctgggattctttcatccacgacccacattgttttcaccaaacctcccattgaccagacgttctcaaaatccccatggcaatgtaaaccctaaagggcagggaattttatctgttctgctcactaatgacacctaggaactctaagcatgcctgatacacagtggttacttaatcactacttgttgaataaatgaataaaataataataacatctgcagtgtgataagatgtaacaggtcgcaaagcacatgcacatctatttcctcacttactctccacagtaatcctgtgaggtggggttttattcttatcttcatttcataggagaggaagacagtgttcgggtactgcctaaagtagctatactagtagttcagcatgtactaattgggaggcaattccagctcatccagttcccttcccatgcttcctcctcctcctcacaaccaagtgtggcctggctgacacatccctatggctttgtttcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtgtaagtggaaataatgagattggtgttctcgtgggcatccttccactttaatgaaaataattccctatagattgagttttaattatacgaataatacatcaatccataaagatgtatgtaatcctgctctcctctacggaagtaacttttgctcaaagtttgatatggaaatccacaagccatttttttatgcatttgaaaatacctttttgacatcaaaatattccttctcaaaagagttttgtgtatgatctaaaacaaactttcaatacatttacaaaaatttaaaatgaaaaagggacacaatagaagttgttttatatataggtatttattaaaacttattcaattttttaaaaaagtaagcatttctttgggatataggaaattcaaagtgacatgaattaaaatgacaggaaataaaaacaaatgtattttagcacaaagtatcttcattggtgaaaagtaagcaaaccaaatcaagtcttaagcttaaataaacttatttatattttcacttggattttttttaataatgttaagttctcagcaaagcctgtataattaaaataatccctgaaaataacaattgttgattaagaagcatatcctactataagtggttgcaatgggggtattagaaataaacacatgggctgggcatggtggctcacgcctgtaatcccagcactttgggaggtggaggtggttggattgtctgaggtcaggagttcaagaccagcctggccaacatggtgaaaccccatctctaactaaaagatacaaaaattagccaggcatggtggcgggtgcctgaaatcccagctactcaggaggctgaggcaggagaatcacttgaacccaggagacggaggttgcagtgagtggagattgcaccactgcactccggcctgggtgacagagcgagactccatctcagaaaaaaaagaatgaaattaaacacgtgactctttgctagatatgacaatgttaacattatgaattattttgatggtccagatcccaattcatgggggaaaaaagccatttggcccatggactttgagttttgagttttcagcaaaatatgcctgaaatggaccttgacatggacttgattcaatttgaagaatatccatgctatagagaattctgtataaaatgtgtttaaggagtccatgatactgcaaactcagaaaggattgtaatcagaaccacttgtgaaaacagattaaggtggcaacccactaagtaaatattagtttttcaaagtaagtagattaagttaagttaatggtacaagttgctagagcccaaacagggagttcttgatgttgttgctgtgagaggttgaactacatttttcaattaagtctcccttatggtttggaagtatcagatatgagtcttttacatttaatcagttcttggattaaagttgacactagtctaaggctaaagccacattactttcaagaaataaatgtctttggccctttctgagtcacaagcaagaagccagatcaaagcaggctttattttagctgagcaaacatttacagagcgtgacttctgtactgggcaccgtgcttagcatggcagagcatatggatggatgagactcactctctgatcttaaggatcttacaattgagggagatgaggcatgaacacaaaaaactccaacacaacaaatttggagaatttccatagaaaggttacaaagaaaagtccaaggagggagagatgaagaatgagggcttcatggaggaagtgacaactgaaggctgagatatgtgaggaacacattttgggtacctgctcggcagatagcataagcagaagtcaggagagcccagtgtattcatctggcttgcatgtatggcagacatacaaagtgacaccaaatgacactgaaaaatgacgctggggccataaaggaaggacattgaatattagggcaaggagtgtatgcttgattcattaagcattggggaaccgtcgggtgttgttgagggacttaccagttacagtgttctcagctgtaaagacagaaccaaatatccaacgaacagtcatttgaacagtcatttaaacaataagtacattttattatctcacataattccagagttgggtatcccgcagctcagtgatgccagggctaaagtcagcctctattggctttccctttaaggtcacaatataattgtcacaacttataattatcacatcttcacaaaatcacattccaagacaagaagagagtgaccacgcttctctttggccatgtgtctctttttatcagggtcatacatcttacagaagctctcagcatttttcttggccctcaggcagaagtggtttacagcttcccccttaaaccaaacactggaaagaagacctgggttaccagttttggtttagggcagcatggttcatccctgggtctgagggagacacccatttccctgagtacattgcagctcacacctgagcagaacatgtgttttcttaatgaggaagaagggaagaatgggtattgagttgagcaggtggccagccttgtatctgctacagggagaaagtccatcagcacagtgtcattgacccaggaatctggaagtggtgcacaagaggcaccgaactggacgagcatggagactcagggagtcagcatactaatcaaggttccaaattacctgcagggacttccagcagtgagactggagagaagatattccatgcatagaccctagagtcaaagtttccaaactgctactgtggcagagaggaacggttcctcctccatttctccagagaagttctgttttcagctatgccacttcttggatttttgtcaaatgatgaactaaattggagtgttggatgggtaatgaaaatatttgagtcctacccatctggaggagggagaaggatagaagagtcaaagacaaccataaggctttaaggcctgatgattgaaagaatgtggaaattggaggggagaagggttcagaatccacaggaatctgaatttgaggtgccaggatcccccatatgattgcaaattatccacacttagaaattcagacctagaatcatccccttagagccaggaaaggggcaggacccgcagcagcatggtatgtaacagaaagctaaaagagcataggatccaaaacaaatgctgaatttaggtatttgaagcgtttttagtaaataataataataataatggacaggaagtattttctgatggataaaagaacaagcggatagaaagggaactgagacaacatatagagatgacaggcgactcttcaaaaatgatggctgggaaaaaatgttggcatggaaaagaagcttagtaatctaaagttaaacaatgtatacacactggacaccttacctagagcagcatatttaaaacaattctgcagctcaagcaaaacttgttacacctctcacaagcttcagatcattagtaccatctgtttctcctccaccctaagcgagagtaagaaaatgggttcactctaattttaacaaaacggctcttctctgtaaaccccaggtatatcttgtgccagtacacaatggacatggtgggagtggagacgggtttcagaccactgaaggcatgctcaggcttttctaggaacttggatttgctaatcagggccatagtgtggtcagccctggcatgtgacgtcatgcctcctgcatgagactgcaggcgaatccagcatcgatagccccccaggaccacaaagcctggggccagccaggaccccctcagaaggtcacacctcagcccttctggaacagccagctctgagtttgtttttatcatgcactcctgccagtagcaaatatctgaatgtgtatttatgtttagtaatataaatatactggatgtactctaatgtactatgcacattataaagcacacccaatcagtatttttaatgggtaagagaaaagataaacacacgtgggagtgctaatgatttcttctcacacctcaagagactgtcaggagcacacctccccaccccttgagaattcagacaccctcgtgtggaggcccctgctccagaacatggcactttaagaaagacaacagtgttgacagaagcaagctcctgacggtgtctttcgcagtgagaggactaaagtgatcatgaaataaacacagccacaggtgggagcagcaaaaggcagcacctatcactcatttggtgtgatttccatttagttcccctcatattgttggaaccaattccctggtaagcctgcataaccagtacccactaccacaaggaccaccctcaagggtaatggcactgagaagggccagacatcccccataaccttaggctgcctggttcttcttctccaagcacagcctccatttccataaaccccaagattatggaacaggtgacgctgggtctccacatgaagtcaatagcaggcatcctgcaaagcaagtcctgggagatttgtaggaaaaaggaagatgtacaggcttcccctcgagaagctggccctctaggaatgaggtcagaggtcccaccagctcaacaccactcccggtgaattgtgcagcactggcatcatggcctggctggcaggggtggagaaacgcaaggcgaggctactgttccctaacccagtggttttcaaaccatgtcccacggagccttgggcatcctgagagtggcttcccaagctgtctgtcagggaggatgggcaagagggatgccaggttgacagagtcctaatcaccaacttcacccagaagccttctgaaagcaggtgagtgggttgattgctcagaatacagaaaaccaggatggtggtgcccctttctaaaccctgcttggccatcgagagcgtgggatccaaagttcaattgcaagggttgggactcagctctgcctcccatgagctgcgaggcctcagcaattactgacttctttgtgcctttcctgctgttctggttgtttttgttgatgatgactctgggtgcgtgttcacacgaggaatgtggagcttacacagtgcttcccagctggctctttctatgtctgctcctccaatgacctggcatccacttttcctcagatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacggtgggttttttttctcagtaacaacagtaatcccaaagcaggcattcccacagttcataagactggatggatggatggatggatagatagatacgaatggatatattggtagacagattatagatagataggtaggtagatagatcaacgataggtagatgatagattgatagatagttgatacatagatgatagatgacagctaaatagatagatgataaatagatggtagatgataaagagagataaatagatgattgataggtagataatagagatagataatagattatagatagataaaatgtgtctcatgctacatttcaacttcaggatttgtcaacactcttttcataatcagaaaatcttgtgagacaccctaattcacggggctcagattcatagaattattgagctagcattgaagaatgccagctgtgatccagaaagcttgagttttatgttgtctgtgtgagtgaggaggaaaacatacacaaagtagtattttacaatttttaaaaggctatatttaagaccaaagcacaggagcttgcagttaaggggtttcaaactttggaaaaacagattaattttgtcccctgctgttcttcctgccctttagttttccaagatttttccttgtgaactgtcagactgttagcctgattcagatatctaagatatgtgatcattgtttttatttggaaacgcaaaagcctgggatctggatagcatctgggtataaacagaaaacaaaagggatgagtttggtattgtgacaagctcgttggtgtgggatctgcttagcacactcacgttcaattacagagtcatacagaagaaatatgccactgggaagccagatcaaaaggacctcaacgagaatctggcagcagctcaggggctagcgcacatgatcatggaatgcgacagactttttgaggtgagcaaaaggctcgaacctccgcctccctagtagctcttggaactagataagacgcttgggattgttgctacatttatggtttctatctgtttgttcctgattttatgacaatagtatatgttatagctctggtgtttgcttccaagaaagctgaggagctagctatacaattgaggctttgataaagacacttgggattaccatactgatggtttttatgcaaacagtgcatcacctgccattatcaggttcaaggccagtcagccaattatgttctatttgattttaccttggagcttgattaggttaaacatctgtgtgagtgtgtgtatgatactgaggaatctttgttgctaagaaccaatgacagcttatgaatacagccacagatatgtaaaagaagtaagtgaaccagacttgtggcatacttttgtgatagaattggcatttgtcaatgggaaaagtgtgctaaaaaagtaaagctattcccaagtcatgtttgatgtttcccttcacaagtctgtctgttttaagtcttattcatagtgggtaaagttgtctgagcccatattttgccaaactgaataaaaagacagtaaaggtaaaataaaagggaagtgaaaataataaaggggaagtcattgcaatgttttgaataataaatacagcctcagaaacatgtttgtatttcctgactttaggaaggcccctcccggccttggcaatgatcttagaaaaacatctctggccgtgtggccctcggcccgtggctcagagccgggttgtgggtgaaatggctttgctttctttgagtctcggcgtttctttggctcagtgtgttgccctttcatgcatccgttggtctaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtaatctcagaggatggaaaaagatcacccccagaaagccacagctaacaatcagacatttgtttttgcattgaaaacagctgctgtgtccacagggcttggcacacacgcggacagttaaggcacatgaaccattcaaagaactcagtccagagatctgttgcctataatcagagagtaaactatggagccggacagctggatcccggtcctgtctctcccccgtagctgtgtgatgttgggcaagtcacacacctctctgtgcctcagttttcccatttgcaaaatggacattgtaagagtaccactgtcggaggaaggctaatttacaaaccaaatggcttagaatagttcctggcacacagtaaccactaggtgtgttggtgattattatttttatcatcattattattcttttaagcttaaggactaaaatgttacagctgaggtatgtagtatcactctcaatttacataatcagtgatggtttttgaacacccagcaaggtatgatagcaaaactaaaagcccaaacaaaaaatgttggacccatatcccagacaacctcttcagcttctgacgttgtctttcccaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggtgagcctgactctagggtttatgatgttctgttccaaaggcaggacgcgaactgtagatgtgagcacttctcctggtgtctcccaccaaagtccagcctccacggggaacactaagccggctcttgtttccctcagtgacatctgagttttctgtgtcgatgcccgacttcctgtgtcttttcacccagcctacagctctgcctgggctctctgattgcccctctccttgtggagcacacagtttattaggccataaatattattcatttcctcagagcagacggcccagaaaagctgctgtttgtccggttgcactttctgccaaattatgcaaatggatctgactggcttttcttctgattttgtttttctcccctgggaaagtgtgtgtaactctcaagactggagtaggtttgacttcagaactcatctgtataacttcagatgctcatagctattactatgctcagaaaccttggcactgccctggaggtccagaaaatcttgttgattctgtgtctgccaaggaaatatttcttctgattgatgtaagggttgagttccagacccctgttcttggggtttggaaggggatgctcaaccaatgatagaaagtttgcacagtagagatgcagtgttgcatcagccagaacagaaattgagggtgctaaagaacctgaatagaaggtaattagatcaatatatccttttttattgaaaatcttggcaagccttgtctcatgtcacagatcagcagtgtaaaaggaacctattgtgaaactcccaaatgtatatttaaaacgctttctttatgaaaccagttttgatggcaaactaaaggttacttttcacatgagctctttatgacttgggaattggcccatggaaccttgacttttaaaggtcaattttccctaaatatatgtatttatctctgcttccttgggatcctgctggagaatgcaggcagtttataagggtggcatattaccaaagttattaggacattagtcatctggtggaattaaacttcatgctttcactccacaagtggaaagttgaatagctgttgcaggatggctgccataggaatggggccatgccatagcgtgcctcctccctccctccagaggaggctgagggcctgagtctgtgtgtagaacctccctccttccatccatccggcaaccccaccagcctgctatttatcagtgcttcgttccatcacgaccacgtgccaggcactgcaataggctctgggtatgccaagggaatgcagcaaacccctctcctgctctcttggggtttgtatttcactggggaaagtccataaaaaataagaaagggagatgggcttacttatcctgggaggaataagatagggagatagtaagggatggaattttaaatagaatggtcagggcggggtcttgctgcactgattttgatccaagacttgaagaagtggagtggaccatgtggccctgaaggagaagaggtgcagccctccacgggctaacaatgaaccagatctggttcccaacaacaggaattccttatgtgtaggatacaaggaggtggaaagtgatgagtgtggtgaggaggcacggggctgagatgcctcctgtcttcagagcatcttacagtctaggctagcatgtatgaggctggtcacctttcaggattgctgcatttgtctctcatgtcacacccattgctagctcctcgggagcttccgctgagagttgctggagattctcccatttatcccaacaaatctctacaactttcagtcgtcacgatttatcacatcttcgttcatgaaaagagtagtcacagcatggaagtcgctgagcatttgtgtggggcttggttattcccaagttcttgtcaagcacatatcaccatttctcttcctggtgtaggaggacagggtgaaatcatggaggacatgacttagtaagggaatagaatttgtggagtaaatcatgggaattctaataatgcaatctattatgatagatccctggggtagaaagggaagttagaggttgttacagagatgttctcatagctcctgactcccatccacaaccttttttcaaggggtagccacctctgcttgaatagctctaggaacagggagctcactgcctcccagggcagcacatttcatttctgaacagtgcacattgttagacagtgcttctctcctgcacagaaatgtactttcctatctctgccttctggagtcaaatcaaccatattcatttcttctcccactcaagagccactcaagtatgtgaagacaataagcaggcccacatatgtttcttttccttcaagctaagcgtaccagttcacttctctttgagcatgccctcctccaggaagccttctccatattcctcccgcagccccctctatgtgatcccagagccctctgtgcataatcttaccagtgcatttacctcagtgcttttagaattctgtttagagtgtcagtatttttcctcctgggctgtgtatatctttatgtccttggtggcttctcagagactggcatgtctatctgcttaattgatgtctgctgaatgaatcgaatgagtgagttctaataataaactgtaaaaccacctcttcgagaatgggcaggagcctctgcagctaagcagagctggggattccagatgcagatctgaaagctgcaagaccatttctggcctcacagtcccagagctgagatccttgctttgaaattctctgtataaactttacacaagcttatgaaagccattagcttaatccaagtcactagcattggaatctgagcccaggttgttggcaggaaaatataaacacaaaccttagctctgtgttcaggttcttcttcctccctcagtcatgactctgatgtgcggattgttttgctacaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaagtaagtgctgactcccttaatggcaggctcagatcttgggagtctcagcttgtacagcacatccagcagggatgtcaccctgatttcttatttcactgtatttgtttcctcattgccattagtgtgctttcataggtggatatgtatgcctcccctctgtctttccccctttcctgaaattctgacatttctcctgcaactgtttgtctttctttattttctgttttatgcctacttatatttctgtctttctcccatgaaacacacaccagaaacagagcctgacacatagtaggtactcagtaaatcagagtttccctctcttgtgtttctttttgagacaaggtctcactctgtcacccaggctggagtgcagtggcaccatcagggctcactgcaacctccacctcctgggctcaggtgatcctccctcctcagcctccccagtagctgggactacagctgcccaccaccacactcagctaatttttgtatgtttttgtagagacagggcctcgccatgttggccaggctggtctcaatctcccaacctcaggtgatccgcccacctcagcctcccaaagtgctgggactacagacatgagccaccgtgctcgaccatgtatttcttttatgcctgtccccttttgctgctccctctggtagttctttgagaagtaagtaacttacatccaaccccttcaaggcattcatgatgctaaacccagttcttggtctgggtagacaaaacggagttttcacagtaaattctggatttcatctgaatcttttcattttaccccaagatgttggtatcattttaaagcacctgatgagtactcaaatgacaacatgaatacttagcagccaggacgttttcaaggcccctgatggcagaatgacgtcctgagcccctcaaggcagcagcccgagctgtctgcaggttcactggtcatcggggcccaagggcagccctgtccaccaaaactaattgctgtgatttggaaacaaactttcccacttcctttctgatttctttccccacagaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatatctacctaagaaggaagcagtaaatccataatttaccttttgggcaatgctttgtgagcaaaacaaagtcacttctgccataacatcttgaatttaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaatttatatatattaaatatttcctattttctataaaatagatgttgattttcatgcttcatctttaaatggaaaatttgcttcatgaggaagatttctcccaagatagcctgccatgactttgactccttggtaccatctgtagtcaatactgtcttcaaatacaaagaagttgttgtcaacagacattcactatcaggctgggtgccttaacctggatctaagggattaaagtgatgggtggggatttttttttcttaaatttcattgtccttaaatctagaagttataattcataatttttttcatattcataatatttttatcaaaggtttagtaaactctttagctacattttatttttgttaagtggacaagaaatcaagatatgatgaaatgacttacagccgcactactagaccatgaaaagtagccacaaatgactctaaatctcttcccttctacccttgaaatctgagcatctcttctaaatatcagcccagagagcccttaagaaagccggggctctcaaacattctcaggcacaggcttccaaagccacagaagcccagaagactgtatgcccctacaaaagttgtcccaactctgctctcttatctcatgcacaccttcccctcttacttgcaagttttgctttcatagtaggcaaagggggaattcaatggcgctttttctcttctacatgaaggaaaagaatgtgatggtcattctagcagccgcaggctacagatgtcctgagagtatggatcatatgaattcaaaggtgattcttgctaattactctgatctcatcaccatatatgtatcaaaacatgcagtgactatgtaccccacaaatatgtacaattattatttgtcaactaaaagaactttgaaaaggaaagaaaagttttttacattattccaaacactcttcatgaaattcttagacataaaattgttccacctgtgtcttttgatatttggttacagaaaaactggacatatggttccttctcaggaagataaatgtaaaggtttaaaacagaccccaaccaaatggagtgtcacattctgatacgaacgcaaagtcaatgtgtgctgactgcacaagcagtgaataaacacctgaccttgtgacactggaatgttgcaaagtcatgaagtttaaacaactgatgatgtacaatttttgacattccataggcagactatatcccttgtagtttttcttaaagacagtgtttactttcattttaataatcccactcttcagcctcctagatgtcacctagtttatatccttctggtgcacagctgaggctcaaaattcccagcaatattgtatctctgcagaaaacttgcttgcataagacttttattcactcagcacacatttattcaacagtgaataagagtgggacacaagtaggcagaggcgttaatacaaagaagacataatgtgggggcagaaactgtgatatacagtcaattttcattgtttgtggtagttcctttctgtaaagttgttgcaaacactgaattagtgaatactgaaccattgctcctagcagaaatacaggattaggttcctgtgagcctcaggtcacaatatttttgtcaacccaccactacataaccttgttttattgtgtttctgtttaagacaccttatttaatatatagttcttataagttagttatctgcagtatttctttataataaaaccctagcagagaaggatttaacatttccctgatgctgggtaacataactgtaaatttcttgggctttcagcctctcaacagtactctttttactacactttaaaaatcagttgtcattttatgagtccacaaatttagctgtttttctgtcttttccatagtttcttcatgcactataaatatcacttcagcactttccagaacagcctcatgtacatattggtgaacttccttttctggatgtactatattgttgattgattaacaatgaactcacaccaatagccctataactcaagcatgaacgaagctcatctaacatacatattttctccatgaggcatacccccagccttcttgtacttaggaacattagacagcactttagtgcaacatctgggggtcatttggaaagtgaaattaccacccaaaagcacaaaaatttgaaaaaaatggcaattaatagactgtaaaaagggcacatttatagtatgtgagccgaaacaagaaggaagcgagcacactgacctcagctgggaatgtgcattcacatcagtgactcccatttgttgacactctgaaaatgcccaaaaatgaccataaaatcactgcatgtattgatctgagggttacaaataagtgttagtgagtagatgaattcacaaatgtagaatccacaaataatgagaagggtctatacatacaacacccagtgacagattactgtgaattctacaagagcccaggggagtcaaaggacaggacgtctcacctgagctggaagagcttggcctttatctgttaagcaaactagagccaagaggcagagaaatgaactcgcactagttttgctgaaagagatttaaaatggacttggaatccattaaaacagacttggagtattaacagtaaaacagacttggacttaagacagacctggagcattactaggcacaggagcagggttgtaaagttacacccgtctttgccagtgttcttcacccgtttccacattagatgtattagaggtgtctcaccacctgccattcctgagctgaaactaatccatgataacttccctttcttttcattttataactcactcctttctcctatttaatgtagaatatttcagaaaacttggcattcatatgattaacctcagagaagatgcttttaaaaccaaaataacaccttcgatgctacacatgacccggagagaaccagatcagtccaggtgttacatgatcctaagatgccaagagctgataagatgagattactggtgagatccccaagaacaaaccccaaatcagcaggaaagtttgggttgccaggctcatgcctccctctcttgttatcatgcccattgtttgtcacaggaggtaggcttatcccagtgatgagtgagtgctaagcccaaacccctcctcactgccagaggaagtctttaatcggcagaagctaagcttgagttgtcagtttgcctctgcccacaactccagcatggccaagacatggaactaaaatccttcccataggccagactagtctgtcctttcctggctagctggctagcttgggcccctgagggtgcaaaggagatgctttgggttggtaacctgaatgactagtggttttgttgaggatggactggcatgatgaagggcagagtgatctgtgaatccaattaaaagactgttgtaacagtctaggtgaaaaatgcttgtgggcaaagaagtggatagcttttaaaacatatttcagagctataatagaactaataagatctatatactagcttgttttgaaatggtgggggaaaggaattatctcaaaatgactctggatcttctagcttggaaaaactttgtggtaaattatttaactgatatagagacaaagaagaggagaagcagattcgtggggggcagcagagcagggagagagccaggttagaaaggatggccaaatgagctctgatcacacaatgcttgtggtgactgtgaaccatccaggtggagatgcccagcagcatctgggcatatatataggtctgtgatcgttaattttgtgtcaactttggtagattatggggtgcccagattaaacatggtttctgggtatatctgtgagggtgtttccagatgagattagcatttgagtagacagagtcagtaaagtatagttgatccttgaacagcacaggtttgaactgtatgggttcacttatatgtggattttttttgacaagtatattgtaaaaatttttgaagatttgtaacaatttgaaaaaactcacagaccgtgtagcctagaaatatttaaaaagttaggtattcatgaattcataaaatatatgtagatactagtctatgttatcatttcctaacataaaatatataccaataaattattaaaggttataatttatcaaaatgtgcacacaaacacagacttacatggtgtcatttccaactgagagaaatgtaaacacaaagaggcaatattaaatcacaattgcataaaatttattgtagtacataatatactactgtaataatttcatagccacctcttgttgctatttcagtgaactcaagtgttacaagaacttcttaaagttccatgtgatgctcatcatctccatgtgagtagtttgtctctccagtaaaatgcatatcacaataaaaagtaatcacttgcagttcttaagtgtttttcaatgtgcaatattgtaaaccttgactaacaccaggggacccatacgaagtaccactagtgatgctggaagtgctcctaagaagcagagaaaagtcatgacattccaagaaaaagttgaatttcttgttatgtaccataaattaaggtctgcagctgtgggtgcccatcatttgaagataaatgaatccagtgaaaggaccactgtgaaaaaaaagaaagaaaagaaaagggaattcatgaagttgtggctgcagctataccagcaagacatgaaaatagcacttttagtgaaataccttttaatcatatattgaaaatgtagcttttatgtgtgtacaggattgctacaagaaagacatacctacaggctttaatataatttgaggaaaagcaaagttattatatgataacttaaaacaaaatgaaggcaaaggatctaaacctggagaatttaatggcagcaaaggatggtttgataattttagaaaaaagtttggcttagaaaacgtcatgataacaagataagcagcttctgctgaccaagaggaagcagatgagttcccagatgtcattaagaaaatcattgagaagaaaggatatctgcctgaaaaggtttttaatgcagatgaaagtgctctattaaggagaaaaataatgcaaaggacatttattaatattattaagaaagacaaataagcaccagaatttaatgcaggaagggataagctaactctattgttttggcaaacgcacttgggtttatgatcaggatttcccatatctataaagctgctaacttcaagccttgaagagaaatgataaacattaggtgccagcattttggttgtaaacaaggcctagtcaagaagaactcttttactggattggtaccactaatgctttgtcttgaagtcagaagtaacttaccagtaagggattgccatttaaagttcttttgatattagacaatgcccctggccacccagaaccacaatgagttcgacactgaaggcatcaaaatttgtctacttgcccccaaacacaatgtctctaattcagcctctagatcagggggtcataaggacctttaaggctcattaaacatggtactatatgaaaggatcatcaatgctatataagaaaacccctctagagagaacatcatgaaaatctggaagtattacaccatttaagatgtttttgttgttccagaaaaggccatgaaatacatcaagctcaaaacaatgaattcctgttggagaaaacagtgtccagatgttgtgcatgacttcaccgcgtttatgacagagccaatcaagaaaatcatgaaagagattgagaatatggccaaaaaaaaaaaagtggggggggtgaagggtttcaaaatcttggattagttcaagagctaacagacaccacatgagaggaattaacagaagatgacttgatggagatgagtgcttccaagccagctgatgaggaaggagacatagaagcagcaacagaaaacaaatgcatacagacaacctagcagagttctgcttatttaagactgcttttgacttcttttgcaagatggacctttctgtgaaatggtcactgaaactaaagcaaatggtggaagaaggattgataccatatagaaacatttttagagaagtgaaaaagcaaaaaaaaagtcaaacagaagtcattatgtattttcataaagttacattgagtgtgccagtctctcttacctcctcttgcaccttctccacttcttccacctctgtcacccctgagacagcaagaccaaaccctcctcctcctcctcagtctactcaatgtggaggtggtgaggatgaagacttttatgatgatccatcaccactaaatgaatagcagatatattttctcttccttatgattttcttaacattttcttttctctagcttactttattttaagaatacagtatatacatataatacaaaatatttgttgattgtccatttatgttattggtaaagcttccgatcaatggtaggctgttagtagttcagttctggaggagtctacatgcaaattttcaactgtgcaggggtgtggatgcctccaatttccacattgttcaagggtcaattgtaaattactctccccaatgtggttgagcaacttgcaaaccactgagggccctaataaaacaaaggcagaggaaggagaaatttgcccattttttcctcactcactacttgagctgggatgtctcatgccatcttctcctgcctcagactgggatctacatcactggctttccacgggcttccagactcagaccaaattacaaccgcagctttcttggatctccagcttggtgacagcaggtcatgggacttctccatctccaaaatcatgtcagctaattcctcatagtaaatctccacatatatctcctatttgttctgtttctctagagaaccctaactaatataaggtctgaaacccaaggaaatgatcagtgcccaaggctgggggtatatcactttactcacttaagtggtgtcattcctgaccatgtacttaatgatccagtgatgcccagccaccccttcatgtccccagtgactacattgacctccctatctggtgggtcataggtcactgatagcctaactctcccgctaggctatagacttttaagggcatggatcatgcctcaattaacttggaaacttcatctgttaggaccttttctgctgcatcattctataagcgtttgttaaaatgaaccagtttgttaaacaggacataacaatgatagaagttgcaaatgtcaagatttcattctttttgtgcctgaataggattctgttgcctatatatacattttctttatctagtaatccactgacagacacttatgttgattccatatcttgaatattgtgaatagtgctgcaataaaaatgggggtacagatatctcctcaatatgctgattttatttccttcagatatatacccagcgattgatagatcatatggtaggtatatttttagttttttgaggaacctccatattgtttgcaatggttgctggactaatttacatccctactaacagtgtatgagcattcgtctttctcagcatccttgacagcatttgttattttctttttgataatagccattttcactggggtgagatgatatctcattgtggttttgatttgcatttccctgatgacgggaagacaaatatcgcatgtcctcactcatatgtgggagctaaacagtgaatctcatggaggtagagagtagaatggtggttgccagaggctaggaagggtgtggagggagggagagataaagagagattggttaatgggtaaaaaaacacagttagatagaataagttctagtgttcaatagcacagtagggtgactgtagttaacaagattttatagtatatttcaaaatagctggaagagaagatttggaatgtctctaacacaaagaagtgataaatgtttgaggtgatggatatgctaattatccttatttgatcattgcacattgtatacaggttttaaaatatcacatataggacaggagcggtggctcctgcctgtaatcccagcactttgggaggccgaggtgggcagatcacttgaggtcaggagttcgagaccagcctggccaacatggtgaaaccctgtctctactaaaaatacaaaaattagccgggtatggtggcggacacctgtaatcccagctactcaggaggctgagacaggagaattgcttgaacccaggaggcagaagttgcagtgagccgagattgcgccactgcactccagactgggtgacagagcaagactccatctcaaaaacaaaacaaaacaaaacaaaacaaaaatcacatataccccataaataggtacaattattatgcaccaataaaaaaattgttttaaaatgatagaagccatggaaaggaagccataagccagggacactgtgaagagtactctaaagctaacaaaatcacttctattttcgattttgactgctttgaccctccccatcgtacagaagatggagaaatagcttgatatggtttggatatttgtccgtcccctccaaatctcatgttgaaatgtaatccccagggttggaagtagggcctggggataagtgtttggcttggcaccctcctcacagtaataagcgagctctcactctgagttcacatcagatctggttgtttaaaagtgtatggcacctcccctgtctttctgtcttgctccctctctcttgcttccactcttgccatgtgatacgcagcttgccctatactttcttccgtgattggacgcttcctgtggccgtcaccaaaagctgagcagatgtcagcaccacacttcctgtatagcctgcagaattgtgagccaatccgacctgtttcctttagaaattaccccgtctcagatatttctttatggcaacacaagaatggactaacacaaagctggtcttctaaaaagttaactgtgattgtttctgaaactagcacatgctgaacacctgtttacaacaaacaggaacatttgcttccttcacgcattcaataaacacgtatgaagcactcattgtgtgctagatacttatcttaggcattcagtgaataaaaagatgaataaaatgagggaataaaacagacaaaattccctgtcctcatggagcttatgatctagtggagaaagcagccaaaaaaaacctaaataaataattgtccaggtaagctctataggaaaacaaaaacaaaaggaaagagatgggcaatgggagagttgcagttttgggtaagatggtgaggaaacaccctacagagatccgattcaaaactacaccctgtcagagttttcatttccttccactccactcaaattgctaaaactacactggtgggaattatcaattaatcgatttgctgatcacctatgtcttgtgaagaaaaagaagttcagcaacttagacacatgcgtcctctgagaactgtccttgctgataaaggacggctacatcttcccgggcagtcagaaagcagggccagcaagggatgcacagatgtgagaacaccacatgtcccaggccactccatttaattgttatgcctaatgataatggggaagtcattggttgtcctgatttccagaaattggcatgtcccaatggccaccagatacttcagagagttctcatatgagcacttctcgtgtgcccaggagcaggccctgtggatcagctttgttgtcctcatcacccaccccgtcaccactgcccctgctgccaatgaccctgtcagctcactgcctgctgggcatatctcccttctgctctctcaacaccgaccaggctttgagaggagacctgattctccccttgacatctctctgtggagctggtctgagtaggtaggtatgttaaatccccacagcacacctgagactaggccgtcactgctaataagactcaactaacacactagaagcgtgttagaagtggagcataacttaaagctgctaataaaggtggcccctcttcgagcccattcacccaaacctggctttggaggctcttatctatccggcctgtcctgccatcccctctatcagctcatcctccatgctgagaaggagtgagcacttcaccttgaagcaagggccccagtgatcccaagcccacctcactctaaggcagagttcccccacgtcttcataatatgagaaacatagaatgtgatggcaggaaaaatgtatcacttcaccttgggagaagagctacttccatctacttatctatagggtgtggctggaccctctgattccagaagataatcacacaatggacttgcgttgattcatttccctaaatccggttacctcataggaaacaccaccccctggtttcccacaggcatagtcggaaagccagccaccaccagccctgcaaaagtgggtagtacttgtggcttcactgccttcccttgctgggaccttgtcctcccagcaaggtagagcaagtttctctttagtaccaccctgttccagaaccccgtttctgtgtgtatcagtcatcccacctgctgaaacgctgactgatgacattttaatatgaatgagtttcagacagaactatttcactacatatttgcataattaagccttttatctctttattgggaatcagaggctttgtctcctgttacatggatttcaggcatcagcaggtaggtgggagctatttttggaacaatgaacagcctgaaattatacgaccacatacaaaagcctaaacctgagagtcgacctgaccttgtcttctaagatgattaggctgggcagaagcatttctgcctgcacaggtccctccttctcctgggagggtggggagctgcgcatttccaggacagtctggggaggagaaatttgtcttgaattcagaagagctcttcctggcagccttgctgacatgacccttccttcaccttgttcctcttctcgtattcccttctcatgttcctcttcttgtattcttccggattccccaaatcccaccttttcttgtggaagaatccctaatgcctttgtgtttcagatttccaagcccatcaagcatttactgaagaaatgcccaagattgtgtgtggtatacactttgagtgaataccgtaatgctcagctttgtcagaaacttcctgcccaaggaagacctcagagaatgcccacatcacctgacagaggtgagagcccagggagaagggagcacatctctaaacagacacaagctgaagatgttgtatgaggaagcacccaaccagggtgcactggaccaaaatatagaacaactggatttttgtgctattgcttggttttccttgtggtcctccaatttctctgttgctacctcatctacatattaaagtaagaggaaacaggcctaataatcaatcctacgatgagtagttagaagccacagataaagagtcctgtctttcctggagatgggcaattcaaaatcacttgggagaaatacactatccagtcatccgaaattaaatatgttctctaaagagcagccactagcgggaaacaccatcatccatcaccggcccctgctggagcctctgtctgtgaggctgagcctggggcggcacacaaaagaaccacaggttccagaaccatgtttctcttctagaaccacaaaaaacagaatgcccaactcaaaagaaattggaaatggcaaaggagggcacatttttatttcgttttctgccagttttcagggattccagtataagcccactagggtatgcacacaacacaaaagacatcagccaacccaatgcaaacatcaaaccagctatgcagcatttcaaacaaaatacagccattatttgactgcattgctcaattttcagaaggcttgtggctgtcctaatcttccccatacatctcaaagttcatacttttaagtcctctagtcctcataactagattactgtacagggctcagattattgcaaagcaggcatcaagcagaatacttttgcataaaacaaagggattttaaacacagtacacacagcaacagctgctgcttggtagaactgaatgggaatgggagaggggccttcttcctctgagaagatagaaaaacactctgtaacttttgttcaaggatttgggagtataaaacaaacagctcgtcgtgttcccacattccatagtcaagatgttctgcagagattggaactaaactgctcaaagtgacatcaggaactatgtaaatcaggaggagagcctctctggggctataaatctcaggacaaggttaaggtcacaaccccggaacaagggaattcagacccctcttctgagagactgagggctgaatacttgcatactgctggacaataagaaaatcctatcagcagcaagcaggcatggcactttaccaatgaattttccaagtggaaatctgcggcttaatgaggaagaaccatggtgaaccagaacttcagatctagtatgtttgtacacattaggggaatcttttgaggccctgaatgctatctgctctttgtcttcctgcctcagatcattacctaccatacatggaacaaaatctccattaaggaaaaagtgagcagacagcaacaattccatgctgacatgctctggctctgtgtccccacccaaatctcatcttgaattgtaattgtaattgtaatccccatgtgttgggggagggaactcgtgggaggtgattgaatcatgggggtggtttccctgtgctgttctcgtgatagggagtgagttctcatgagagctgatggttttgtgaggggcttttgcccgcattttctccgcgcttttcttcattcttcattcttccccttcctgccgccatgtgatttaccatgattgtaagtttcctgaggcctccccagccctgctgaactgtgagtcaattaaacctcttccctttataaattacccagtcttggttatgtctttattagcagcatgagaactaatacctgctatataccagggaattttcctatctatatatagacatatacatatacacatgtatatgtacacacatatatccatataatttgatattatatacaatttatgtatcagtcctcacaagtccatactatttgtattttttaaaagagtaaattgaggcacagaaaggatgagagacttccctgaaatcatcactcaactgggactgaactccaggcaatgtggtatttacttgtttgctgactttagtgaggagggctcctctatggcaggacaatgagatgaaccacccagagtggaactcaggaagacccagggcagaattaggctgaatggatcttctagagagtgaaatgaggaatataattgcaaagaatctccatcatgaagaaaacattaagggccaggagcctgcacagcatgacttctgatgagcgccggccctaaaaaggtgacggggcacatttgcagggacatcttccacttcttgttcagccatgcaacttctgccctccccagcaccccactgggagagagaagatgctaaggtgattcactggggttcatggcattgtttgcacagcacattattagcacagcattgccaggtgtcacacatagtgtagctcctgtgggcacacagctgggccagtgagtaaagcctcatgtacagatgaatctgccatcccagccctctggcccatgcaagctgaggagtgaaagactacttgccttttactgcagttctctgacatttgcacagctattaatagagatgtcttttgactccattctgctattgttcttgtgcatagagattcttcagagcctagtgggaaggactgagaagaggtgatcaagatttcagcattttggggtccctgacagtaatatctaatggcactaaattatgtcttctttcttgaaaattgggcagaataccaagtacaaatgcaaaagatgggcatagcctctaagagtgacctcaggatgcctgaagcccaaaaatgcattgaggttttcagagacgttctgaggatgcaaaacattttttaaataataaaattagacttttaaaagccatatttatgcaagaataaacagaaggaaggaataggcttctacctgacatgatataatgtcaatagaagacaaaaggaagggaaaattatttcttatttatagcattctcatctttccagccataaaaatctcccctgctaaaaaaatgtagaaaaaaacttaatggttaagaggaagtggtgttttaaaaatacgtccaaaaattatttgatgctctctcttcaagaggtggagcttaattttccttcccttaagtgtgggctttatttagagacttgcttaacaatagaatatagcagaaatgactgagagtgattccaagggtgggttttaatttctcttgggtggatacctaggagtggaatggctggaccatatggtacatttttgcttaacgttttaaagaaccgccaaactattttccaaagtggctgcattattttacaccccctccagcaatgtgtgaggattcaactttctccaaatccgccccaactcgtgttattgtcagtcttctggattagagcctctcggtgggtgtgaagtgccttctcaatatccttcacagttctaaactttaagcaaaaataaaagttccaagtgatcacattaaatgatagaattcaattaactcaagttctggttcttcctctttacaatcactatgttgtccctgtttatttcaaattgacagttttaaaaaatcacagggattggaaactggaattgaattatgcccacagcaaaacagaataattccaaactctgacttactcttagtcttacttactcttgaaacaaacccatgtagctgagtctgcttgtgtcaaggactgactatgaggaggaggttctctaaattaacctccttgttggcttttgaagtgtttattaaataatcaataataaaatgtgctaatatgaagtttgcatgtattctctcacaattcagcagtgactgcagtaattcatcacaacttaggacaataaactattttactgcggaagaatgatttatcactaaattatttagaattgccagctcatagtgataataaaaggcagttcaaagtttagtcggtgttcttaacgtttttaaatgatctcaggtgatgcaataatgaacccttcctgctcatgccccagacagatgctcccaccccctttgtggtaccccagcccaagaccatcccctcacccatggaggaagctgtgagcatatagaaaagctgtggcttcttactgactggtatgttttttaaaccggaggaattgcaatggtttatcacttttataaattgccaagggacactggctatttggcaagtggtttcttataaagcaatgaggggagatggagagcatcttcctgctcttgcctcctagaccctcttctgaaatccacttgggcctgggcttatccttatttgtgctctatcttgtttttatagattccccctgtgaatgaagaagagaatgtgctaaatgaacacagcttcaatgtgatctgatcatcaatagatttaaccaaggagaacaaaagagaagcaagtgaacgcattccagtactgaccagggtaggggtgggggacactaggacacccctcatacttaagcatgcaaaggcagtaaacctttgagaggcacacacggggggctgagcaaaaaagtgcagttacctcgaaatgacaggacgactcccagttcagaatgacgggaagttagttccataaaaccacaaagaatgttctgccacaggggcagatggtcagtcttggaaccgcaggaaaggacaagaggcgaaagttgaaatgcccgcctgagacctgcctgggccatgggcttccagagcctggttccctgtccttgcagctccctggggaaacagaggccacaggcgtctcacccttgcctcatttaattctgttctgtgctcactgggaaaccgtctgattatgaatttgctcccacactgggaggctcatagagagaaaatgtgtatgcaggctcagaaactatttctggatctcagagcagagcaccaggtataagcggggctgaggggattggggggtagacagatgaacaaaaccaggacctccatacatggggcttccaggtcacagaaagcattcttccagccccgcctccaccccagtgcctccctccgagtcatcaggcaataccttagccaggccaaaagtagttttaaagaatgtctctttccaaccatattgaacatttgcatgattgggcattctcaaaaaaaggagcccataaggaaggcagagtcctcaagaatggacatccgagggcacacgccaagctccagcaaagggactcctgaacacgagtgctggtggaaaccacaacctcaaaatccagctattttcaaagaacttgtgctcagagcatcatcatgcaaattaaaattgtggtagccgttcttcttattggtgcattaacatctctgaaatttagatgaagaagggggtcacacaaagtggcaaaattcaccagggagtctattgttgttattgtttaatgtggccattcttccagaaattactttcccacaatcacccatctctacaggaacagagctgttctgagcggcacgctaagcacagtttctgagaagcccaaaacctcaaaaagactgtttctattttagaggacaaactatgaaaggtttcttctcaaatgttccatcttgaacctccacttttccacattaggtaagtatcaaagtgattaaatgaatcattttctgttcccaataccaaaagaaagttcatctcagtgtaaaggcaagcaaggagggagtttgatatgagagcatttattgaagaaaaggctgcagcactccgcgtgaagtgaaaggaatgagccctaagacctctcctaccctcccattcgcttggagaacactgaatttgcactcaaaggtctgtatcaagggtcatttaaaagctatacttgctttaatggttagttaaggtaacagtggatttaaacgaaccatgtgatgtatcagtgaggagagatggtctttaaagatcataagacttttgtcaaggaatcctagcagataatggcccaacaaggagggagaaaatcaggggaagagggttgactgaaggtaaagtagcctggagaagtagcagcactccctgcagcctctctttagttcccaagtgagttacatgacccccgaaaagtctggaagatttggttttagggttttattggcattctcagtaacaagtgatcacataaagccttttacagtcacagatccctgcttcccttcttaatgtgctaaaactccaggcattaagggaaatgcagcaattcagaagttcaattgtatagattgctctttttttgattcattaaaggactttaacatgatgaagctggtataataactggcagatatattaaactgcctggtaaaatggctgtacagcggcctcttcgtttctgtggcacgaacacaacctggcaaatggcgcgctcaagaacatggcgctcctgtatttatttaacaggctggaaagatgaaaacaattctcccagtgtgcccagtggaaaattattgctggcgggagatagtagctacaggaacaaaaaggtaggaagtcaggtctgatgaaaatgagctgaaagctcccctagcgccagcccggtgttctttttagattttatattccacaaagagaacataaaaggggaccttagcatacatgctcgtttttaaaataattctgttccctccctccctcttctttcttttgtttccttccttccccttcccttcccttcctccttcctttctttctcctttccttccttctcttccttctttcttttcctccttccttccttgctttaactctataactctaactcttcccttttcttccttcctcccattcttctttccctcccttactccctccttccaaccatactaagtactccatgttaacaacctaatgttgtagacaaacacatacacccactaatatacatatacaaatacctatgtatatacatagttttgtcattgtttattaatattagtcacagaaatgcagtgttatacatttttctgcacctagatttttctcagtaaatacatcaaggaaatcctaaccaactgaacggttttgcggtaatttattctttttaagggctgcataatattttatgataaagatggattaaaacatctccctatttatgtttcagaattttagttgtatgaataatgttataatgaacattgtatatatatgttcttatgaaattatatcattatgtatttctattatttagaatagcttcccaggaatgaaactggttcacacaagtgtagtgaatttttattttgaaaaatgaagatatagccatactgcaatttaaaaatggctttaacaattcacatttcatttgcaaaggatgacaacaccttttcctctgcattcttacctctaaagagagtgatagtgttatcattctattatttttttgttagttatatggttataaagggacacaaatttgcatttccttaagcactaataattttgacatctatatgtttatggccattgtatatacttttgggtaaattatccacttatgtctactttatattatttgttgcttattagaaagaactcttggtgtttaaagatgttaactttcatctatcatctgtgatgcaaatgtatttttaactctataatttctcactgacctcgtttcaatctcctacagattttggtttcttttcttggttaagaagtctctacaaaccctaaactgtatgtataggctcccagactttcttctgaaaattcattcattcactcatttatctattcatttatttatttttacactgaagtcttcagttccctggaatttatttgtctatattctgagaaacaagtgcccatttctattttctcctggatggagagtcagcaccttccttctcaccctgaattgaaatagcaacttcataatatattaaagttgcatatattttggaagctagttggaaggtctgctattcaatcactctaacatgtttatttatttcaaaaactgtaaatgacttatgtatttgattatagtgactttgcagtgtgttttaatatctacactcactattcttttcatacattttattcttgggcatttaattttctatataaactttaagatcacttaatattatttgcaaatggtgtgcttctaattggaattgcaatatattgtgtaataatatacatcaatattatatacgttatatacatattgatgtatataatgaatttggggggatctaacatttaaattattttcagtctacagatctaaaaacttagtatacctctagaacttagtatgctgttccatttgtttgagttttgttctcaggactttagttttcttcacacaggatttctttgcattgtattacgccacgaattaattttttccatttccatgttagatggacttttgctgttgattattacatgtgcatattttatatgtccccattttatcaaattatctcatcaattcaaatactttttttcttaagtctgttgggtttttcaggaatacaataatattatcaacaaaaatagagttttaatctttcttttccaatgtttatataaatcgttatttttaaaattttattttagagatggggtcttgctatgttgcccagtctggactcaaacttctcagctcacaggatcctcctgcctcagctttctgagtagctgggactataggcaggcatgcccctccacacctggcattgacaaattattttactgccttttcccac

SEQ ID NO: 1785 - DNA, 130581 bp, Homo sapiens
  KIAA0853 gene - 45434315 - 45524895 of chr13; NCBI Entrez Gene ID: 23091; Build 35; sequence includes 20,000 bases upstream of initiation codon and 20,000 bases downstream of termination codon of the gene
catgagaagggccaagaagaaacctccattcatattgactctaatttatatcggtgaggttgtccctaatgactgcccttctcaccctgacacctctgccctcctattagacatcctaccctctacccaaactgcttgctgaatctttgtaagattaaattatttaatccacaaatatttatagattgcctatgatgtttcagatcctggaaatacaaggatgaacaaaatatagcccaaggatcttatagctgagtattttgctccaacaatgtgaacctgatttgtgtagcccaaagaaacataatcaataagggctttttaaatcgacatttaaactccattcttgcctgcctaaaactaattcagatcatctgactctcttagtacttcaaagcactggaggagggaaagtaaaataaaatatttacctttcaacaattgtgaaggtaggttttatattcaaaaactaaaccacccaaaggcaaattaaaatcttagcttttaagtctctcactcttttctacaactcaataaggatttcaaaaatcttataatctagtctcagtggaaatccactacactacactttgagaagcttgaagccagtcatttctttctaagcttctcattcatgtactctcgggaggcaaatttagatccttctctttccgcaaaggcagagctgagaccaatttgtgcatgactgcatcaccaagccaaaatccggcacagggctggcacatcataggacccagtgaatatatgttaaccatcacaacttgccaagtactttttctgccaaatggcttttctcactgctaacctcctgccaaacctctgccctagaaaactctcatctaattgcacacaaagttagagctctacaacctcagggccttcacagaattatctctgcccctcctcaccacagctgacacatgacctaaggacactgctccctggtggctccttcaagtagaggggctgctctttttttcacatcaccatgtgctgagaggcctggtggagtagatcagcattctcttctcctgatactaccaatgatccttctcttctcagaaacttacacaaactggttgcactcttattttattgctatcgtgcactgaccttcagataatttcctggtacccggttcatgattctttattcccctccaactcttgccatcattctgagtgaattcaaagtccatgtgtgagagtcacctaacaatgtatcttcacagttccttgttctctgttctactaaacctcatctcaactcctctttagcagatttctcctgtagccatcctctggatctcagaagtaatgttttgctgatccttagacccagaatgtggccatggacagcaacaaggaatgttagaagaagccatctagcaatgtaacttcttaatttcctgtcttctctcatttctcacccctactatgactgcttttttttcaaccttagcatatttctagttcctacacagatctatatcattttaatttatcagtccctttccaggaacactttcttcactaattggtcccatcacaaattcatccgaaccctcaatttcttgctcccttgacctgctcttctggagttccaaccccaaacactccacagaattaaccatcctttttctgagccaccttgtacatcttgccattgtttattatcatacttatattaatagcattgaactgctgcttttccctttccaacttatcacttctattagctttctgaaggcagagaccaggtctaaagtaatttttttgttccccataacctggtatattgtttggtcaacataattggtgctcaatatccccttgtggaatttgaaatttaaattaatgttgcaggtttaggctgacatacaattttgggttgcagagagtatctaaacagtacctactgttgggataaatactttattgtcattggctacagttcaaactatacatacatatatagagattggagtaaaaactgagacggatagctctctgatatatttgtaatggtaatgaaaatgacattttgttttaaaattttcccttcatgtgtcttatatttttttttagcaaccccattaactgacctatatgtcgttatgtactaatttattatctctcaaatggtcattggttaattcctaggcaggaattgttgttgttgttgttgttgtttagggccacattaaaggcaaagcttgagtgcaccccaggcaaagtgagaggaagagctgagtaatcattgaccacaggccagctgatgggaatcaatcccaccctctcatcactcagtcttacactcttctccattctcctctattctcatcttctttttcttttatacagaggcttctcaatttatggtggggttatgtctcaatatacccaataaacaatcacaactgaaaatattctaagtaaaaaatgcatttaatatacctaatctaccgaatactgaatatcatagcctaaccttccttaaatgtgctcagaacacttacgttagcctacagtagggcaaaatcttctaacacagagcctaatttataataaattgctgaatatccatatcacttattaaatactgcactaaaactgaaaaatggaatggtggcatgggtatggtttctactgaatatgcattgcttttgcgctattgtaaagtcaaaaaatcataagtgaagtcattgtatattgcagaccaactctagtaggacaggatttcagttatgttacttgccatgttggtaaatcgtaccttcaacaaatatttatttgtcgtcaggcaaaatttcttcagtcactttgaaaaacaatgtggaagttcctcaaaagattaagtatagagttaccatatgacccagcagttctactcctaggtgtatacccaagacaagtgaacacatatgttgacaaatgattatagcaatattattcataatagtcaaaaagtggaaacaactcaaatttccatcaacttatgagcagaaaaacaaaatgcagcatattcatgcaatgaaacatcaatcagcaatcaaaaggaatgaaatactgattcatgctacaacatagatgaatcttgaaaatactatgctaagtaaaagaaaccagatacaaaatgccacatatattattccatttatatgaaatgtccagaatgggcaaatccacagagacagaaagttcattagtgattgtcagaggcttggggaaatggcaggagggaaaggggagtgagttataatgggcataggcatggggattttttatgatgaaatgttccaaaaatcagatattagtgatggttgcaaaactctatgaatacaccaaaaaccgctgaatttcacactttaaaatggtgaatttctggaatgtaaattatatctcaataagctgttaaagaaaaaatgggcaccccttccttcgggattgtagctatagccacacttgaaggtgtggcttggcacacagcacagactgtatttcagccctcactcactccttctgtctggagtcctacctattagataaagaaataggtaacattgttctgggcctaacatcggtaatctctcagagcataactttttgtagaaagattcccatccaaccagaggtaaaggtaggaaggaaatttaaaaagtgaagcagaaaaagaaattcatatgctgcatctattaaaagtttggcccatgttgtagaaatgaaaatgagaaatgctttattatttgctttattattttaaaaggaacaggctctcctaatatttttctaataatgaatgctacattattactgaaaagtgatgctaacataaatttataaattcgtaacataaaaatgtatttaactggttgctcgactatttaaaacatggcttccctggaaaccatcattctcagcaaactaacacaagagcagaaaaccaaacaccacatgttctcactcataagtgggagctgaacaatgagaacacatggacacagggaggggaacatcacacaccggggcctgtcgggggtggggggctaggggagggagagcattaggagaaatacctaatgtagatgacgggttgatgggtgcagctaaccaccgtggcacgtgtataactatgtaacaaacctgcatgttctgcacatgtatcccagaacttaaagtataataaaaaacaaacaaacaaaaaaacaaaacatggcttccttcattctacaaattttgcttccttttcattaaccttttatttctgacctacagtagattttaaaataacttttttcttttctttctctccgatttcataagtatttattcatggcaaagatttttaatgtgactcttgtgattgttctagggaaatatgaatataatattttaaacgtttaaagggaaaatagtaaagtttataaaaggcttgtttttattttgtcaataatgaaaaagacatttcttaacaatgtcatgagtatgctttaaggcaacaaacaattataaactaaattaaatatttaatgtaattaaatgtgaattaaattaaaatatagcaatgttgccacaaattaagattttgaaccaaaagctttgtcctagatgaaacgatttgaccagctaaaatttgtctttatagttctcctgcctgtacattttgtcattttggggtaaacttctcagtcaccaaatttggatgccattggatcacactgcaatatgtgccactaagctggatgactctaaagtagagaggaacaagtttgagatgatgtccgttaggaattcatagccagttcctaggaaaagctaccctaattctacagctagatgatcaaagccttgggaaacacactcaattctagcaaaacttgagctccacaagttctaaggacaatgtagccaatatcatgtaatcacatctggggataaaacatggtaggtagtttaagctctgatgaacatgaattacagaaaaaggagctaaactaaatctaggtttttgtttccttaaatcttcttagtgggctctatggctttaataaagaattaattttattttttaaggaaaatttagaaagtttatggttcgattgtctgccttcattaactaggaatactggaccacgtgtaaggcatttatcaccacttcgtagcaccctaagttcagttcttttgaggaattagcactctttctgaaagttaaatctgcaaatctaaacatgccaaatgacaaattaaaaaaaagaaaaagaaacacactaagtttagaagaacttaaaacatctaattaaatatacttggtttaatttgcagataactcaattctatgggataatagggcaatataccaatctcctgaggcttgtggatttctatgttatgccagtggttaatgtggatggttatgactactcatggaaaaaggtaggagaaaaggcaaagaagacaaatcatgttctccttggggatataggatatacaggttgaattattcatagaattctggatctaggcacaatggctttattattaattttttttaacttttattgtggaaaatgtcaaatatatatataagtgcacataattgtgtagtaaacttctatctacccatcatagagcttcaacaataattaactcatgaccagtcttgtttcatctgtattctctctacccacttctaccttactcattttattttgaagtaaatcctaggtaccatatcacttcatcaataaatatttcagtatgcatttctaaaaaaaaaagaactctgaaaaaaataattatagtataattataccttaaaaactagctgtttctgaataccataaaatattgccagtattttcaattgtataataacttttttttttttttttttttgagatggtgtcttgctctgtcgcccaggctggagtgcagtggcacgatctcggctcactgcaacctccacctcccgggttcaagagatttttctgcctcagcctcctgagccactgggactacgggtgcctgccaccatgcctggctaagctttttgtatttttagtagagacagggtttcaccatattggccaggctggtctcaaactcctgcccttgtgatgcacctgcctcggcctcccaacgtgctgagattacaggcatgagccacctcgcccggcctcctaactttttaaaaagtatgtttctttgattctggatccaaataaggctcttacattatgattggtttatatgtcttttaattctattttaatccatgaactcacattccatcttttgctctttctctctcttctttttttccttgcaatttatttgtcaaagaaaagagtttcccattatcaggatttgctaattgcattaccatcttgtagtttaacatgctcttctgtctgtattttctggttactcaacattgtgattcatgtaaaattactcaagcaatatgaaatactctgctttctaatttaaagaggggcacatagaaacataactaggtatatataaatttagaaaaacctacttgagtagcacatataaatactaagaggaataagattagttggtgtgattggaaacatggaattacacatgaattatttcatgtaggaggtaatttatgcagaagatatggaaatggcacaggagattgaggaaaaagtcatctctggtgagaggaatactgtaactgaaaattttgtaggtggaggtgggcaaatgccaaactaagtaaatgagaattacctagcataatgcctaacacaaatttggtgtccaatgaatggtcatatctgtaaactggtaataaagtatatttacaccttaacctgaatcacagtggaattcagtcaccctttagatttccagcttcccaactgttctttgtatcattaccctattattaattcccacagtttgagaacttgatatccccagggcctattgttgccacggaaccacaggcctgggagtggtaacaggctggaaggcttggcggagggttggtgagagtaggagaaaagggtgctacatcatcccaaactcagaacttaaatgaagtatgtgcaactcttttttttttttttttttttttttgagacggagtcttgctctgtcgcccaggctggagtgcagtggcaagatctcggctcactgcaagctccgcctcccaggttcatgccattctcttgcctcagcctcccgagtagctgggactacaggtgcccgccaccacgcctggctaattttttcgtatttttagtagagatggggtttcaccgtgttagccagaatggtctcgatctcctgacctcgtgatccgcccgcctcggcctcccaaagtgctgggattacaggcgtgagccaccgcgcccggcctgtgcaactctttacatgaccaaactttcccagtttaccccaagaacccaatagggaatttgctttatatttaaaaaccagagtcaaatcagcacaatcgaagaagtcatcagattaaaggtgtcttcacatctccaccttttctagctttgaaaggggagtggtgaattctacctaaagagagcattttaacttatgactcagcgttcagttgagacacaaagttattttgcttttcttcgaaggagctcagaatgaccctgtgcataaaattaatgtaaaggaaacaagactaaacaagaaggctaataagcagcctagtggaatgaaaggaaatctttatttgtatcagtcaaaattgatcaaatattaccattatgtttggttcaactaaaatagtctgagtggatgtgattgaaacccggatagcaatagggaccgtgcaaaggaatattgcaacaacagtgatgtgatgaagccatgcaaggtatgggattgaaggagagaaaggcaattctggcttcatggactttcaaatgcatgtctttcctcaggccttgaacgtggctacccaggttgtctgtttgtattttgtttatgtagaatcgaatgtggagaaagaaccgttctttctatgcgaacaatcattgcatcggaacagacctgaataggaactttgcttccaaacactggtgtggtaggttgttggctttatttcttgcaatgtctcttcactgaaagggtgatgttcacagggaaaggcccatgaattcaaattaaatacagagctggcctgtctgaatcagggaataatttaaatgataaatgcttaggtaaatgtaatgctgcgactgttggccagagtcagcaaatcactttggcctctcctctctcctgtttccctatctttaaaataagaaagttgaatcagttttttaagatcccttctagcttcaaaattctaaaatctattatcttggaataataaagaagtgacagttaaagatcctattttaataaacaaaaacattcatcattagaatatcaaagacctgagatggggggaggacctctcttttttttttgagacagagtcttgctgtgttgaccaggctggagtgcagtggcacaatcttggctcactgcagcctctgcctcctaggttcaaggattctcctgcctcagcctcccaagtagctgggactacaggcatatgccaccgtgcctggctaatttttgtattttttttagtacagatgggatttcaccatgttggccaggctggtctcaaactcctggccttaagtgatccgcccacctcggcctcccaaagtggctcacaggagtgggccactgtgcctggcctggacccctcatttttaattgcacaagtaaatgtttacttctatagtgtttgaagacatttttttcactattcactttcttaatttctttaataaataatataaagaaaatataaaaatattaaaaatagtataaaaagcagcacagtgggaatttattatttcttaattcgaatgagttaaggcattcgatgatgttgagttatgcattcaagaacagtctgctttcaggagtttgaagattttttaaagaactaaaagtagaattactatttgactcagcaatctcatcactgagtatatactcataggaaaatgaatcgatctacccaaaagacacatgcaatcatatgttcattgcagcactattcacaagagcaaagacatggaatcaatctaggtgtctgtcaatggcggattggataaagaaaatgtggtaaatatacatcatggaatactacacagccataaaaaagaacaaaattatgtcctttacagcaacatggatgcagctggaaggcattgtcctaagtaaattaacacagaaacagaaaatcaaatactgtatggtctcacttataagtaaaagctaaacactgagtatacacagacataaagatgggaatagacactggggactcaaaaaaggggcagggaaggagagagaggggaaagagttgaaaaagtacctaagtggtactgtgttcaccatttgggtgatgggttcaatagaatcccaaacctcagcatcacacaatatatccatggaaaaaacctgcacatgtaccccctgaacccgaagacaaagaagtttgcttttaggggggtaggtgttagttcactctttcttcccacccactcaacattatttttcatagtactacatttcagaaacagctacgaaaataaactaacctgacaaggagtatgcatcatctatatttttgggctccatggggcccataagggagagaagctattgtatccacagaaacatcttcttcctcccagacctggaccctatacaatcctatgcacataattttgcctatttcctttaaaaaaggtaaaatttcatgattttaaacattttatcaaaatcccagaatacctattaaaacctcacaacattcagcctgggaaagctgattgctaaaacaaaagaaaaccaaacctcacaacaaagcacttaccttatttccttatttttttccctgtctaggttagaaactccatgcagacagaaaccaatacccattatctagtgcagtgcctggcacaaggagggtcctcataaaatattaactaaatgagtccatgaatgaatttagttgctctgagagctacagatatggtaggaactcagaggaagaagcagttcatcccgacttaggttccagggaatcatttagtggtttctccctaaaaaaccactcgtgttcccagaggcccaaagtttgctgtggcactaataacatgccaggggctcacaggaacagcagccatgtaaaaagaatctaagtaaatagagctgacagttactcagcgctgagccattgacatagttcatcttccagatttcattatctatgaatcatagatggagaaacccgggctgaaaacagttaagtcccttcctcaagggcacgtagcaagtatgtgcaagtacgtggcagagctgggctataaacccaagttatcagttcccttttggaagtttttattttatcttcaagctcttttggtgcttgattttacttaatatttttcttggtgaagtcagtgttatttaatttggatagccaagtagtcaaaatatattctgttattgtcatcaagaaatgtctcagtcccctcttgggcatggtgctatattgttatgtatcataagagtgaaaaacagaaacagaagcagcaagcatatgggtttttaactaaaaaaaaaaaaaaaaaaaccaaataaaaagtaattgtaaggaactgtccttattaccaactgttccagtatctattctgtactatgtaagcaagacagtgagaaagaagaatttaatcttttctcatccctacaactagaatgtgcccctatgattctttatataaaggatccaaaaacacctcacttattaacaggaagtgacatatcaaacctacttactcattttatgctcctctgtattaaaattttgtgtgtgtgtgtgttggagatgagagtggagggtaggttgtaggggtgtctttgtcttctcaggctgctataaccaaataccataggttgggtggcttaaacaacagaaatttattttctcacagttgaggattgggagtccaaaatcaaggtaccagcagagtgaggtcttcctgaggattctctcattggcttgtagatggctgccttctctctgtgccctcacatggccttctctttctgcacaaacctccctggtgtctctctttattcctataagggcaccagtcacattggattagagccccatgcctatgacttcatttcactttgtctccttaaaggccttatctttaaatacagtcacattggggcttagggcttcaacataggaatttgggaggatgcaattcagttcataacaggagtacattatgagaacctttggtctcaaacttcctaagatagcaccacacattttctaaaacactgagttcaactacaaagtttttgcaactggcttgaatggaaaattctttatttctttttctaggagactatagtgttttttaaaattattttttattatgataaaatacatgcaatataaaatttgccattttaacaatttttaattgtacagttcagtggcattaagtacattcacaattactactatctattactaaaattttttaattgtcccaaagagagatttttacttattgtaaccagtaggcaatatctcctcatccctaccttctccccagcccttggtaatttcttatctactttctgtctctatgaatttgcctattatagatatttcacagtgtgcttggttccatgtctatagatcaaagaatgcttgagcttggagggatccagtggcccaagttccttcctggtacagatgaggcccctgaggctgagacgatgaagtagttgcccaaattaacatgactgcttaatggtaaagcagagtctcgacctcaagtttcctgcctcttcagggctctttccactaaaatgcttgaaatctctagaatgacaatcatagaatgagaatctgaggctcactgtccagcatagtagccactaaccacatgtggctatccagtgcttaaaatgtagcttgtctgaattgagacatacactgagtgttaaatacacaccagaatttgaaggcttagtatgaaaaaagtaacataaaatatttcaagaataatttttatattggttacacttgaaatgatactttgtacatatttggttaaataaattacaatattgaattaatctcacatatttctttttgtgtgtgtgtgtgtgtggcagggtcttgttctgtcatccaggctggagtgcagtgtcatgatctcagctcactgcaacctctgcctcctgggttcaagcaagtttcgtgcctcagcctcccaagtagctgggattacaggcgtgcaccactatgcctggctatttttgtatttttggtagagacggggtttcaccatgttggcctcgctggtgtcgaactcctgatctcaagtgatccgcctgcctcagcctcccaaagtgctgggattataggtgtgagccaccgtgcctggccttctttttatttttcttaaagtggtaacttgaaaatttaaagtaaatatgtgacttgcattatatttctattaaacaaccctggtctgaggattcatattagggcaccacctctctatttagtggttatgtcttccccgacctccatacccaatatataatctctattctctaagaattatatatcacataaaagggcaggaatattcaaaggtgaccgaactatcaaaaatggtttatccaatcaccttattggttaaaaatgaaatacttgggaagaccttagatgttcacatttcctctcagggaaacaattttttaacaaacattaatgttgtgtttgtataataacaggaataaagcagaatgagcttaattaagaaaagcaggctctgtaaggatagtgagtagcctcagccatggactcctgaggcagagatgcagctggactcagaaacagaaaggaactgggcctggagccctagagaggctcagtgaatccttcctctccccttctcatctctgtgatgcacactggcttctttcaggtctcagtccacatgatgatgatgatgatgatgatgatgatgatgatgatgatgataaacagcaacagttatgaaatgcatactacatgccaggcactgtgcaaagcactttgtatgaactagctcatttaattctcattcaatcagcatttaatgtataatttttcaattttgcagataaggaaattgagatacagatagatttttaaaaatttacccaaagccatatagctaataaatggtagtcaagatttagaatcaagtaattgggtgcttaacaatatgctgtatagcctcttattctgaagagtggttaccaccaagaatatccagattgcatctcctaaaatgacagtatttacttcatagggctggtgtaagaattacatgagatgtggcaaaaatcttagcagagttcctgacgtacagcatgtgctccacaggtgtcagctggtagtattactatttttactgtctgttcaagagagcagctagactgagactagactcttagtattgatttcaagttatctttgaagggattcagattggcaagcacaagagtcagacccaatcctgagccctcaactgtttgcaggaaggaataatctcttgtgtcagatgcagcttgctggggcttcaccttgtgaattagggacagggggagaagtgttggaaggcagcctaccatctcaagtgatgcaaattataatctatcaaaggaatgaatgaacgttggtctggcaacaaatatcaccatcccattttatttactaaacttactaaaccactttagcaagttaaaagtagcactgaaggcagatttacatattctgagctctgaagtgaggcttttcttttatgggctatattgatggtagctttaaaactacaaatatcagaaaaactaaatttacagtggattaaggaaagtggggtttattttttctcccataaccataagtctggagacagggctggcatctctgaggatctcttagccactttctcaaggttgcaagggagacaggtgctgggaatgactgttagaaggtcagctatgtgagcagataagtatttgacttcaaaagaaacataacacttagtggaactatgttctttgcagagccctacctaatccattcatctaaaagtgttgcaacataggtaggagaatacgttgtctgggaaaccacaaattacagtactatgtgcatcccctcataatttcaccttaacaatttcgttacagaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactggtaagtgctacttaattatttttctcattagcattttggaaataaaataatacttagttgaagaatcaaaaactgggaaaaattttgtcctctagaaggcaaatgatagatgttttaaatcatggtgtgatcctgttgagagtcaccctgggtcagtgttctctaagggaatataaagaacgtgccttaccctaacaacacacactttattcagcacgtgggcttcctaagaaaatgtcagacaaattccttgaaggttaggaaggaactactactacacttgacctgatctgcatgtgaagcggtataagcaaggatgagtatggaatcatgcgacagctttgtggtcactagcttcctacaacagcacaccacagattaagtctcaacacagcactcattgttttggtattagcagcaggaattgttcctgccctgacttccctaaccctcagggttttggtcctattaaagtacctccaattttagcattgaggagagagtctgttttttggaacataacagacaatacaggaaattcaaagaggactcacacaatttgatactcccttagcactttttagtccaagatactgtatgtttgggttcatggcaaaagatgcaaggattcttgaaggattgtagctaggcttcgacaaatcctcatcccagatgctctccagacagtggaagtgttacatcaacagccccattcttgggaagggactaatttttaggtagtagcttgtttcttagtgactcatttttttttctggctctcttaacagaataaaatatagtcacattacaggagctagcaattgctgatgacaaatataagattatttgcattctctgaaaatagcccatttagaacataaatgtacttgatacttgagcttttttcttctcaagggaaaactgttaaggaaagcacctttcaaaaatattatctttgaagaaataaaaggaaatttatcatgatttgggaagtagaattagtctaattatgcttttttttttttgcatcactgccagcacacatatatgttgagagccattacgtgtaaaataccttgtcaatggatgtttaaagaagcattaggtaaaatcctgccctttaagagaatgtgttatggttagggagctcaaccattagcaaatgttacaaatagttgtactctaaggcgacatagagtaactactaaatacgtggcacagacagtacaactcacttctaactagaatatcaagggatggcttcactaatgcattcagagggaaatgctgagataagtgaggagataaagtagttactgtccttgaggaatttacaatctattaagggggggaaaaactacaaataataaagtgctgttgatgtcaaagatcagctacattttagacaggcattgaaagaggatttctataggcagacagggaaggaaggaccttccaagcaaagaagttggtgttcaccataagaggatgcaaaagtggagggtgatagcatcagaaagtagattaggttggcttctgaaggggtgtgactgtcagataaatttgtatttcattatgtagacaatggggttacattaaaacttattttttgaacaatgagatggcataaaataatatccgctgataaatctcttgagtttttcaagaaggtgacagtgtataccatgatgctagttccaatttccgaaaagttccagataagtgagaacttcagaatagatttgacaaaatgaatatcaacagacaaaatgaagtcaaatgggggtcttagttattatcctgctccataccagaggcataatcttttttgatttgatgaatctatggaagtcattagacattttacacaagaagaaaatagaagttgtgagaaggataagaagtgagtcatgcatgcattaggtgtttgtatgtgtttagaaaggttggatttaaagtttggtgataattttgttcagaaatggagtacctctaagcctttgagatgtagttatacttcattttccataataaatgagttcccaaaaaggcatgtgataatttttttctgcaaattaatatatttatttatataaattatttcaatatattgaaatagtttatgtttaaagccacccaattgtgattgccataaagtgcacatattttaaattaatttgtttaccttatttatttgccttttagatgaatctagattttctacctgtatactttgattcaattaatgtatgattattttttagaaacttctacttgtcatgtttcaaagctgcacattaactgaaattctatatcttgttgcttccagtctctagtagccagtgaagcagttcgtgctattgagaaaattagtaaaaataccaggtatacacatggccatggctcagaaaccttatgtaagtatttcttcttatgatcttagagaactttgagctactaaagaaatctgtgtgatctgtttttctttgtgtatttaatttttctgaattaaatagggtcacatgtaatacaactgaattgtaataattaggaacagaagcataatagctatgacaatgctgaacaaagctatattaataaatgagttactaaaaagaagccaaaatcctatttaagaaatcatatttatcacaatcaagtaggaattacagaattggcatcatactagttgagtgaagcagaaaagttcataaaacttttgcatgattcccagggccaccatggaaggttgtgcaggttgtacactacactaatctagggcatgccatttgcatcaagtgttttttagtgttagcctgttcccaagagtatagctcataacacattacagttgattgtctttaatatatattacacacacaaaacttgtgacaaactcttaacaaaaagttttgattaatttttgctgaaagatatttagtgagtaactcctatctacacacagtgggaggacagactgattttgcccttttgaagtttgaagggagatgggaaaagaggagcataaaataaacctgtaaccaggcatcagaaaactacagcctgaaggccaaatccaggtttttccttttttttttttttttaatgattagaaaaaaacaaaaagaggccaggtgctgtggctcatgcctgtaataccagcactttgggaggctgaggcaggaggatcacttgaggtcaggagttcgagaccagactggccaacatggtgaaaccctgtctctactaaaaatacaaaaattagctgggcatggtggcaggcgcctgtaatgccagctacttggttggctaatgcataagaattacttgaacctgggaggtgggggtggcaatgagctgagattgtgcaactgcactctagcctgggtgacagagtgagactccatctcaaaaaaggtcgaaactgtatttatcatgaacactaaaatatgtacacattttagttaacatgcattaaactgtaacaagtcttctggcaattgtagctttcatgagatgcttcccaaactgtattagatagatgctaaaattataaattaaaattttgggtcagactttgccataaacctggactcaatttagcacccccccaaaaaaagtcagattattcaattaatgcggttggaaaacctaacaagttacctagaaaaaaattaattggattattaacatgtctttcaccaaagtaaattccaggtacagcatatattttcatatgaaaaccctgcataaaccaagttgaaatctcagtaaggagaaaaaattcttgtgaaaggagaaatgaatgaaaggagaaaaaaaggtctacatgccaaacaaagctaataacactaatgtcgtttttataagcaattgataaaatgaaccaagtagacaaatgaggaaggacaattgataggaaatataaagatagccaataaatatgccaaacaaatgtgcaactcactgataatcaaaaaacataaattaagacagttggatattatttttcgcccataaaattatcagaattcataattcctattgatggtatgggaaggggaaatgggcaaattcataccctgcttgtggaagtataaatgaattcagttcttttgacgtccatttgggaacatgccgtaattgcaaaaagtacagagccttagactagcaaatctattctagggaagaatattctaaagagacaaagaagcaattatgtataaacaagggtactcattgtaaagttgtttatattagttaaaaactgaaaaaaatctaaaggtatacaaacaaataaacatttaaatcaaacaattcccagtttgtaaattaatttgaaacgtctgtatttcaacaatttctttcttcttcttttagacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcaaattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaagtttcgacgtttgactagccatctcaagcaagtttaatcaatgatcatctcacgctgatcattggatcctactcaacaaaaggaagggtggtcagaagtacattaaagatttctgctccaaattttcaataaatttctgcttgtgcctttagaaatacaaccatgcattccgtttgctccacggtaattaggcgatggcccagaaaggggaggggtgtcaaaaacgacaaacatagcctctcattccagctcagctgctcaataaacactgttgaacgaatgaatgagtggctctaggtactgtcaacaaatgccgcattttgcgcatttacaacagctgtttatggtaaggaattatgtaataaaaagagaaaactcacttaaattcacttttaattgggaattttagttctcccgggctcccagtttcctttcctaggatctctcacagagcacagattcgatttccaagtcccgccgcactcttaccgctcgcatggaaccttacgcctagagggcgtgtccacgaagggtggtgtctgcgcactgacgactaatctgacggccggaagctgcctgggtctacagaggaacagggcaaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaagtaagcgttctgtgaattggtgtgggtatctggggaaggcattgagcggacccgtaatgcggaggcccgggttacccccccccgtctttgcttgagtcactgggattttgagctttccttgagcatcccacccttaactctgcaatagccccctgtgctcaggcgtaatttctcactctgattatgattctggcatttgtctaagggcgataagtagactcagacaataggctgtacccctcgttaccatttgatgtaagcacgggaacccttgtatggtgttcgtatttgtgtgcgatggaagggtgcagcaatttgggcttaaatttagaatcttcctctatactcattccagatctgttagagaaaaacatcttacttgtgattggtcttgtttttttttttttccctcagcagtgataacgatttaggtcctgggaattgagtgctactttatcttcacaagccttaggtaggtagttttggcaactgtcagaaacgggggaaagtggaatagaaagaagagagtctgtttggcggcattatctctctgtaataggctaacgcaatttatgtggtttgaaaattatttagagttgataatacttgaattatgttggtaagatgttgtttgtgaagggtagtcttaaggtatttggttatactatggggctttcaggtaattcgaactactttgaaaattatgggagtatgaagtctcttaagatttttggatttttaaagtagttttaaaaatttggaaaacatctttacacctcaagttttcgaagtccgcgataccgttggagaataaatacttatgcagttcagtctatgggtatatggtgccagttagcggggtctagttctgtaacatttgaaattactggctttagtacaatatattggagcgttttgtgaatacaatctatagattttcaaataatttttattttcttaatgaactatttagattataacagatgacagtttcaactagagactagcaaagttgatgcaagcttgtaacaattgcggctttaaaaatagttgcactctgaaactaaggctttcactctgtgcatctggtaggattcagttttatcaaatgtatgcctcttactggcttcctgattactggtcattctaaatgaacattgcatattttgagatttgcaagcttatgtgattttcatatttgtaatatgaatttaacatactaaaaatccagcaagtggatggtatcttaacatctttacaaattattaaaattgtaatatcatcagtatttataatatgcattggcatttacatagaggaaacacattgtttaacttaaatttacttagagagttggttttcagtggatgatagtcttcctcacctcctcatctctcccaactccatctcatatagaggtggagctatttctccagctgttagtagtagttgaagcattaactgctgttgatatagaaagagtcttttattcttttttttttgtatttttgtatgatgcagttctttttacttcactttagagtagctaccagcatgggatgttttctgtgcacagtctttttaacaaattgttttttctgcatagtactgcagtgttgctttgctaattcctatgtagtcagcttagttctgtcagttgtatttggaatttagtttggaattgttttagcattaaatttacggaagcaatctgaaagtttgttttagaaagttctttttaaaaaattctctcaaactatgcatcaaataaagttaatttttctttctaaaaatatgaagtataaatgtgaagataccttatttttagtatcacctttttaatcttagaaattcagagtatagggatttatcctactagttagtacattcatgtagttttaattgcctaattgtttgaaatttccctaatattatgccgctactcatccggattaaagtgttatgctttcacttatgcttccagtagatgagacctggaaaagataattaattatggattgaagtgaagatactagaacgcatatgtgtttattgacaagattttattaattgagcttctggagtcattattcaaaaagagacccttttgtatgcttctcctttctcagccataattataatgtgaaccttctgagtacagtgttattctaagtttctcggggcaagggagcagttcccatttaagaccctcttttgttgtgtctttattaatagactcaaactttgtgtcccggattttctttttctttttccattttcttttttaattgaaaagagattataaagacttcagatattcatttgctctgcaaatggagaggagaaataggaaaataacgaaataggctttcactagtgccactctgtctttgataatgctcgtgtttgagaaagacttgatgatgtgggtggaagtgtgatggcaacttaaaccaaataataatttgaaaacaaaaatggaggaaaaccttcatagaagagtaaattagtaagttattggtatgaccttgatttctattctctatgataggaaagactttagtatttacatttttatcttatggtttctaatttttctcatatactttgaagcatttacttgtcatgttcagcctgttcatacataatttgaaaaagtttcccgccccgaaaatctacattttaactgttgtggtgttcattttcctttacgggcccaaagttttaaataggattgaaaattctaattgtcacattagttggtaacatttagttttaatatatgaaaaaggaaatgtttttctgctgtattgtagatagtgtgtatatttttagataaatgggatttttaaagttatatattgtgttctttacaagcatgaagcattttgtttattcaaattcatgaatgtctcattagtaatatttaagtaacattttattgttgactacttgtggaagtttttacatggatgatcagaagaattttttcagttagaaatcttcagtttctgcttttttcttttttcaccagacgttttacacacacacatatatatatcacattaaagaacattttattaagaatatgtgtgtgtgtattattgttgtcattattcttgttttaaatgttcagtccaggaccttgctgtaacccagaccgcatactcagatgctgtattactttaggacaaagtatggtactcttggagtctgagaaaaagtagagtacatcttttttttttttttttttgagacggagtctccctctgttgccaggttggagtgcagtggcgcgatctcggctcactgcaacctccacctcccgggttcaagcgattctcctgcctcagcttcccgagtagctgggattacaggcgtgcaccgccacacccagctaatttttgtatttttagtagagacggggtttcaccatgttggccaggatggtctcgatctgttggccaggatggtctcaatctcttgacctcgtgatccgcctgccttggcctcccaaagtgctgggattacaggcgtgagtcactgcgcttggccacatttttacttaatttcatttcttcgctaaattgggagactcagtacagtagtagctgcaagtgaaattcctgggataattactatgtaggtgaatcttgaatagttcttgatgtcactggtaaaagcaattttgtctctgtggaaagaatatgggcgtagggtgagggaggtgaggaggtggatcattagtcttcacttgattgtctttcatagcaagtccaacccttgaaatcttcaaagtttttttttttttttttttttttttgaggcggagtctcactctgtcacccaggctggagtgcagtggcgcaatctcggctcactgcaagctccgcctcccgggttcacgccattctcccgcctcagcctcccgagtagctgggactacaggcgcctgccaccacgcccggctaattttgtttttgtatttttagtagagacagggtttcaccatgttagccagcatggtctcgatctcctgacttcgtgatccgcccgcctcggcctcccaaagtgctgggattacaggcgtgagccaccgcgcccggcgaaatcttcaaagtttgccttagggagtctaggattggagagaagctctcagaccagcaaagcaataggtcaagggaggagagtagtgcgaatcaggcaacagaggacagaccagaaaaagaaactgtagagttaatacctggaaccctcaaaaagtaaaaagaaaggagatgatagatgaccaatgttttaagtataataagtacgataataaatagcctgtcgtcctaactggaaaccattaccattgaattttttgaaggagactgagctgggagtggaggcatgttgggggtagtagagatgttgggggcagaactaactcatttccagtgacagtggagggaaaaataaaaaattagtgttagtccacttgaggcagtgtggtgggatggttgtgcctgttttctaagttctacataactagcaaataaggaaattttggaacctattcaattttgtttattaagaaatgttttaaaaattgaattattggttgaggattactctatatttgtatattaatgtagcaatatataatgaaactttatgtttttctcaaacttcttatacattgtgatacatttacttattattgaatcatgcttggatatatattgttaaaaaagtttttctcaaagctctacattttctagatctttctcagctccacttctcttagctttcagttttttcgtgctcagtaaatcaaatagacataggaaattttaccagcttctcctccgtatgttcacatttcagctgagaatgagtctaagaaaaattaaatcaaagattatcttataatgctaacaccagtatgtagaattggtgtgtagttccttacttggagaacaattaatatttaattgattttgtgttgcagcaaattattgtttatgtgatgctctccactggttcttaaatttataattactgtgaagtaattctgtttttaaaatcactaaaaattaattgctattatatcaaaagaattattacattttatattgataaaaatatagattttccaatttaaaatcaccatatattatttcatattttccttccttgatgcaccatcttttatttatcaaatgttgttcttagtctttggattcttttaaaagtgtgacctgaagtacctcattgaaccaaacactgtttataattttttattgctgtttcaattaggtactaccacgatttaatttcctttaaagtgatatgtctttactttgaaaccacattaaagatttgtgatctttatagagactaaatgaaacttttttagctgctgtggttcattctagtaacttttgatgattgataagatttcaactaatatttagtttgtataaagcgggatatagtatggtgttttttttccttccccttatgaggcagtttctaccctcttcccacagtagtgtatgctctggattgtatcttggtctagaatttaatattgttttctaatgtcataatatactgtcattatctgatacttgcaaatctagttgaattacccaattatgtcattggattagatttttactatagtttcagtttttgaatgttttatttacatacatatatatatatagagagagtttttttgttttttttgagatggagtctcgctttgtcgcccaggctggagtgcggtggtgtgatctcggctcactgcaagctctgcctcctgggttcatgctattctcctgcctcagcctccagagtagctgggactacaggcgcccgccaccatgcccagctaattttttttttttttttgtatttttagtagagacggagttttgccatgttagccaggatggtctcgatctcctgacctcatgatccgcccgcctcggcctcccaaagtgctgggattacaggcacgagccactgtgcctggcccttaaaaaatatttttatgtttacatcaaatctaacagagcttaaacgtaaaataaaataaaaatatttttacaatttgccttttttgttattactaataatggtaaaatagtctgataattacttttaacacctttgaattttatgtcagtgtagtatagattatagaaacacctcgactttttctagttctacagtctgtcctgttttgaaagttgtttctatcaacattgagttttgttttgttttgtttttgtgttactggaaaataaatatgcttgatcagattgttttgacttctgtcaggcaaagaaaatactaaaatatcattcatttttctcaacctgatttttggaacataactgctgttgtcccttaaacttatgaaacataatttctgctatgaaaattttcacccaattttatttttccattttctttagcataactctttttcagttaaccagttgatggttaacaactttgagttactaaattttgaagcaatttttgtaagtaacttttataaagtaaacattttgtactgtatcttctgaggttgattgtactatgaaaacttcactgtgtgagtaggatcatattcgttcactctgcagaagaggtacaattctagccaacagatctcacagctgttataaattcaccagtaaggcatgttttagaagatattatctctgtttacctgtgacctctcctatgctttttttttttaatctcccaaggaaaatctcctgtaattttacactgttacctatagttttatctacttgtaagctgtgggctcagttatttaaaactgaggaattttacagttttgcctctttcttttttggttgaagtagtacaaaatgtcaaaaattagaaggaaggtcacagtggaaaataccaagactatatctgatagcacatcccgaagacccagtgtatttgagaggcttggacccagcactggcagtacagcagaggtgagttgtcactagtatagtcacaggggttctcttagaattctattattgaaatgcttatttgtatcataaaggtgaacaggttgttttattgtaggaatgtttgttcagtaaattttttaaagtgtgttttataaaaagaagtgaaaagggtgataaggtttatgggtttttccatatttttttcctgaagtttttattatttggggagtaatatatcacaggttagctggaattttggtagcatttgttttaattttgtcccgctagcattttttttttccagaaataaatatgaaatttacatagtaatatctgtctcttagacacagtgccgtaactggctgaagactggcaactgcctctatggaaacacatgtagattcgtacatggcccttcacctcgtggtaaaggttatagcagcaattatagaaggtaaactgagaactttgtattgttcatgtactattagaagatggcttttgtaatttatctagtataaaaatctgaaatacaaccatatatttggtcagattttctatattggtggtagtcttaccagtaattgaagatcgacaggatctttttgttattttcaagattaataaaatgtttgctttcaaattaacttatttgttcattatttatttgttttgacagtagatctttttgtagtatgtgtatggcttactttttcccccctaattatgtattaaattgctgcttaagacagcagaattccatggtgtctgaatttctttttagtgaggctatttttaactcttaaaatagtaaaattcaaatagggtataattttagctgtttaagatgttctgaattcaaattttgtacaaattctataggttaaaatgcatttgccaaatcccttagcacagtatgttaatgaaaatatgtatttatatgtggatgaatatgctccatatttcgaacatcgttttgcctttaataaaggcttggctagattaaacttgcttaataaagaccttttatttttcttttggttccctcatgatgattattttatggtatttaaagatgtaatatacataaagtttgtcacaaaaacagttttaacttgattggtaaagaaataatttacctagatccaaaattggttacactgattgttttggctatagcatagcaacactataaaaactgaacattagcaattggaattttttttttttttttttagttgaatgatttttttgggggtagtgtatgggtagattttgtttaggagaatttaaaattcaaaccctcaacattagccaacttctttttcacgtaaacattgtacattttagtttatttgtgattctgaatactgttttatttgtatttagattgtcatttgtcacttccgttaatgtgggaagattagtgtttattgtatatgtgtgtttacttgtatatatacacgtagatacatacctggtgaaactatttcgatacttttaatgttttgctttaatactatacttttgatacattttaaaatttatctttgaaatttattagctgactcagaatttttattcaagaaatcattttgagaaaaatggtcagagaaatttgtctaaaatgggaaaaagtaatgtcattgctagacttagaataaagaatatttattataattttgctattttgtgtatgattttccatctgataacttctttcgtatttgtgcattttttttgtcgggaggaaaaacatagttcataatgcgagtcaaagataagaaaagcaatgtattttacagaatgcttatttatatgtttatatacaagacttttacataattaattgagaattcgctgtgtgtaaaacattcattctgttgggtgctgtttaggatagaaacaagttcatactaaagtgttttattatataaaggaaaccagggcacataggatttacatgtacatcattataatttagagcacttaagtactggttcttagtaagagattccagtttcaagtttagctttaactgttaaaacatttaatataaatctattacatgtgcatgtaaacattaatgagatcctttaaagtgaattaactcaaattatttctttactaaccttatgatttatattcataaaatcaaggaactgatttgattgcccaatgactgcttgaaatagatgtgaatatttatgtgatttgtttatatcttttttatatatagtactttttggtagtcaaagaggaacagagcattccttaacttcttttgccctgttttaaaggtgttgtagaaatagtctttaaaggcagtctgttttccatctctcctttgttttttcccactgatagtgaaaataattgcatagccatatactgtcaaatttctagtataaataataaagccttaccactgttgagtataaatatgtatttttcctttagttaaaaaatttacagcagaatatgaaaatcactgttgtaaaattgccttgaatcctttatctttattctgaaataatttaaaatttaagataaattttaaagctcctatatttgctttgattcttacttaaggtacataaaatattttctcagttattgatgttgcatccaaccacaggcatgtgtatacaagaaacttatttcttgtaatatcttcttatatctttcagtataaatgataatgctgctacctctagattaattttgcaactttgtagtttaaaactttgtgttactactacattttgctcccacatataactaatatatttatgtgattaataggaaaacaagtcaagctattagttcctttttctcagttcacatataatttcttattcacatcaccagtacctgccacttcgtggaatttaacatatacattttgattgttattgggagaaaaactgtaagtgttgctcgtgttttgcatattaatatttaaggtgaaatttttcagaaattcaggagtcaaggtcagttagaaaaagtgtattgagatttgtgaggttatttctgtaaatacattcttataaaatgttattaatatataaatacagatttttgttgttttgtttcgttttttgttttgtttctgtgttttggttcaaaggtcaccagaaagacctacaggggatcttagagaaagaatgaagaacaagcgccaagacgtggacactgagccccagaaacgaaatacagaggagtcatcctcacctgttagggtaggattgaatttcccaaaacaaagttcaacttcagtagtgatttgttaatttgagtttcattttaaatattgtgtgctaaatatatggtaaatgtgtaatacggcattataatgttctatatggataatgtaatttagagggaaagagtcccctgggaaaactgtgattggttcagttctttatggtagttaagatgaaagggattagttggcagaactcaagctgaacttagtagggattttgtgtagggatcccttagtagggatccttgacgaggatcatgagtatctttaagttttcagaattcagccagccatcacatctgcttccaagaaagattgaagtggcttgcagtagaacacttacaaatgaaaacaatgaaagcaaaacacatggggttaacaaactgcactagaaagttgaggtaaaagaaagcacatatgaccacaaattttagctgtgaatttgttggcagtgaagccaagagaaataaaatttataatgtagttcattgaataaaagaaaagtgtttgtcaggaatggaaatctttcccagagctaatttttttctagaaatttatcataccatatttcacataccatacagttcactcattaaaagtgtacgcctcagtggtttttagtattattagagttgtgaaaccatcatcacagtcaattttagaatattttcattgctacgtaaagaaacgccaaacttttcagcagtcgccctcctagccaccagccctaggcaaccactaaatcctctttctctctctagagatttgcctatatatttcatataaatggaataataaaacatgattttttgtgactagcttttttcacttagcataccttttcaaggttcgtgaaagagtatgggatgcatcagtattttattccttatttttgtcagataatattacattgtattgataatatcacattttgtttatccactcatcagtgatggatatttgggctttttctactttttgactcctgtgtataatgctgctatgaacatttatgtacaagtttgtatatggatatgtttttatttctattgggtttatattgaggagtggagttgacaagttctacggtaactgtgtgtttaaccttttaatgaacttctagactttcattaagtggctgtatcatttcacattgttgacagcatatgaaagttctagtttctgcacatcatcaccaacacttttgttatctaactttttgattatagccatcctgatgggtgtgaaatgatgatctaactgtggttttgatttgcattttggattctaatgatgttgagcatcttcttgtgtacttattggctatttgtatattttctttggagattcttttcccattttaaaaatcgagttgtctttttattattgagttacaagtgttctctttattttggatacaagtcccttatcgtatatgtaacttgcagatcttttctcccattctgtgtgttatcatcacattcttgatggtgtcctttaaagcatacacatttttaatttgatgaaatctgacttacctgtttttgttttttttgttattattgttgcttgtttgtgcttttggtgtcatctaagaaactattgtttagtccagggtcacaaagatttacgtctatgttgtctttgaagcattttctggttttagctcttatatttaagcctttgatacattttgagctaatttttatttatgatgtggtaaaggttcagccttattcttttgcatgtggatatccagttgtcctctattatagtctttttatgaaagttactgaattgtaactgaatcaaggaagcaacaacttccttgatcacttaaattatgtagaagttttctgcagctgtttttgacccatggtaaaaaagccctgacagcattataatttgtgaaacttatttcttacaatacagttttaagtatttagttttctaatgtctaatgttatacagtgatacagtcttaaaaatcttaaatagttctcagctggaggtttttatcaacattccttttgagggaagatctttttcaaaatacacatgccaatattccacccctaatctactgaatcagaatttctgggttggggctaagcgtgtgtattacattttgaaataacctattgattcagaataacagatgcctcagcggtctgccagtaaatgtaccgctactctgaaaaaaagaaagccatgctttctagggtttgccccttcttttatgtaaatactcccaccatggtcagtttcaagctttcaaagacatcactgacagatgcatagttgggaagagatgctaagtgacattgtatacagtgttcccgttatgtatattataaacagacacacaaaatgtaaataacctcagaagtaaaatttactatgagttctgagtacttattatctttgtttttaatacagtttatttgttcaatcatggctgtgtttaacagtggcttccagaattcctaaaaatttaaatcagctcttatgagtcagtacagactgactctagcatactactagatgaattgttattagtataaggagcaaacatctggaatccatatttagagcatattactttaggaattgttaaactcttcttcttgtctccttatccgtaaaatggaaatgcaggctgtccatgttgctgtgaagaatatacatgtaaatgatttactattccatgatgacacatgcgtaataaatggtatatactggtattgaaatggcacttagctttttctaatataaattgtctttaggctcttatagaagatgaacatcagccttggagatttaggttgttgacagttaactgaatgtaagtgtgttgtttatcataagggtttttatgttcatcaaataaagttagtacagtaaagttggcattttgttaagaaatttaaagcctgattcttgctttccctagatgagaaagccctcaaaggcactgagcatcgtgtatacctaagggatagagttacaaatttcaacagtgatcaggttttaggtaatacactatctaaacttaaacagaactgttaataacctgggacaccaggatattaattattatttattagtattcttttgagacagagtctcaccctgtctcccagactggagtggaatggcatgatctctgctcactgcaacctctgcctcctaggttcaagcgattctccagcctcagcctcccaagtagctgagattacaggtgcgtgccaccacgcctggctaattttttgtatcttcagtagaaatggggtttcactatgttgggcaggctggtcttgaactcctgaccttgtgatccacctgcctcagcctcccaaagtcctgggattacaggcatgagccaccagcaaggtattaattatttttagtgttatatttgacaggtaacagatactgatcatttttatggtgcattcttgctgcaacacatgactgttgatcttcatgtaatgaatttctctaggaagatcaggcctatgttaggtaagggcaactgtggaatagattacataggcatagctaagatagaatgggtgtgattttcagcaaattagctgtaattcctcctcttctctgtcactgatgtcaactccagtgtgtttgaattatgaggttggtaacccttgatcttgtggttatcaaattcataaatggataacttgtaattctgtagcatgtgatagtgtgtcagaaagatacgagcaaaatgcacaatggagagagtaagtaattacctggagaaccagggacctcttcagggaaaatgacacttggactggtgttgaaggatcgacgcggtgtcagaggggagggaagaagagaaaaccaacacaagaactgtaaggagttttaaaggactaatgtgtttgaggagcttgtgaagctgtgtgcctaggttataaaaatgataacgtggacgtgagatgaaggctgaagtagattaggaccagattatcagtggtcttgtgtgccaaactcacagtttagcaatagagaaaagagacatgctgagatctgtcttgctcaccagtttacctccagaccctggaactagtaagttcacttactgaattaatggaaagtggttctgatatgcagccatgattgagaaaccctgctgatgtaaggtctgtgctgtcaaatgtgggtagtctgaattgaagtgtgctgtaaatataaaatacatagtgaatttcagagacttagtatgaaaagaaagtaaaatatctcaaattttaaaatgtagattatatgttgagaggacaatgattttggatatgctgggttaaataatgttatcagtattttaattttacctttatctttttttctttttaatgttacaacaaggaattgtaaaattacttaagtgcttgcatcatgtttctgttggaaagggctggtctaggtgatgtgaatcagacttaatacggtggaactgaaaagtgagaggcttatatgaggtagtcagtaggaaatagttgcatttaatcagtagaggttttcagattaaaatggaattgtattttcattttatattgcagagacttgttattttatggaatttgagcacaaaagataaattagctttgaaagcaaaattagacccctaaatatagtcaggaagaatattcaagcatttattgatgacggagacatacaggtgctgtagggcatccttatctcttagtagaagctttgtggctgcattcaagaaagaattagataatttgtcactgtgggaagatacctaatttaggagttagaggtgccctatgagtattgcttacctaagtcttacatcagagcaaatgggcaagagcagtggtctaagtttatttttctttattgatctttgtttttattttcatttttttattgtggtaaaatacacataaaatttactattttaacaattttttgatgcacagtttattggcattaagtacatttacactgttatgcaactgataccaccattcatttccagaactttttcatgatctttgtttttaaagtgtttagttttttgttgttgtttattcgtcctcatatacaatattaaaacaattgggatagctgagtgtggtggctcacgcctgtaatcctagcactttgggaggctgaggtgggcagatcacttgaggccaggagtttgagaccagactggccaacatagcaaaaccccgtctctactaaaaatgcaaaaattagccaggtgtggtggctcatgcctataatcccagctactcgggaggctgagccaggagaattacttgagcctgggaggcggaggttgcagtgagctgagatcatgctagcctgggtgacagagtaagactctgtctcaaaaaaacaaaacaaaacaaaaatgacaattggaataatattttaactgatgttaattttctaaatgttaattatttcaactggttaaatactttttctttacctgttattttaataactttttctggttcctaaaaagtaatttttagaggttttgttttttttcttttccacctcgaggtttttcttttgagacttcacaatgttgttctctttcccttgtccactgttttttcaaaggaccatttctgtcatttgtttatgtttcctaccccaccccaacctaattgcttaccttcaaacagatcatttgtttagacttgatatttatcctgaatttatttaagatgactacactcaaattactttttcaattctcagtctataggtggatctcaagttgattatccaactttaaacctattccaggtgtcttattactgaattgaaaatgtatttctagtatgaagtttactgtctctggaaattgtacctcctagaatgcccatgcaattattagttttgtttcacagttgcctcctcagttctcttactgccccccgacatcccctatcttgttctttttttttttttttcttgacacggagtcttgctctccctctcgatctaaagtgcaatgatgcaaacatgattcactgtagcctccacctcccaggctcaaacaatcctcctgcctcagcctccaaaaatgttgggattacagttgtgagccactgcacttggccttaccttgttctttttctgccatcttgatatttctgtctagatgagaaaaaaaaatggcactgactctagaggaagggataatactgtagctgttagaattagcaggactcctgcagtggaggacttttaagttagaaggccttaacattgttactaactatatcttgagtaagtctcttgactttgtcttttaacttgtaggatagatgtacctgccccagtttatcacaagttatggtgagaaccaaatgaagaagtacgtataaaattctttggaaataataaaacatagtttaaatgcaaaatagaaatagtagaaagtcaccaaagtaaaaatttaggaagctgatcactgtaggggtaaatagatcaaatgagtgttgtttgtttatttcaaaagaaaaggcttagaaggataagagtataagtagaggtacagtgtatctaccacctggtggaaatttggtaatgaatatgtagtacggagataattatggtgattttccaacatagctatatattttcattttatatggaaaaaacttttaagtttagcctagtatgatctgcagatgtattctttgatagcattaagagttgttccagttgctattccttgatgtaaaacaaccatttattatgtgctcaaattctgtcaggaattcagaaagggcacagcagggatgtcttttctcttgatctgtgggcctcagttaatctactggaagcacgtaggctggaatcacttgaaggtttatttactcacctgtttggcagtcgatgctggctgtcagctagaggcctctgtttgtctctatgtggtctcttcccttggatagcttgggcttcctcacagcctgataactgaattccaagggttagtattctgagacacatgcacactggcacacacagcaagggaatgagcatgtgcttgtgccctggtttcttttattgtagaatggtattagtaaccaaaacctgggcgttagctgtgtttgtgctagtggggtattgtttcttttaggacctctcagctagcagagcaaataaatatatgcgtgtatactaactggtatatataaatatttctagtgaccatctgttatctgtattaagctaaccatgagtttttactgatttctctaactgtaatccattcccactattagtatttttatgcccagatgtcccttccttagcttgtgggtgatctttgtattggatcctgagccttttttttaaatttactttattgaaatataattttcaaacattgaaatgcacccattttaagtatacagtttgagtcttgacagatgtgccacctgtataactaccaccacaatcaagatacagaacatatctgtcaaccgaaaacatatcttcatgcctttttgtcatcagtcgcctcccaaactcactcctgataacctctgatctgtcactgtaatggaatcatatatattatcgtgtcttgattctttcagcatagtacttaccagattcaaccacattgttgcatatgtcagtagttcattccttttattgctgattcatgttctattagatggatatatcaaaatttgtttagccattctccagtggatggacatttgagttgtttctagttttcacctattaagaataaagctgctatcaacatgtgtatatatgtttttgtgtggaaaagttttcttttggtaaatatctaggggtagaactgtgtcttatgtatatttttaactttataagaaactgctgaacagttttctgaagtggttgttccattttgcatctccacctacactgaataattttctctctgtattcttaccaacacttggcattgttggtctttttcatgttagcccttctagtgggtatatagtagttttaattttcatttcttaatggttagtgatgttgaacatcttttcatatgtttattggctgtttctgatcttatgtatatcttttattggctaattgtttatttgttaacatcttttgctcataaattaggctctttgtcctattaccaattggtaatattctgtataccaatcctttgtgagatatatgtattgcaaatacgttttcccagtgtgcagcctgcctttttatttttttttgtggtgtctttcaaaatgtctttcaacttgaatgaagtccagttatatcatgttgttttgagaccactttagtaatcctctgtagtttctttgtttctctgaagatcacgtattcccagcacattgtgtatttcatactatatatgtggaatcagccattttcctcaaaaaacttggttccttttactgagagtacttgaaagcttttaccgctagattagtcattgtctttggggcttttcattaggcatacctaggaaatgcgtatagatcttctctttaaaacagacaaacatgaattcaaataattcagatttggactgcaggacttttacttaactttgattttattagttgtatgatttttctcttctgctgaaaattttggtccctgttgacattattcatttgcctgaccttacattacatttaatagtttcagaatagcaactatattattgctaatagtgttatactgagctcaacttaaggtttctatatagttcttaagatatatcctattaagataatattgttaaatctgtctattaggaatatatagtcaaattcgtacattttaagttacttgaaacaggtcttctctatgtggttaaaccaccaaattgatacttagttgggttaactgaaataatcagataattacaagtaattttgaagtttttagatttcttttttctttcattttctaattacataaaacgtttacatgatttcaaagctaaatttacaaaacagttttacattcagaaaagtctttaacttctgtcccatgattgctgtacccttttccctgtaggtaaccacatttattagtttttgggtaatccggctgttttaatacacacatatatatatttaatatttacatatatatgcacacaaattagtgtatatataatcaccttttttctttttcttagataaaaggtagcattactgtatacatttttcttcaccttgcttttttaacttaacactgtaccagagatcattctatagcagtatgcaaagctatatcttaagcttttttatagttacatagtatttcattgtatgattgtatggtacattattcaaccagtcttctattagtggagattttaggttatttcagtcttgccactaaaagcagagctacagggaatatatgcaattgttattttgcatttttgtgtctgtgtcttagggaaatataaatctctagaaatggaattgctgtgtcaaagggtaaatgcctacataatcttactacataatgacatttgcattgttgccagcagcacacagagccaaattactttatctttgctttgttagtatgtgttttcaaacttgtctttttgccaatttcatagaaaaaaatgttatttcatcatagttttaattatgtttctcttgtgagtgaggttgggcatcttcatgtatttacaggtaatttactgtatcccctgcccattttctctgtttttttttttttttttggtctttttcttctctgttttaaaaattctgtattttagggaaaatattttacttaagatatcaagtacagataattttacttgtcacttttctggttttagaaaaacactatgttttatacagttttaggatcacagcaaaagttaatggtaaatacagagatttcccataacacttcctcccccagcatatgcaggacttgcaccactatcagtgtctcacaccagtggtgcatttgttgcgatcagtgaccttacactgacacattattattactcatagtccacagtgtaaagttcggctattctgtttatttgtccattgacctaccaaaggacatgttggttgcttccaagttttggcaattatgaatacagctgctataaacatctgtgtgcagatttttgtgtggacatatgttttcaacttctttgggtaaataggagtataattaatggatcatatggtaagaatatgtttagttttgtaaaaaactgccaactatcttctaaagtgactgtatcattttgtatttccaccagcaatgagtgagtttcgattgctccacatcctgccagcatttattgttgtcagtgaattgaattttgactattcagataggtgtgtagtggtatctctttgtggttttactttgtatttccctattagataagctcttgagcgtcttttcatatacttatttgccatctgtatatctttggtgagattgttcaggtcttttgcctatttttaaaaacaggttgttttcttattattcaattttaagagttccttgtatgtttttggtaacagtccttattgcatatgtcttctgagcttatttttcccagtctatggcttgtcttattattttgatggtttttttaatagagtagaagcttttaattttaatgaagtccagttatcagttatttctttcatggattatagtttgatgatgtgtctaagatgtcattgccatacccaaggtcatctagatactctcttatgttactttctaggagttttattttttttgtcttacattaagatctatgatccattttaagttaatttttgtgaaggctgtgaggtctatgtctagattctttttatttatttatttattttttttgcatttggttgtccggttgtttcagcatgatttgttgaaaagactatccttttttcattgaattggttttgcttctttgttaaaaatcagttgactatgtttgtgggagcctatttctgggctcttattattttccactgatctgtttgtcatttcttttgcccgtcccacactgtcttgattgctatagctttataggaagtgttgaagtcaggtagtgtcaatctcatgacttcgttcttcagtattgtgttggctattctggttctccatatagaatgagtatgtcagtatctacaaagtaacttgctggggttttttggtggggattacatttaatctattaatttgggaagaactgacatcttgacagatatgtagtcttctgtccaagagcatggaataactcttcatttatttagttctttgatttctttaatcaattttgtaattttcctcatgcatgtcttatgcatattttgctagatttatccttaagtatttcatttttttctatactgatgaaaatggtattgttttaattttaaattccacttaccgttgtatataggaaagtgattgacttttatgtgtattagccttgtattctgcaacctgaactaatctatttgtcagttcttttgcccacccgcagtcttgattgctatagctttataggaagtcttgaagttcttgaactttataggaagatcttgaaaaaagaactaattcctgaagttcttctgttagttctttcagaatttctacatagacaatcatgtcttttgcagacacttttgttcttcttaataatctgtattctttttatttccttttcttgtcttattgcattagatagaaatttcagtatgatgaaaaggaatagtgagagggaacatcctttccttgtttctcatgttagcaggaaaacttctcatttttcaccattaggtatgacgttagccgtagggttttttgtagatgatctttatcaagttgaggaaattcgccgctgtttctaatttaccaagagtttttattagtctgagtgttggactttatcaaatgcttttcctatagctattgatataatcatgtgagttttctttgttagtctcttgatgtggtgggttacattaattgatttttgaatattgaaccagccttgcatacctaggataaattcttcttggttgtggtatatacattgtgggatttgatttgctagctttttattaagtttgacttttaaaattatatctaatttgcataacatgttatgatacaaatatatatagtgaaatgattccttcagtcaagcagatttccatatccatcattttatatagttactttttgatttgctaatatttttgataaggatttttgctattattcatgagagatattggtctttagtttttttgtaatgtctttgtctggtttcagaattaggataatgctgacctcatagaatgagttaagaagtagtccatctcggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaagaagtagtccatctcttctgtctctgaagagattatagagaattggtataatttcttccagaaatatttggtagactttacctataaaccatctggtgctttctgttttgaaaggttattaattattgattcaatttttaaaatagatatatacctatttaaattgcttgtttctccttgtgtgagttttggcaccttgtatttttcaagaattggcccatttcatgtaggttgtcaagtttgtattcatgagttgttcatagtatacctttatcatatttttaatgttcatgggatttgtagtgagatccctacctttgtttctcctattgataatttatgtcttctctctttttttcttaattagcctggctagaagctgataaattttattgatcttttcaaagaaaacagcatttggttttgctaatttttctctattgaatttctgttttcgatttcattgacttttttcattctaattcttaagtttattttcttctgcttactttgggtttaatttgttctttttgttgttttctaaggtggaagcttaaattaatgatttttggttgtcttttctaatatatacattcaatgctataaatatctctttgggtacagtgtttactgcatccaacaaattgttgtaagttatatttttattttcatttagtttaaaatattttaaaaatttttttgcaatttcttctttgaccaatatgtttattaaaattgtgttgtttaatttctaagcatttggggattttcctaatctttctgttacagatttctagtttaatttcattgtggctgaaagcagacattgtatgatttcttttacatttgttaagtgtgttttatggcccagaatgtgatctgtcttggtgaatgatctgtatgagcttgagaagaatgtgtattttgctgttgttagataaagccatctataatcaattatatcaattttgttgatggtgctgttgagttcaactgtgtttttactgacttcctgctgaatctttccatttatgatggaagggtgtgaaatcctcaaccataagagtgaatttctctttgcaattttatcggtttttgcctcaggtattttgatgctttgatggtagggtcatacacataagaattgttatgtatttttgcagactggacgtctgtatcattatgcagtgctcctctttgtctctgataacttaccttgctctagagtctactctgtctgaaattaatatacctactcatactcttttttgattagtgttagcagtatacctttcttcattcctttacttttaatctattaatatatgtgtttatatgtgggtttcttgtagacaacataccattgggtcttgtttttccatccactccgagaatatctgtgttttaattggtgtatttagaccattgatgtttaaagtaattgttgatgtagttgaattaatatctacaacattcgttactgttttctcttcattgccattgttctttgttcctgtttttgttctcacttgttttgtgccttttttggtttaaaatttgtggttttaattgagcatttatgtgattctttgttcattcttttttagcatatcaattatacttctttctactttttttggtggttaccctagagtttacaatgtacatttacagctaattcaggtctgctttgaaacagcactatactacttcatctataatacagataataacaaaatattcccagttctttactctgggatattttaaatgcatttagattttctgctctttaaaggattggtaaaattcccctgcaaaacccactgggtttggtactattttatgaaggagttctttaactggctttattttttctttgaaaaatgatgtagacttttggttctgttaaagtcagttttggcaaatagtatttttctagaaatttcagccgtttttcatgtaagttttcaaacttgtttgcatagagttatgtaaagaaatctcaccagacacagtatctcaccgggcacagtggctcatgcctgtaatcccgcactttgggaggccaaggcaggcagattgcttgagctcagaagttcaagatcagcctgggcaacatggcaaaactcccatctctacaaaacgtacagaaattagccgggtgtagtggtgtgtgcctgtagtcccagctacccgggaggctgaggtgagaggatggcttgagcccaggaagcagaggttgcagtgagccaagattgcgcactgtgctgcagcctgggtaacagagctagaccctgtctcaaaaaataaaaaaaaataaaaaacacctcatagttttattttttcattttgctttgttcttagagatacttttactttgtcatttaggattttgaatttgtgctttctcccttttttcttgtttaggttagccagtggtttattttcagagaatcagcttttacatttgtatattagttccttctttgtgctttctaacatttatttctgggtctttaaattccttctttggttgcttatttttttgttgttgttgaatttgttgaacatttgttttcatttttatttatgttctttaatgctgtaagttctcatcagataactgctttagctgaatctcatgaatctcatatgtcaaactatgacagttattttcgggaagttctcctctttagatttggattccacccattatctaagaattgtttaatggaatgttaaaattttcaggttggagggccttttgttttttacgtgtgtatgtgtgttttcttttgatttttaaaaagtaactttcatgtttttcttcatatttttgaatttgatgagattttctttgtagcctaagacagtcactttttctcaattttccacccatgctttaaaaaaaaggtgtattttctagttcttggtttttaggttctataaatatatataaaacatctattctttgggcatcctatatttttaagattcttctttatttgatctattttggtttgagaacattatgttaaagtatcttagtagtaggtttctgtctcttttactccatatcctatagtttctgctcttcactactgtattattaggtacatagatacagaagtattaactatttctttttcattttaattctttttgtactttttagagatgatgttattttggttatctgtatatttcttacttgttttttctgagatgagctaatttaatttatatgagcacttcataaaaagattctccaataatcctatttgggtatttttctttagtataaacaaaataaactacagtttcattaagtgtaggactaaattactctctttgtttctataatattgaaaggatctgaaactgcagatctgtgaataatttcaaaatttcaaaatattaggtatatatattctaaaactgtatatagactgagcaggctgttggtctaacgttcaggccaaagcacaacaatgaaccattctactagattaataaagttttttttttttttagctttaatcagatgtgtccaattataaaggtttgaaaacattaaggtcgaaaaccctaatctttttaaaattaataatagttgcttcacttgttaataattttgggataccacatgacagtaaataacagagaagaaaaattggtattaacattaattctagagctgctcaaagaaaatccaggaattggttgataatgttagtgttctttgaaactaagtttatttttagagcaataggatttgaaatagcattattcttttaaaataaaatgagaggttagacctggtatcgtggatcacgcctgtaatccctgtactttgggaggctgaggtaggaggattggttgagtccaagagttcaagaccagcttgggcaacatagagagaccctgtctctacaaataaaaaaattttttaattagctgggcgtagtggtatgtaccagtagttccagctgtgggaggctgaggcaggaggattgcttgagcccaagaggtcaagactacagtgagctatgattgcgtcactgctcttcagcctggatcatagaacaagaccctgtctcaagtagatagatcgatagatgggatagatagataagatcaataagataggtagatagatggatgataggagaagaaaacaaagttttgcgtaaaacattgaatgtttaaaatcctctgatgtcaatataataaatatggaattattacttgaatgataactttagtagtggatagatttgtgtagatgtttataagtgaatattagtagcaggtgagaatgttattgacatacaaataattgagtcattctttgactaaatgttctgagataatttttgtatattaacttcaaaggaaatttctccaagtaattgtggaaagatgtaagtaaatccaatataagaggtgtgattatataggaagctcagaaactgttagggataaacatggaattgattttaggcatagaaagttaattgcactggtgtagaatagggtgacttgacctgacaatagttgccagctgaagaatttctccagaattcatcacataaagagaagttatggaaagtattgacaaggtttaaaaacatgggggaaatacttagaaaattcaatatgcatctagttggaaacccagaagaaaaaaaaaaaagaatgttggagaagcaacattttaagaaatagtagctgagaattttccgtaattgatgaaccacaaatctacagatacgagatgtgcagtacatgagagatagaatattataatgaaactgcaaagcatcagagacatagagaaaatcctagaaacctctagatacagaaagacaaatccccatgcaaagaagcaacaggatgacatcagtaacaaacaatggaagctaaaaggcagtgaaataatattttcaaagtactgagataaacctatcaacccaaagtatgtaccaaagtctggctttcaggaatgagaataaaataaagaccttttcaaataaaattgagagtgtttactaccaacagatcttcactaaatagagaatatttaaaaggatatacatcaggaagatggaaaaagaccttagaagaagggtcggaaatgtgaatagtaaaggagaaatttttattaagttggaaattctgtcttgttatagcctgaagttatcaaaagtgtagcattgtaccatgaggaagtgaagtgtactatgaagtgccaggcagatcactttggattccccagaacccgttccaccactttttcattttgtatcagcattgtgatttggggaattgatcccactttcatggctgggccttgattagtcgaatccagttagaataatcccattctccttgctaattcaattgattcaggaagcaggcctaagccatttatcccatggctattaccttgatagttattcattcataggtggccatgtgactgaagttggcctagtcactctgaaggaaggaattcttatttgtgcttgtgggagagatacactgaggagacccagattgcttcttattatggtaagagataagctttaatgtgaagtcaacattaggcagagcggagctgtgataaatgaaaacaagagtgaatatttggtctttgatgatttcactgttactaagtcacttaggcctgaagtttaccctatatatagacttcattttatgtgaaataatagttcaaatttgtatagtttaggagattatagtttcttagttgaagctccatttttctctgctaaaacaagttagacttcattaatacaagtataatttcaattctaagtcaggggagttggaagctgtatgctttatgctgttctgacaagactagattaatttggggtatcatgtttcattgaagcacactagccgattaatatgcccagagaagatgacagaatgatgaagaaagggctagcacgtgaaagaagtattagatttgttttgcataattccagaggttagaactattcccaatcagtagaaattgtagggaggtagaacctctagagaggttaagaaagatgcaatgggcataagaaataattttctaataattagaactgtctggaaatgggaagaaagggtgcaacagcacagagctaagatttttgcccccaagagtcttgtaatagagggcttccatagctatacaaatattgtggaaaattgttctgcatagggtaggaggttggattatattacttacacagcctcctaaccatttttatactctagttactaataatggttctcaactctcttagccttgacacttcctatttcatattctttgtaatgcttgctttttatctaaaattaatgatgaacataatctgcccacgcatataatgttcaagaaataaatgtgcatatgagagtggaaatgaaagtaatataaacatctaaaatcatgtattacatttctgaaattcaaaaaacttcaaacatttttcctaagacacagacatttgggagcaaaacctggtcttaattgaaataaatttaattacagtttttatacaagtggtgaatttctgtgttttgctgcaaaaatgttagtatgtttggtcacaggctactgttccagactccactggaacagtagtactacttaatatgctttgaaatgcaaaaaaaaaaaaaaattctgaactcttaaaatatctgatcccaagggttttggctaaaatactgtggttcttcaagtatttcaagacttagatgttccaggatgactaatttacaacacatagtaatcagtaggttatacttttaattaatatgtttggatttaagagaagatgagaagccattctgttcaagaaatacagcaaggtggaatagtagaccgtgctacactacattggacgagtaataccataccctatttatttgagtataagagaaaagggggaataactttgtttgataaaaggcataacatacctaaacaagttacacattgttgaagtgggggaaattaggaaataaggtattttttaaattagctagaccttcttaataaatgttaccaaaataatttcctatattatgatttgaggtaagaacttgaaattccatcacctatttaagcctgcattcagtctctagtacctaataatagaagttatatatgatctctgggagtagcatcagagtcatattggaaaacatggacaattcaaaaattataattttaatatttagggtaaatatgaaatatttacagacatcattattaatgacatttattgatacaacatttctggctctaaatctgataaaaaatgttacaaatttatagattgattttgcagcaccagcactactgctctgacaccctttttaactagacttgcaattggattttacatacttttaagtggacagaaagcacagaatatgttatttaataatttggagataacctcctattaaatatttttggtatagttattcagtaatgtatatttacagtgggtttaatccacagaacattcaaaaattgtttgggatgtaggatagttcttcattgatgttccacataatatgttttaagagtaaaagtaaattatatttcttccttttgtcttctgttcaagtagaggcccatttctgttttcttgactcttcaccatttttttcatggcaggttttattctcatataacttacaaattattttcgtcagcctctgttgtcttaccagcaatcaaatccaaattttgtcagtaatatttacagtatgacttcatgcctaaatatgtagaatttaggggcagttatatatactagagttctttaagaagaaaactacaaagagaaattaatttgtgttttaagcagccaaattttatgattagtaatgctcagaaagaaatttgagcacttaatatccttgtgtgtaagtgtctttcatagtatttacaatgttagtaaaagtaagacttctgctgtggtggaagataacaattatataacactggttacttttattttcttaccacctagtaaaatatgatttggagttcttatgtaataggacatttaattgacttttataatctgaattaattttgtccttttttgtgtgtaagctgcttttatacctggaataaaatgtaaaacctgttttttagcagcagtagtgaggactaatttactattttaggtaccatttggtttcatcaaaatgggtaaaatatatttttgtaaacctttataatactattaaatgagtttggatttatccttgggtgtctaggaaaatgacaattacttgaatatatgacaagtcctagatcagttatttttagaagtctgtggtgaatggtttagcccttttttgacattttaaaatataatcacttacaaatccttccattgtattttattcattttaaactgtcttttccccagtggttttcacgtggaaacttactgtgtagctgaatgtcacaagtttgttaaagtattagatttgcattgtatatttttacatcttagctactctttaatatttaaagtttttgttctttagtaaaatagatgtagtatagtctacatctcttttagtttttgttgtttagtagtttttgttctttagtaaaatggagtatagtcttttcattgtggtgctaaactagaatttgtcactttctctacttagtggataagtgactatttacaaaactgattctttgatgaaacagagatgaatgaaattaaaatgttctcttattacaataaactacctcataatttttaaaaatatagtaatctgaatgtatgtatgtacttttttagaaagaatcttcaagagggagacatagggaaaaggaagacataaaaatcactaaggaaagaactccagaaagtgaagaagaaaatgtagaatgggaaactaatagagatggtgagtttcagaatcttggtttaaatggcgaattcttgattatttactttctagagttttcgtgggcttcagaacacctttcgactgtgatccctctcgtttcagaatcattttattgacatatttctatcttactgaattataaggcaaaaactggcatatagtagctgtacaaaggcagagaaagtggtttgcattgcatatttttattttcccttcctagttttccctctagaactttattgtgcagcattacagcccttcaggattgtattgcatatgtaaatttaaaaattcctaacgctaagcttaaaatgaaatctatatttgttttacataaaatattataaatgagatttttaaatcttaaggacttgggaaagttatttccaagaaatgtttgacttttatctttcagaagaaatcaaaatcagattaagatagagacctggatttattaataaaaaattagcaaaaaaattttttttcttgagacatgctctcactgtgtcacccaggctggaggacagtggtacaatcatggctcactgcagcttagcctcttgaagtcaagcagtcctcctgcctgttatctcagcactttgggaggctaaggctggagtaccactttagcccaggagtttgagaccagtgtgggcaacaaagtaagaccccatctctacaaaaaaacaaagaaattagcctgacatggtggtgcatgcctgtgatcccagctacttgggaagctgaggtgggagcaaaatcatttttgagtcatcaataagcatttattttccaccccttgaatgttttctccacctctttgatgttctgaaagatgggcactgtaatgtcatattaccaaacacagagaaagagaacttgtatttgttaaatgcattgagtgggggtggacaatttaatgtaatttatataattgtcttattatttcaatagctttgttactctacttacagatgacaaaactaaagatcttaaaaatttaagcaactttttcagtgagaagctgaaaacttagaccagggattagaaaactagagtgtgtgggccagtcactggtttttgcaaaaaaagttttattggaacacagccatgtccatccatttggttacatattgtctgtggctgcttttgagctacagtggccaagtcgagtctttatgacagagaactgagaagctacaagactacaatattaactactatatttcagaattatctctgaagacttaatagactaacagttgtaaagtattgtaaatacatctttccagtaattgttacatcagtacttaaaggaaacctgttccatctttggacagtgctgttaaaaaattgcttctaagaacaaataggaaacttgtttatggttactcaggatttcataatccaacctaataccgcttctacaaaatagcaataaaggcagctatactctcccattttagttgactagtatatttaaataaaatattataaaccataactgttcaagtttggagagctaacttttcctaaatactaaggggttaccttttaacacacccaagcatcctttcttttcattttaatttttttgcataaaaaacattttaaaatgtatttgatacttcttatctttaaaatattttcagttgtcattacaataattagtagttgttgaaaatataaaaggttcagaaaagcccaagtctgttctttttcttcctggtaggtatgtcaaaccttctccataaatctatgctttcatttctcttttttgctatctactaagcagagacaatggaaatctttaggaattccctcaacttcctcctaccacaccttcaaactaagtttttatttgtgcctaaacttttttacttccctcttattctgtgtaagaggcctccttcctgctgtataaggttgatgaataattcccttgtattgtagatctgatttcctcctgcctcagcaatcttgttcatttgtgatacactctcttctatatctttaacatccattttctctcctccctattttactgttagtcactatcctgcttatccccacttaacaactaaattcttaaaacagttctgtgccttactgtttctacttgatactgtttcacctgatacttattattcagtcttctgacccaactctccactaaaactgcttttcaaagtcactaatgacctcctcattgcagaataaatggagatgtacttgttactatcctaaatggccgtctgcagcatttgacacatcaagagctcctgttttcttgaaaaagactcttcttttggcttctatttatcactcttcagttttgtatcttcctgttcaagcccttcagtcttacacggaggctccttgtattctgtgtgccccttaaatgttgattcccaaggatttgcacttaactatattcttttaaaaaatctaaagtgattttatttcaagagccttttatataggaaattcttttaaaaggtgagtgtaaatgtctttaataagaatttcttatgcttttccttgattgaaacgcacagtttttgaccattgtgtatctctgtgatttgaaagtatctgttgagggaatattgaagcattgagttaagtgccccactccctggatagtgagactaaactggtttcatagacttaccttctgcattgttattctatctggaataacaattttagctggattcagaaaaaattggtatatttataaactttctggtttttaggccacttttatatgctttttcagaacccccaaataacttttatccttgtgtattttatgtttccataactgccatattatgaacctgagaaaattttttaatatttatgtattcattcatttaacaatgacatataaaaatccattatatgcttttatgaaaaataactattttgcaaagcaaaaaataataattgtgaggaggtggcagtgttttgcatcattttgcaaattgttttaatatctggcttaatagttgataggtagattttcttacctgcttctacattccacctgttaaccacatcacatattctgggaaactccactatctactcatgggagaatgagtacaccaggcaaacaatgtagtgttatagaaatagtctgattttgtagaactcctgaaattgtctcagggacctcctaggtatcctcagaccactctctgagaatcacttgtctgtaagaacagcttttaaaacttggttgttttcctgttacctagccatcttcttttctcactttcaatttttccttctagatgaaatcatgcacccagtgcttcattaacgtcgtacgtgtagtgactccaaaatctggagctctcaatttagcattgaccaactgggcatctccatctgagttatgtatcttaagggcatcacttttcctaccagataccaacagtcctgagagtcatcactgacacttctttccctccacccaggcattaccagatagatatttttatgtacccaataccattgaaaaccatctgtttctcttgatatactactaatattctagttcttaaggtatttatttattgcctataaatagattttaccaaaataacctcctaatcccatcccttgcttatagtcttgtctcctaattaatcccccactttaaagcaagaataatctttcttacaaagtttttctactgaagtatactatacgttcagaggaatgcacaatacatgtgtccaacccattggatgttcacagactgaacacatttgtaaaaccactcaaatcagtaagtaggaaattactagtttcccatagtccccttgtgttttcttctagtcactcctccctaccctcacccctcaaaggtaactactgtcctgatttctagcaccattgattagttttgtgtgtttgagctccatataaatggaattgacagcatgtactctttttgtgcctagcttcttttgttaacagtattatctgagattgtactttatttcacatatcattcattaattgttattgcatcattcttattgctatatagtgttttattgtatgaatatgccataatttagtctactgttgatgaacattcaagtaattcccagtttggtgctattatgcataataaggtgctattactattcttaaacatattttttggtaaacatgtacagacacatatcaatttctcttgagtttatggttcgaagtggaattgctgggctgtggagtgtgaatgtgttcctctttagtagataatttcagatcaaaaatggttgttccagttaaccatacggtgtttttgcctttttcatcatagctgttctaaaattttgtagtagtatcttactgtggttttagtttgcattctcctaatgaagttgaaaactttttcacatgttcactgaccattgtacaccctattttgtgaagtgtctgttccaaatgtctgccgttctgctattgtgttacctgttttttttttcttgttaattagaggaattctttatgttttctggatatgagatttttatcagatatataaatatattgttagtgttttctcccactctatgagttgcagaacagtcttttaaaagaataaattgaatgttcattttattttcctgtttcaaattccctaatttcccattgccttcaggagcaagtacaaattctaactacgcctataaaacttttgattatctggttactctttgtatttccaggccccactccgaagtctgtggtttttatttggttccttaaacttcttgtatttgttcatcatgtgttcttaaggaccaatgaagtaacataaaaagtaaaagtatcattgcagtagaatgtgtgaaaatattttggtaatcttggaggttagtacatcctccttaaatagggcataaaacccagaagccacaaacatttgattacataaaactaggagtttctgtgtaactaaatgcagaagttaaaaacagatgaaatggtaaaagaaaatacttgacatgtgtaacgtgtaagcattagtaaagatactatatagacatataatgagtttctacaaatacataagaaaaagacggcctagttaaaaaatgagtaaaaatatatatgtatcagataggtaactcacaggagaaatagaactggccaataaatgctcaatcttactgcagggaaatactgatgaaaataaagagatatgattactcacccattcgtttggcagaaatgaagaacattaatgttttcaagtgggggtttacattggtaaaggagttttggagtacagtttggtgttattagaaatagaaattatacttattttcagtctagcaatgtagtctgagaaataatgtcatagaaaaatacttgcacttgaaccaaagtatatatcaaaatgttcatataagtcttgtttttaacagcaaaatactggaaacagttcatctgtctttaagaaggaaactcttttaagtaagctacgataaagtatgatcatattaatgaaatgctttgcagacgttaaaatgaagatagttgaactctatgacttggaaagatcttgtttatagggcagtgttgaatgttaaagggaaaaatgtaaaacattattttcatgcatatgacactaaactgttagcagtgttatcactggagtaaggatggctgtaggaggaatataagggaaatttcatattttactctgtgtattcagaattatttaagactttagcaatgagaatgtatcataaaggcaaagtacaaaatatagaatggaattcaaaaacaagtgtctgaaatcagttaatgaatttagaaaacgtctcagacagcttgaggttaaaaactgatacacataaatgatactaactcattggaaaaaggttaaatataattagcatgatgtaacaaggcaattcacaagtatttatagtttttaatccttatacataaaccttttatatatctatgattatttttatacaataaattactggaagttgctgatcaacacagagaggggaacatcacacaccagggcctgttgtggggatggggggtgaggggagggagagcattaggacaagtacttaatgcatgcagggcttaaaacctagatgacaggttgataggtacatcaacctgtacctataggtacaaaccaccatggcacatgtatacctatgttacaaacctgcacattcagcacatgtatcccagaacttaaagtaaaataaataaattttaaaaaaagttgctgtattaaaattaaagttatgtattgatgttcttaaggcttttacccatattgacaaataattttacaagatagatgtactagtttgcattgctactgccagagaatgagtatgtcctttatttgtacctttaccaacaattaatattataattagaaaaaatggctcctgaatacatgaaaaaatatgtgtatactttcttcatttctttctctttgtgaattgccttgtaatgtcctttacctgttctgttaattagtaagaattctttatatagaaagaatcttaaccttttcttatgtgttgcatatatttttctgttgtatattcttaaaaatatctaccttgttaaatatacctttctaattatacttgatatttttctgatgacttaacaatcatttatgtgaatcaatttttataaggcaaaattgtagtgataacctgaagctacatgagagacattttctaaatttattaactggcttcagactcttgtttttgaattccatcctgtattttgtacttcctgttttttcttttgttgtcaaaatactgtcagttgcaatgtgcctatcttgtagtccatctcttacaggttaggaaaatatctgagtttttattatatgcgtaaaataagcaccttcagaataaagacctgagagcttttcttctgagcaaactatattagttatatttactacattgactagactttttatttattttgtttttttttttttgagacgaagtcttgctctgttgtcaggctggagtgcagtggcacgatgtcagcttactgcaacctccgtctcccgggttcaagcaattctcctgcctctgactcctgagtagctgggactctaggcacgcgccacctcgcccagctaatttttgtatttttagtagagacggggtttcaccgtgttggccaggatggtctcgatttcttgacctgatgatccgccctcctcggcctcccaaagtgctgagcttacaggcgtgagccactgcgcctggctgacttacacatatattttaactgctcaggcctctcccccttggttggatagttgaaaattgagaactgaaagccagcttcttctttcttttatgtgttctgtattggtgatatttccagttgcgaatttttagattggcagtgccttactgataatacagtaccgtcagaaacactgttaatcattcttctcaattaactactctttccgttgttttacctgggtatttggttatggaattttattgaatttaggaacataatcaaaccagaacattgactcctattattcactgatgtaaagtatctcaatagagtacaaaataataactggagatagctagtattcacttaattaaattcagtgtcttcattttatctagtgaaaactacttgcccttaattaaatatttagtaattgctttctgactgaaaaacatgctttagcctatttcatatatttactgagaaattgtcattgtactccaacataagatgagtaatcaagcttagtcacacaggtagtgaatatatatagttaccctctcagtccccaagcatgaatggatagttgtcattctaatgcatttgagcaatatataacagtgatgttcattttcttgggttttaagcagtcaagtaggacttcttatgtttgttgtttttttagttcttcattttatttcttttcccaaggttaagatatgatctaaagtgctagaagtatatcttgagaaggcacctcagtttgtggtcagtcaagtccatcgtggtcaatgaaattcccacctctaggctcctgggcatttatggcaaatgagcgtgatgggtttgggtgctagtgccagcaacttctatgtattttaatgaaatagatctacacaccactcttgattttttaaccaatcttcatagcttttcatcagaaaatataaatggaaatagaaatatggcatcagatccgttgagacggacagttgtgatctaaggaaatagtacaaatcacttgtaaagaaaatgtcataaatcctttaaaaattagtttatgtacacattagtactaaaattactttagttttagatattaatcatttgtctcacaaattttaaaactgaaaagcctatggaagcaatgttgcacacgtaatataacctcactttgtatgatgtattttagtagcgtatctttaggaaaatcaaggagataatgagtcgcatcgtatacagcatgaaatattgaaggctttggtatctttaaggcttagaaattcagctgagtgcattttgtcttttaaaattccatctcctaacaaaaaacccaacttccaaacaacccaaaattgtttccagaaaacccagaaacttccaaaatatttggcttttcatgaagaaatcaaccatggtgattttaatcctttatagaaatggtatctatttcttttatcttttagaagtatgtgatcctgatgaaagactctgctatttagatttgtgtaagaaattagttgaaaaaagtctgtatgatttttggcatagataattatgctagtttctaacagtaatgcaattttattttaaagattctgacaatggagatattaattatgattatgttcatgaattgtcattggaaatgaagcgtcagaagatacagagggaattaatgaagctggaacaagaaaacatggagaagagagaagaaattatcattaaaaaggaggtatgctatttattgcaataaatatgttagtacttaatagcagcatttgtattgatcagataactcagcttcttgctacatcttaaattatattagtatactgatatattgatcaacccactgtatatgtactactccatatatattcatttaattttcacattattctattagataagtagcaaatatttatgttattgaataggtgagcaaagctaagagtttgttgcctagagtcaccagctaatgtaacatggggtttgaatctgcctatgtctgtttcaggcccatgctatttctagaatgccttgtttcttttctaaaaagtgaagatacagttaatttaaatataatttatgatttttctgaggagattttgaaattttatgattttaatttactttattgaaactggtatatgttaggacagttatattgcttaaaatcatggattcaggagtcagactaatatcaacagatagtggttattataattttattatttttatttttatttcaaactttttttgtagggatgagatctttctctattacccaggctggagtgcagtggcactcactgcagccttgaactcctgggctcaagggatcctcccatctcagcctccctaatagctgagaccataggcaccttccatgcctggcttttttttttttgtataagagatagggttttttttatgttatccaggctgatctcaaactcctcacctcaagcaatcctttcacctcagcctctcgagaaactgggattacaggtgtgaaccactgcacccggcaataatatttaattttaatctgaagtttggtgtgattctaaaatactgtaagtcttgttgtaccataagtggaggaatttctgaattgacttactgaatttttttaaaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagaggtcagtagggtgataaatagtatcgagaaaatagctttttctgaagtgatactaaaaagaattagtaggttataaaagggtacttttagtacattttatatttaatgtaagcttttttgttctaaaaagaaatttgaaatgtttcaattaaaaagacaattatagagaacaataaaacaaacatctgtgtaacatccacatatgcttcagagctttttattttttaagaaataaaaatacaagatacatttcctgttcctctcttaaatctggtgtttatgatacttgtgcatgtgtttatactttaactaatatgtgttctgcaatgtatagtattgctttcatctattgtaatagggatatatcataaccttctgcacattgctttttcactcaacattttttatgtttatattgatacatataaccttagttcattcatcttagtatttatattataaatttgtctgcttttctgtggaacatttatgttgtttccgatttttaaactgctacaaattatacacaaaaaatttttgtctttcagtatatattatcaagagattgaattctttataacttagaattactgtagaagccagttgaagaagtaaaaatagaaatgattatattcagggactaagaataaggagaagatacattttcatttaaggtcactctgaactatttatattttattttaattaaagtccataccctaattttatcttaaaaaaaatgaactaaaaatatcttctacctaagatttaatcagttaacaagccctgtctatttgaacctgtaatgaaactcatatttatctccctccttctagttcctagaaactaaccctatttcagactctacttaactttttgcctagattattatatcactaactatattgactttatgtagtttctacccaccacccacacaggtgaacattttcattcagctacctcaacccatttattttgtagatgctgtcagagaaatcttaaaaggacaattccaattaatttattataccattgaaaaactcagtggtttttcattctgtagaatgaaattcagattccttagaatgacatttacactttggtcttttctttcttgtcagtagtttttgtccagcttcctcctatctacccccttctatctcaattcttcaatctctagctcaaattttaagttttcccatttctctttatggaacataagttctgttccctttaggtacctatcagattttgcttatacctccatgttgataataattgcctgttgcattatatttcagctgtgacttatgttttataacctttattaaatttaagctccttgaagattgggatcttggttattcatagttctgtcttctcatagtgcctacttgacatagaactttgcattgtaataaggcacttagtaaagttgagttgatcctctccctcatattgcctacttggcatagaactttgcattttaataaggcgctcagtaaagttgagttgatcctatcctttgttcatgcaattgagtaaatattgcaaaggtatattgaagaagttgaatgaacagagagtgatacgctccacttcacttgctcttatcctcttggctaaccagctatgtaactttccctcaattctattcatttccccaataaactgcatactagaaataccctttcttccttgtcttatctgttctgtttatagaatatttgaaacttaatcttttcatagaaagttttgataactatttagacaaagggttagtttcatcttttacatacaatctcttttgcttctttattagtaacacatcctattataaatatttgtcatgaataatcattcacactggtttaattactgtatttcttatattctactatgttgttgactttacgatgcaccgttaatttaataataaaagcaaaaggacctggaaaaacagtatattaaaaatacaaagaaaacatttaattgagtatagcatttcttttctttttttttttttggagtataacatttatgcagtttacatttcctagagtgtgtcaagtaatcatcttttaattttattgctggatcatactatcaactcagaacatactaagcacatgtaaggattagaatttcagttaaaactcagtggagtattttaaccagtgtcagccaactgaggtgtgataatcaggtaaacaaatttcttggtggtcttactaggttatcatattgaatggaaagatataattactgacaaattaaaacttacacttttccctgaaagctggcatttttctttgtttgacatttattttgagatatagtctgatagtaagatttgtcctgatatatgagatatggtataatctaaaatcataaatatattacctattctgtccatctgcacttttaatcttagtttttattaggtgaatttttctttatagctctttgtacagagaatattaagtatgtcaaaagctaatctaaaacaatagttttgaagagagagagaaaagattaaaaactgataaaagtaaacaggtgggctctttgccacaagtctgaagtaggctctgtgccactgaaacaacaattagttgactttttaaatgttgaagatcttggtgatttcagaatacacaaaaccagttttggcctcttcagttggaaagcactgtaacgtaattgtgttttctaaccacatataattttgatggtaatgtgaagaaatgctgtactttagtaagtatattagaatagtccagattgtgattatagccaagtcccaaaatgtcggtggtttaacacaacagaaggttatttctcacgtaaagtcaaaatgagtgtttctgattgacagatggctgtcctatatatggagattgagtaacccaggctccttctgaccatgattccactttcttgggttttcaaggaaaccaaagaacgggatgtacaaagaaaaacggaaattgagtattgcagttatttagctctatagtttacaattgcctggcatatgagagccctttgaaatttgggcctggaggtggtatacatcatttccactcacgttcctttggccaggtcttggtcacttggccatgcttaatttcaagaaagtgtagatagtatggtttaccactgtgctcagaagaaaagtttggtaaaccccctgctagtctctgtcacaggtgataatgtaaaaatagtttgtgtcaagaattcctttgttgtttaatcatgaaattttaaaagataattttgatacagatgctaattattgatccgtttttatctttaaagtagaaaagtatccagaaatacagatatttatcacatatctgttagggtgcataagaagattgagtcatctcatgaatatgcaatgagatatgtggctaatatagttgttggcagaagacaaggatgaaaactagatttagtcgtcatattttagtaatttcctacttgtttacatggttaacgctatgagtgataataagacatagggatgaggactaagagagctacattttctcaatgctatgagtcaagtgcttttaaaatattgccagcaattttgaggtagatactatctcatatatatatatggctaagaactcttgggacttgagaattctgagaattcagcatgataggaaataagttctaggattttaggcttaggtcttcatttataaatatcagtagatagtgagattagtagatagtgaaaactcaccagatgtatgaaaagggttacttgcaaacctagtaccagactgaacactctgagcagatggcttacacagaaacgttaatacagtaaacaggaacaaacttaaattataaattcatttataagtttagtgcaatttgtgaggatattgtatttagaagacaaaagcagttgattatgggaaaaaaactgtgaacaactatatttttattttattttattttattttatatttttgcaggagactggagttttattaatcaatctccctgagcatttggggatcagagttttagaggacaacttggtggcggggcagcagggagactgggggaagccagtaagccaggagtgctgactggtcaagtcagagatgaaatccgagggagtcgaagctgtcttcttgtgctgagtcagttccttggtgggggctacaagatcagatgagccagtttatcgatctggttggtgccaggttgaacaacttttttttttttttttgggacagagtcccactctgtcacccaggctggtgtgcagtcagctcactgcaacatctgcctcctgggttcaagcggttcttctgcctcagcctcctgagtagctgggattacaggcgtgcgccaccacacctggctaatttttgtatttttagtagaggcggggtttcaccatgttggtcatgctggtctcgaactcctgaccgcctcacgatccgcccaccttggcctttcaaagtgctgggattacaggtatgagccacgtcgcccagcctgaacaacaatattttaaaagagaaaagagttcaaatggaaaatcatagaataggacagatgcagtggtctgaggtggacagatcacttgagcccaagagtttgagaccagcctggataacgtgataaaaccctgtctctacaaaaatatgaaatttagccagttgtggtggtatgcacctatactcctagctactcagagggctgaggcatggggatcactggagccctgggggtcgaggctgcagtgagccatgattgtgccactgcactccagcctgggcaacagagcgagacactgtctccaaaaaaaagaagaaatcaaaaaatagcagaacaacgagattgccaaatttagaattagcaaaatgagtactactttaaaaattactgaatataaagacagatttaagatcctggaaaagcaggaaaaatggaaatgacagagacatctaacatggaggagagatccaagagatacagtaactgtgtaataaagagaactgcagagacttgggtcataaggaaaagttttgaaatgaaaatagaagaaattgagtaaaaagtttgaagtttcagattgaaacagtccatttagtgctggaaaagattttttgaaaatacctggatttagtgaaaatctttttccagtgagtaattttcaagggataatgttcataagcatgccaacagaaaaaccagcttacctgaatagtaaaaaatttgattttctttggacttctgacctgcaacgttaaatgttacaaaatattttaactagagctctgaggtaaaaggattttgacatgaaaatgctatattcaattaaactattgttaaagtaagaggcaaagacagccagttttgaatgtgtatgggatcaaagttatactatttacttaaaattacttaaattgccaaaaagaggcacttaaagaacaaaatttgtaccccaaaatcaattacaagtagattaaagacaaatgtgaaaggcaaaattacaaaattttaggagaccatctttgtgacctcagagttggtaaaaatttcttaaataagattgagaaatttatgatgaatatatactgacagtggttgatatttcatttgtagatgatgtaattgtgttttttgaataatgatgaaaacctggaagccacctgaaaaactatgaaattgttttagaaagttttggagcatctattcagggaaattctatacagtcaataaaaatgattacctaaatctgcttttttaaaaaaaattttattttgagttagagtcttactctgtcacccagactagagtgcagtggcgcaatcttggctcactgcaacctctttcttccgggttcaagtgattctcctgcctcagcctctggagtagctgggattacaggcacccaccaccatgcctggctaatttttgtatttttagtagagatagggtttcaccatgttggccaggctggtctcgaactcctgacctcaagtgatccacccctccctcctctgcctcccaaagtgatgggattacaccatgcccaacctaaatctactttttgttacagaaagatgctcacactatgtctatgttcaatatttgaaaattttgcaaaatattgtaataggatatcccatgaatgtatgtgacacacacacacacacacacagagttaccatttccaatgatgagagaaaatagttgtgactatatatatatatgatttgcacatattttctcgcattctataagttgccttttcactttgttgattgtgtcctttgacatgcaaaagttttaaaatttgatttagtctcatttgtctatttttgctttgttgttacctgtgcctttggtgtcatagccaagaaatcattgccaagtccaatgtcatgaagcttttcttctatattttcttttcggatttttatagtttttgcttttatgtttaggtctttattttgagttaatttttgatctggtgcaatgtaaaggtccagcttcattcttttgcatgtgaatacccagttttaaatgaatagacagagaaagtaagatatatggcaaaagtatgtaaatattcaagatgttaaaaatagttctctttgagtagtagaattataggtgatttttactttctttgtctacttttctgtcttaaaaaaaaacagtttaaacagtcattgtattaacatcttttctgaaagtgtcttcctatttcacctctatcttttctcagaaacctgcccctttaaagttatataataataagcagtgttaacaaaataagtatcaagtaaattaattcttcagccatttctgttagtttttttttcttcttgatattggttagtagtatacaaaataataaagggcaagtaatgtaaaggaacgctgctgtttttaagaaggctttaaaaaatatccttttggcatatttgaacctctaatgatagctttttgttaccttcagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtaagtaggattgtatgtttttaacaatattaacttttgtagaatatagaatatttacttttcagaagccgttgggcattagcatattgggttttttagttttgtttacaatagtgtgtatatttattttaataattcccataataattattattatgagtcatggataattcagtaagccttaatttttacaatttatttttcaattttttattgtggtaaaaaaacaaaatgtaccatcttcatcattttaaagtttatagtttggtagtgttaagtattttcacacttgtgaaacaattctgcagaactttttcattttgcaaatctgaaactctgtatctgtcaaaaaataactccccctttccaccttttcccagctcctgttaactatcatcctgttttgtttctgtgaatttgactgcttcagataccttatataagtggaatcatacagtgtttgtcttttttgacaggcttatttcacttagcagaatgtcctcagggttccttcttgctgtggcatgtgacaggatttccttcctttttaaggctgaataatatttgattgtatgtatatgccacattttatttatccattcatccatttgatgggtgtttgggttctttcacctcctggctattgttgatagtgctgctatgagcatgaatgtgtaaataatcccttttgagaccctgctttcagttcttttgtatatatacccagaagtagaattgctgggtcatatgataattctatttttaatttttttgagaaacctgcctactgttttccaatgcagttgcactgttgtacattcccaccaacagtacacaagtgttccagtttctccataccttcaccaacacttagtttgtttgttttatagtcgccattcgaataggtgtgtttatctcattgaggtgaggtgttatcccattgaggttttgatttgcatttctctgatgattagccatgttgaacatcctttcatgtgcttgtcggccatttgtatatcatctttggagaaatgtctttccaattctttgcccattttttaattgggttatttgattttttttctgttgagttctaagagttcgttatatattctggacattaaccccttaacagagataagattttaaaatattttttcctattccatatgttgcttttttttttttcactctgttaattgtgtcttcttgacatgcaagagaacagttaactgaagacttcagagttcttaagtatgttttcttagactatactctatattttactcagtccagcaggtgtgtttgtgaaaattacatgtaaatgtttttggtgattgacattctatcagtaataaatgtttttggtgattgacattctatcagtaaagcctttagttttccctaatggttctttgtacttttattttggtattttgactaagaagtctctgagagttggttcttaacacctgttgctaggtagtttatcatttaaatggtaaaaacatttgtgttatgaggagttgaatattacacaggcttatccttcattttccagtttttctcccttggttatccctaaatggtatgcataggactcacctgttatttagtatgtagacaaatctgaacttggtttttaaatttatttttattttttattttttcatctaaggacatgaaacaacagagctaggaatactggaagattatgtaaatacctgatctgcacgcactggagttctaaagccatatgtgacaagacattggaaaaagacattttggtttaggaagagttaattaccaaggttcttaggtggggctgttattttcatttgtctccattactctgaatgaagaaattacaggcgcaccaattttattgaagctcacagatgttgtgtatttttacaaatggaaggtttgtggcatccctgcattaaacaagcctatcagtgccatttttccaataacatgtgctcactttgtgtctctgtaattcttgaaatatttcaagctttttcatcattattgtatctgttacgatggactgtgatcagtaattgtcgcattaccattgtaattgttctggggtgtcgtgaactgcacccatataaaacagtgaacttaatctgcaaatgtgtgtgttctgactgccctactgactggctagtcccctgtctctcaccatctccttgggcctctgtattccttgagacacaacaatattgaaattaggccaactaataaccctatgtgtagtggcctctaagtgttcaagtagaaaggaagagtctcttactttaaatcaaaagctagaagtgattaagcttagtgaggaaggcatactgaaaacttaggtggcaagctagatctcttgtgccagtcagctaagttgtgaatgcaaaggaaaagttcttgaaggaaatttaaagtgctactccaatgaacacatgaatgggaagaaagcaaaacagccatattgctgatgcggacaaagtttgagtgggctggataaaagatcaaagcagccacagttgaaatcagccacaacattcctttaagccagagtctaatctggagcaaggtcctaactctctttaattctttcgaggctgaaagaggtaaggaagctgcaggaaaaaagtttgaagttagcagaggttacttcatgacatttaacgaatgaagccatctccgtagcacaaaagtgcaagatgaagcagcacaaaagtgcaagatgaagcagcacatgctgatgaagaagcagcggcaagttatccggaagatctagataagataattgatgttggccacactaaacaaattttcagtgtagttgatacagccttattggaagaagatgccatccaagatgtccatagccagagaggagaagtcaatgcttggcttcaaagctccgaagaacaggctgactctctcgttaggggccagtgcagctgggggttttaaggtgaagccagtgctcatttaccatcctgaaaatcctaggatttttaagaattatgctaaatgtactttgcctgtgctcttaagtggaaaaacaagcatggatgacagcacatctgtttacagcatggtttactaaatattttaagcccactattgagacctattgctcagaagaaaagattccattcaaaatactactgtttgtttatgatgtgcctgtttacgcaggagctctgatgaagatgtcaggagagattaatagtttcatgctcgctaagacaaaaggcaccctacagcccatggatcaaagactaatttttacttttgagtcttatttaaaaaatacattttataaggccacaactgccatagatagtgattcctctgatggatctgggcaaaataaattgaaaactttatggaaaggatttactgttcaagatgccattaagaacattcgtcattcacaggaggaggtcaaaatattaatagttacagaagttaaaagaagtcaattacaacgttcatggatgacttagagaagttcaagactttattgaaagaagtaactgcaaatgtggtggaaatagcaagagaactagaattaaaagtagatcctgaagatgtaactgaattgctgcaatctcagatcagacttgaacggatgaggagttgcatcatatggatgaacaaagaaagtggtttcttgagatggagtctactcctggtgaagatgctagaaacatttttttaaatgacagtgacaccaaagaattcagagtgtcacataaactttgttgacaaagcagcagcagggtttgagaggattgagtccaggtttgttttttgtgtatgtgtgtgctgttttttgtttttcttctcactgtaacccaggcttaagtgcactggcgtgatctcagctcactgtgtctcgctattacccaggcttaagtgcactggcgccatctcagctcattgtagcctccgcctcccatcaagtggtgaagtgatcctcccacctcaccctcccaagtagctgggcttacaggcttgcgttgccacactcagctaatttttaaaatctttttgtagagatgaggtctcgctatgttgtccagactgatcttgaactcctggactcaagtaatcctgccttggcctcccaaaacattgtagttataggcttgagccaccatgcccagccgactgcagttttgaaaattctactgtgggtaaaatgctagcgaacagcatcacaagctacagataaatcttttgcgaaaggaagagtcaattggtgtgacaaacttcatcattgtcttcttttaagaaattgccacagcctccccagccttttgcaaccttcatcctcgtcagtcaacagccatcagcatcaagataatacccttacccacaaaacggttaaaactctctgaaggcttagatgggtgttagcatttctttaacaataaagtattttaaaaattaagttatgtacttttatttttttttttgagacggagtttcgctgtgtcacccaggctggagtgcagtggcacaatcttggctcattgcaagctccatctcctggattcatgccattctcctgcctcagcctcccgagtagctgggactacaggcgcccaccaccacgcccagctaattttttttttgtatttttagtagagatggggtttcactgtgttagtcaggatggtgtcaatctccttaccttgtgatcctcccatctcagcctcccaaagtgctgggatgacaggtgtgagccaccgcgcccggcctgtacttttttagatataaatctattgtacacttaaaagactacagtatagtgtaaacataacttgtgtgtgtactaggaaaccaaaaaatttgtgtggctcacttaactgtgatatttgctttattgtgggaaccaaacctatgtttctgaggtgtacctgtattaattttaaaactaaacagtatctttgtcactgtcttcagattgataaggaatgtaattaaaggttaatgtctaaattccttttggaaaaaattgccctttaaaaatactttaaatgtcataatgggcgtattagtagtgttttgtttactagtaggtgttgtgcttaagtaaaattgctaattcattcatccaacagttacttaaatacctgttctaaagctggtattgcagcagtgagcaaaagtgtttccaaaagttttgttagtacaggtagaagtaatatagtgatggggtgtgtgtgtgtatgtgtgtgtttgtaaaatagtgtttccaaatacgtgggttttggctttgggtttgtttttttttccttcaagtatgacccactaggcttactggatataagcggttgcttacatttcttaaaggatggctctctattgagttacccatttacatggcataggtgtgcatacacatggcataggagatgcaacaatgctacacgatcctctgactttaaatccttctagctgttctctgtgtctcagttgtccaaattcaaaaataaattgtaacagttaatgtttactgaattatccattactcataatagataataattgtgtctcagttgtccaacgttctgtatcaggtgcttctaacccgaagtccactggtggattttaggggtctacaagtttcttgagttatgtataaaactttgcctgtgtatgtgttttggtgagggagagtgcccatacccttctagaaaagttcatgattttcccttctccaaaaaaatgttagaattatgaatcattcttgaagcctaggacactaacctgatgtcaaggatttgagtactttcctcccaaactgtcattggcatatcaagtttgttaaaaatgtactcttcccagagtatttgtaagtttaatacgaaattctatcatgtggttaatttttaattgaataatttggagacttcggcccttaaatgaatgtcatcagtgtcttccaacttaactttactcagctttgatttatttattcaatgttgatcaaaacctgagtactactcatttacgcagagaaaaagccttatggatttattactgtgctttcagaaaatatagcaatttcccataatatttttttaaaataaactttccgtgacctactctacagagaatagtaaaatactatttctgcccctcttatcctcagggaatacattccaagacccccagtagatgccagaaatggcagatagtgctgaaccttgtatatactatgcatgaatttcttcttctttattcataatttcatgtatagactattccttcttattgtagatttttgcaacctcagcatacagtttttcttcttaagaactttcatgttttcactcaaaggaagtactttatggctttttttttttttttgtacatattcaaattgccagcatcactcttctttgcactttgggtcattattaagtaaaataagggttactcgaactgcataattactgttattgccaaactgcaagtcaatctgataactgagatggctacaaagtgatcagcgagcaagtgcatacagtgtatagtggttgcggtagagtggaacgacaaaagatttcactgtgccacttagaactgtgtgcaatttaaaacatatgaattgtttatttctggaagtttccattagtatatttggactgtggttgaccagggaaagcaaaacagcaggtaagctgggcctattgtagtgggaacccaacaaactaattttttttcctgtaaattgtttagaagagatgtaaatcaaagggaaattaagtttattttaggtatttagtcagaaagataatttttgaagggaatactctgtgtcaatattcctaacctattatgtctagataatcctaaattgaatatttataatgatcttttggtagatgtaatacttgcttttatcagtgtactcacttatattagtatatattctttatagtttcccatgctaaatcaggaaagtaaactaatacattagtagtattttaggaacaagggtttaaacacaaaatcttcttggataataatcagaaaaattatctgacaattgcatgtagctcattctgccagatattttggtttcagtatgattctgctgacaggtgatatgttttaatcataatgctaggttgtaggactttgtggtcaaatgaaaaaatagtactcagagcatagctaactaaaaacacaatcattccaacacaattacctgagtgtagaaatctgcttattacttgatagtagttggatcaggttgttcttgtattgctataaagaaatacctgggacaaggtaacttataaagaaaagaagtttaattggctcatggttctgcaggccgtacaaacatggctccagcatctgctgctggtggggcctcagaaagcttactaggaggaggtatgctgaagtaaaagtgctaattcatttattcatccaacagttacttgattacctgttctaaagctggtattgcagcagtgggcaaaaatatttccaaaagctttgttagtacaagtagaataatgtggggtgtgggtgtatgtgtgtaaaatagtgtttccaaatatgtggggtttgtaatatagccaaacatgattatattgcacactaagcttacgaaaggcttgtgttaagaatgaaatcatgttataaacatcaaaacaactcattcacaagggataaaaaagaagcctttcacatttagtcaaattaaccaaggcttggactgtctttagtaggtgtgatgttgggaaaatttgttgaattcaggagagaaactcatatctagaaagagtttatgaccctaaataattgtacttttagcttttgtccaacttgctttgcaaaattggagacttgaggaaggctgttctcaagtattttcagagaggtttttagtagcagctggtggttcggaagtttaatcctattccaataattgattcagtcagaaatgcataatatagagtcaattctgtaaagaatgtagggctgtgttataatgacattaataaaatagcctctacctgcactgtcaaaatccatcctaatctggctgtggtctggtgccaggtggtggcgtttttttttttttttttcactgatagttaaatgaccgtaagaagaattttggctcctgtgactagatgggacttccaggccattggcagggatttcaaaaatctcccttgcttggcacccagtggcctgatctgggaaggtattatgtctgggaaatgcagattggggacttctgcaccttcctcttccaaaactggattatctactgtttcttggcctggtttggtcctctgcttcatattcttgccaccctaccctatccccagcagaaagtagtaactttaactggttccaccaagcggaaggagccagttgtcttatgccaatgtgtgttgtttctgggttttattgtattttaaatatcgattctcttactctgggagcttaaaaacaatccacatgcgtgcggcaggaataccagctatttgtctttttctaacccttgatcacattggtaggtacagcttttagttcaagccatgttgttgaataagtctatgtaaggctcttaccttgaaccacgtttcataaaagtattagttgttaaattattctggatttgaatagcattaaaggatgggttaatttaagggttgtctttaacattttttattctgagattgaaactttggaaattacagttgacccttgaacaatgaaggggtagggggtcaacccctgtgcagttgaaaatccttgtataacttttgactccccccaaacttagctactaatagcccactgttaactggaaactttactgataacataaacgtttgattaacacatattttgtatgttatttgtattatatactgtattgttattacaaagtaagctagagaaaagaaaatgttaagaaaatcataaggaagagaaaatatatttactattcattaagtggaaatggatcattataaaggttgtccctttgaggaggctagaagtgcaaaaaggaggcgttgttcttgctgtctcaaggctggcagaggcagaagtaaactcacacgtaagtgtggaccctgtgttgttcaagagtcaaccatactgcgtttgtgcatgcaaaaatgaaatctgaacaaaattattagtaccttagtgaatattttcttgtattatctagaacttacatgagggttttttttaatcaaatctgttttacaagtatcattatgtatttatggaggagtgatcttttaaaagattcccacagacaagtgtcctcctagttctgtaagattgttcagttagaaatgattccctttccagggagtatttagcctgctgcaaaagaatagcaagctactaggtgtaaaacaaatcacacagaagcattttcttttttcatcttacaggtttatttagacgagtaagatcttgttatattttaaatggcacttaaccacctatcactctccagtgctttctctcatgcttagaataaaatccagacttttaccatgacctgtggcccacatctggctctgcctgctttctgattccctcatgagactctgttctctcataaattgtggttccacttggcttctttctattcttatacatcaagatccctcctacctcctttgtgcttattgatcctaaagctcttgcctcagatcttcagcacttggctcaaatatatcctctagtaagggtcctttccttaccaagcaacctagagtagtcaccctgacatagttttttgtgttttgtgatcaagggctagaaaaagacaaatagccggtattcctgccacacacatgtagattgtttttaaactccaaaagtaaaaagcacatactttttgtgtttttttggacctaacagttctattttgttgtccttttgtataaatgttgttacattaattagcagaaattgtcttgctttgtcattgttggtttgctccctggaccatagactctgttactagatagactggtttccagtcctccctcgatgtattagtcaaggttttccagagaaactgaaccagtagaagatatgtctagaatgagatttacttaaggaattggctcatgcaattatggaggctataaagccctgtgatctggctgcaagctggagacccaggaaagctggtggtgtaattcagaagcgtgagaggtagaaagctgcctccattcagagtgtaagacctgagaagcaagggtagatcaacgttcagctcaagcagtcaggcagagaatgtaaccttccttcacctttttgttctgttcaggccctcagtagatcagatgatacacacattggtcagggccatctgctttactcagtttactgatttcaaatgccagactcttttaggaagccctcacagacgtgcccagaaataatgtttagccagatatctgggccattccatgacccagttaacccagttatgtcagaagttgcaaatttttttgtgaaaaatcagaccttggccatgagaccttgagcagtaggatataaataactcccacaagtttagtattccaataatggaacactaggcataaatggattaagttgacacataaaattaaccatgacattcaattaccttattagattgtcataaagattaagtgagttaatatatgacaagcacttaaaatagtgtcacacacatagtagcaatatacgttacttgctattattaatgtcattactattattatgttagtggttttgttctcttcatttctgtatcctcattgccaaaaataatgcttggagcttagtatgtgctcacttaatatttgttgagtgaattaaaatgatttaataaatataaacttcatatgtaaaataatagaacctaaatatttctacttgcaaaatgtgtattatgttgtattttatcactgaaaacagagatgattttggtagtgcccatattacctttgtgttttaaaaatgtatacattttacatgattttaaaggttaaaatatgaatgttagtgcattatgtaagcatattttcatatttgagaaatagaaaccattttttgaaagaaacattggtgttactatttttaagtaagtctggggtaaacctattagtttgcaggtgaaattacttgcatcttgaatgagagtttttatttttaaatttcttaacttttcacattttttcccaaaatgaaatataccctgaatattctcattccacaccacatcatatcctaattatagcagcactaaaaagtgtttgattggaatctagtcagaccaaagatcaactttccctggatacaataaatcacagtgctcttgattacattatacaggtttttgttttaaggtattaagcttctcttcattaaataaactttccttttttctttatttgaatttcaagtttcactaattttttccctcagataagaaaccagccaattataaagcataagacgaattaatctgaagttacttctattctaagtggaaatgtactttactatagctctgtaatagtctatagccaaagtactattaattttcaccagatttcaagacagtttcgttgcttagaatcataccttttatatatgcagaatggacgtaggtgaaggttgagtaaaaagaaaatatgattaaaaagttgaagccattatttgacaacccattagtgttctgaccttaatgtgatagcccgattatcctaagtttgaagttttttcttccatgctatagccatcaagttgaatagaaacatgattggaccctaatgtgttttttaaaggtagtatatgtgaactgttttgtttttttaagttttatgaactaataactcaaggctattgtagacattcttgaaacaattttaagtataccccagaaataaacacagaagtaaccaaaatatcagttcaatggagaaccattcattctttagttttttaaattgacgagaaccatcaagcatggtggctcatgcctataatcccagcactttaggaggctgaggcaggatgatggcttgagcccaggagttcaagaccaaccggggtatagtgagacctcgtctctataaaaaataaaacaaagtagctgagtgtggtggcatgtgcctgtagtcccagctgctcgggaggctgaggtgggaggatcacttgagcccagaaagccaagagtgcagtgagccatgatcatgccactgtactgtagcctgggtgacagcgagaccttgtccccccgcccatccccccaaaaatttactagaacctaatgacattgaaattgaaaacaaccagacaatactgactctaatttttactcttgcagtgatttttctgttcagtaggatgcatttagatgggcattgatcataaatggttttccaaatttggctaagacccgttgagtatttccactcatattagctgttaagttaataaatttctatttagagtcaattaaattttagtagcttatggcttatctttttatgttagaaaggaatcactattttattaaaagtataaagctttaatcaagtcacagaaaacttgatgtttaagtgagtgtagtgttctagttagctgacttttcatttactgtcacccagaggtatttttatttgcctaaattcttttctgcatattctttctaatatattagatcacattcctgacttagtaacatagtttatagattgaaacctttttttgataaaaggtttactaaggcatcatttataaacaacatagtttaaggtagtggttctcaactgggggtgattttgcctggtagaggacatttggcaatgtctggagtaattttttattgtcataacttggaatgggagggatgctactggcatctagtgagttgaggccagggatgctgttaaacatcctatatataatgtacaagacactccccctcctccgaagagttacccagtacaaaatgtcagtagtgctagggttgagaaactggtttagaattagtaatgatttgtgccatcactgcacatactaaaaaaatgtttatcatagacactgaagataattacagaaatactttgacttaaaaaatcagaatttttttgaataagcttttagctcttgagatgattgctttgaggaatatttatctgggcatgtctagaatattatattttaaacattatttcctgctgcttcttagttattgcacaaaagtttggacaggacccaggtataatagactctaggagtgattcagatgtgcttaatgatcacatctgtttcatgaggttatgtgttgtttctctggtagcagtgaaagaaaatgatttgaagggaataggggaggccttagttgaaccaagaactatgaactaactctcagtttgtgctgcccacagtgaaggcagattacttaagttaaagacagtatatattttgttatcctttccttaattctaggattctttcatagtcctaaatgtcaacccatgcagcgtggactttttgtttgccttagctgatgctacctccccttttaccatagccatgaatttacaggcattctcaaagccactttctctctagatctcagtagtatgttttgccatagtttgtgggttttctccctctaagtatttgttcacactttcagagattatcagagtgaattccatactttaagttagggtagatggtgtatgttggaaaatgcagtgtactttggcaccaaagcctgggagaaaagcactgcatatctcttcttgaactgttgcttctagttgacttaaagttaagtcacgtcgttaaaaaagtgacttacttagaattttacagcattgtgaattaaaatttattctgaagttattgtctatactttcatattcacttttttgtttttaaagattttcctttggctagaaatgaagctcttgaatacatgttttattgttattgttttcccttgtaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccatgaaaggagggaaggtgtgtactgtactttgatttttttaattgaaaaattgaacatccagctttattgttgtactaagagatggagaaagactttgctatgttaagtcttctgtaacacacagactagaatttttgagggcaataggagatgcttaacaacatgggaatgttagctgttaggtgtatacaagttggtatttacaggtatactaagctggtgctttctttagttaagatgttctggccgggtgcagtggctcacgcctgtaatctcaacactttgggaggccgaggtgggaggatcatgcggtcaggagattgagaccatcctggctaatatggtgagaccccgtctctactaaaaatacaaaaaattagctgggcatggtggcatgcacctgtagtcctagctactcgggaagctgaggcaggagaattgcttgaacccgggaggcggagcttgcagtgagccaagatcgcaccaccatactccagcctcggcaacagtgcaagactccatctcaaaaataataacaataataataataataaaagatgttctgctgagtaagtactctcaagttctagaaatttttggccatctgattcttagagcatccttttcaatcactgagttaatgtcttttgaaaacaaggaggtgaagggaagaaaagcaacaaatcagagagcgtagtttgaaagcatcagaagtgttttgataaaggagtgagggctggggggaattgttagaaggtcattgcaaaccgagtcatcaaatttctaggtcataataaagaagtaagcgaagcagttttcctttctagatccctgagaattaagttaactttggatttgctactccctattcaagctgagattttattgttacctggcaataaagcctgtttaatagctctcatctctttctttacttcttgtctaagcttctggtcttcgtagattcaacttaataagtctgttttctaacttctcctgtgttcattttttaacatagtaagtactcaggaaatgcttacttggaacaacatttatatttaatatgcactttaagcgcctcttggtgagtggagtacggcagtctcctatgaaacatgttgaatttagtattctcttcctatcaacaatgcaagcaataatcagtcgggttcttttgttcaagaaaatggcggatgagaatgatattcaagaaaataggcagggactggagaaagcacctatttgatagaattttttttttgtatgtatgattttggaactaggtcagcacagcagtgtttatgaaacattggtaagatgggaaaattctcttatattgtacctttctataaattttaataagatatttaacaactagagttgaccaggaatatagtacatatttaatgactacttattgaatgaaaactccattaacattattaaacatactaaggaagggaaaataataagcaattgagtctcataggaatgcttgtgttaagaagggacttaaatcataggcgttttaagttctttgtaaggaagatgtctgtttaactttccatacgggagatttagcaggcaattgttcctctctatttagatgtcattttctgaaataaggataatttcggtggaaggatagggaggtaggtaaagaagaaaatacagtacctagacgtatttgtaaagacagatgggcgcatcatgagaaaaagatctggcactaagtgaacacattttcaggcacagttggtattgggggaggaatagaagtgaaagatattcacagaaagggatggagatatgtcagatctttgcctcttgcctttgtccttaaacagggtttgtggatatggatatatggacaaaggaattggtgggggagataggttattgatgagggtctaagggccttgtggttacaagatgtttgggtccatgagaaagtctgtgggcctagccattagggacaaagagaaaaggaggtaaacttataatgttttgggcatgaggctgctagagttgccaaaatagccttagactagggcaattccagagtataagagcaccttgcagaagaatctgataaaaagggcagaatttatcctttgaggttctcttgttaattctttggcttcatatcagatttgttataatcaatttgtgccctttctaaatatatgtaaagagtggtttctaatctttgcaaattatggggttgactaagccatctaagttttgggcctctatttctttattataaaatgacatggtttgtttagataatcactgtggttcagcttttaaaaagtgcaagtatttatttttttgtatgaaatgcttttttgttcgttcattttaaagagaaaaagtctcatcttcctatgttgcccaggctgaactcaaactcctggattcaagtgatcttcctacctcagcctcccaagtagctggcactgtaggtacatgccacgtcacccagctagaaaatgctctaagtagagaaagctttaaagacttgcacacatgaatgttataccattaaacagtgcaggaaaagagagtgaataatagtatcactcaaccagctagcttactaaccataggctaccctaaagtgcttaagtacatttgaggaggtcacagatggtctagtttagcctaacttaatagttgatagaaaagattaaagtaactgaagtgtctttgtatctaaaagtggtttctgaaaagtaagccgtcaatgataggagatgaacttatttgtttcagttgtttaggatctggtaagttggggtgagttggggcagtataggtaagttggggcagaggaaattcatgttcggagtttatctaatgaagaacattcttatcaggtgttaattatctttggaattttagcttctttattttttgcaaagaacacgaattgtcattataataaaatttttaaagttctgtattaaatatgttttctagtttcctgaaactttgtaaaagcaattacagtcaatttccaaaattgcattacagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggtaaggtttttgacttgtctatgaactatatcttatatagaaagtataaaatctcctaagatttctaatatgttgtttcttacatttgttatcattttgtcacagtaatttttaattaattgaacttgtagtcttccttataaattcctaattggaattactagttaaaatagcaaaagataaatggagcttgagctagaccccccctaagtatatccagtcatgcctatcatcttgattaatgtggaacactaagaaaatcactatcagacaaaaaagtagaatcacgaggaagttgctttctgttaaataggtataaatatgataaaatgttcattaaattaaagtaggattaaagtggtgggttttcagaattgttggcatcagaaatgactgatttgtgtattcttcagtatttgtacttgcttcagaccctgtcaaactgccacacgtcattatcttgagccatttttcttttcataaaaagtatttgccatcacccaaatgacttaaatatattgtaactatttccaaactgctgagacttaattatcatgacctctctttacctccacctgcttttctcccctctccccaaacactgctgcagaactttgatcacttttattctttccattggtctgttagtcaatccttggtcagtattacagcttcatatttgtgttgagggtcctttagcttctttgagctgccttgtcttttcttgaccttttactttttcatatcaattttagaaaacagtttttaatttcataaaaaaactgttggatttttatttcaatgcatcaacttaatcaatttataatatttctcattaatattttttacattttttcctgtgtatcctctattttttattgccattttaaatagtacttttacattttgtaagatgtaaattatgtatttacatggttcaaaattttgaatgtataaaaggatatatagtgaaaagcctccgttgtaccctgaccactcttttgccagctttgtatgtattcttcccaaaaaacattttacacaagcaaatatatatccatttgttttcccctctggttttacaaaactaatttttaaaaacactggaaaaaactatgtactgttttatatcctactattttcaactagtaaaaatatctttcatgtctttctttgtggtaaacagctattttcttcttttggtacttgttctctattgtagaatataccataaagtcagcaagtgctgcattactgggtattttggttttccaatctttatctctttcaaacagtgctttagtgaataactgtgtacatatgtcactaaatggtgtcttttaaaacattgcattttctaatgctttgttggtacctggaaatggtaattggcatttgtgtattaatcttacatttaaatgatgttgctgtattttcttgatctaattagattctcttaacagatgttcctaggaacacactgatttggctcttcttttctgattattaattttctgtcagtaaccttctgagcatctttatcaatacagtgttaaatataagtagaaggggccgggcgcggtggctcacgcctgtaatcccagcactttgggaggccgaggcgggcggatcacgaggtcaggagatcgagaccatcctggctaacacagtgaaaccccgtctctactaaaaatacaaaaaaattagccgggcgtggtggtgggcgcctgtaatcccagctactcgggaggctgaggcaggagaatggcatgaacccaagaggcggagcttgcagtgagccgggatagcgccactgcagtccagcttgggcgaaagagtgagactccgtctcaaaaaaaaaaaaaaaaaaaaaaaaaaaaaaatatatatatataagtagaaggggctttgctttgtttcagattttaaaggattgttgctggcattttattactaagtatggtgtttgtagattttttgcagatactttttattgtgttaaggattaagttctctccccccattttagttgtcagaaaatactctgttgaaagtcagttctttgggatatgtatttgttaactcttattttgtggctcagtggtctgtttttataagtgttctgcatatgctttcaaaggagttgcatttgtaatggttgaatgcaaaatgtttctctaagataaagtttgttttaactacactttcaaatctacatgtaatttttcttagtctgtttgttctgtcattacagagaggtgagttcagtcttccactgtgattgtggaatttgtagatttgttgatttctacttatagtttgatcatttttttatttgaatatttgaagctttgctattaggtacacgtaaattgagttatttctttctttattcattatagaatgactgtttatgccaggttcaggttgagcatccctaatctgaaatgctccaaaatctaaaactttttaatgtaattttttttgtttttgttttttgttttttctatagccactagcaactgataaaatccagactttttgagagctgacataacattcagaggaaatgcttattggagcattttggatttccaatttttcagattagggatgctgaaccaatataatgcaaatattccaaaatccaaaacacctgtggtcccaagcatttcagataaagggcattcagcctgtatttttcttgaagattgttttgctggcagctgtcttttggttagtatttgtttgatatatctttttccatcctttcaggcttaatttttttttaaatgtaactctaaacaacatatagttttagacagattaaatctcctcattgtatcttctttcattcttaactttcaaatttttcatctctttatctgtttcgcctctaggtcatattctcaggcttaccttctagtttaccaattttttcttagctgcatctaatctgatggttaatccattctttcctagatgttatatgtagcctttttgtagtctgtaaaaatgttttaaattttttcttcctggtctttaattattaaaatatttttcacagctattttgattattaaaatacccgtagaatcatgctgtaattcttttaggtctcaaaagcctgttacatttgtattctttgtgtttttgtttgttttttaaatcttggggaagtgccttttgattctgtctttgggtgggttagtttgtcatatgttcttttttttcttttttatttatttgtttatttatttatttattattttattattattatactttaagttttagggtacatgtgcacaatgtgcaggttagttacatatgtatacatgtgtcatgctggtgtgctgcacccattaactcgtcatttagcattaggtatatctcctaatgctatccctcccccctccctccaccccacaacagtccccagagtgtgatgttccccttcctgtgtccatgtgttctcattgttcaattcccacctatgagtgagaatatgcagtgtttgattttttgttcttgcgatagtttactgagaatgatgcatcactggccatcagagaaatgcaaatcaaaaccacaatgagatgccatctcacaccagtcagaatggcaatcattaaaaagtcaggaaacaacaggtgctggagaggatgtggagaaataggaacacttttacactgttggtgggactgtaaactagttcaacccttgtggaagtcagtgtggcaattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacagtgatagactggattaagaaaatgtggtacatatacaccatggaatactatgcagccataaaaaatgatgagttcatgtcctttgtagggacatggatgaaattggaaatcatcatatgttcttttaagtttggagtgaactcatctttgtcaaagatttatccatggtaattctatgaggttgagggcagggccctcagagtttctgtctttgtttttgccagatattcctaaattatcacagccccagtactgtttctctactcctaaccctcactgctcaaaaaaagcttttttttaaatttcattttgttttgaagtaattaggaattcacaggagattgcaaataaatgtacagggaaactttgtttatccttaccccaacttctccagtgttaacatctaacatcttatctatagcatagtatcaaaaccaaacaattgacattggtacaatccatagagtttattcacatttcaccagtatacatgcacttgggtgtatgtctgtatgtagctttttgtagttttatcatatgtgtagcccatttccatagtcaagatactcatctataacatcctaagattcctttttattacccctttatagccacaaccctcccctggcccctggccccaacccctggcaacctcttatgtgtcccttgttttgtaattgtctcgtaaatggaataatgctatatgtatcctgttgagattggctttttcactcagcataattttttcttggggttcatccaagttgttgcatatatcggtcattcatttttattgccgaatagtattccatggcatgcatgtgccacagtttgtttaactgttcatccattgaaagacattagtgtactttgcaggttttggctgttatcaacaaagccactgtgaacatttgtttcccacatctgttaatgaaaattttcacatacagtttaatgttgtcattaaccttggtgttctatgttggaatgttttcactgtaaactgtatttaagcaataatacgtacccatttttttctttcattatttttatatatctgtgaattaaatatgaagaaatagtttttattttttgttttttttggggggacaggttaattttaatgaatcttattattttatgattttatcatatgacttttatataggtagggaaaactgggacttcgtctactcaggtcagtcattggacaccttggttgttctgattcattgcttgatactcttttcaggagtgattaccacactttggaatattaaatatatatattagtgatgtttaggaggaaagattatgactgatgaaatttgttgaataaagtgtatgtggtaaacatttgtgtgtctatcctttgtttaggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagaggtttgtcaaacagaattttattaaatagtgaacaatatcaattgggcgaattgttttttcaaacagttaccaatttactttttaatataaaatatactttaaggcttgtgctcgatgacacatttgaaactattatatatactcatataatctttgttcacatggtttaggagggattatgtcaatagctagtgaccagtacctactggcaacaaagtgcaaaaacttgggtgccctactgtgtgtttctcatcttacccaaatagcttacaaacctttaaagaatgtagatggttgggttctattccaggcaattctgattcaagaaatacctaaacctttacatctgagtatcctgtctactcactcatttgctatgatcaatagaattttataaggacttccagaaaggaacagtaaaaaaaaactgaatgatagggctggggattgtttagagaaatattttatttgtattctgtcctgagaagatatggtatttgctttagctaattttacgttcttatatgtcttaagctaaaactttttctgttcatctatcaggtgatctcttaaatgaattttgaagcaagattactaggaagcacttaagaagggttgtaaatactttctttggcaagcttttatttctgtacttattagggcctttaaacattaaaaattttatgaaggtcttactaaccttggctgaagtaaggttcactataatgctgagattaatatagcatgaaacttgatggcccagagaattgaatattgatactttactatgggctgaatcaaagaggtaatattatatcttgattggttagtagtgggagaagaataaagtttctaaggcatcatctacttttgggagcatagataggatcagaagtaggagaattgattaggttgagtttataaggtaagcctaatgcattttggttaaaagatgtgtagaatttccttagttacagatagggctggagtttctatgttctgtgttgatatctgaaattttttcttccctgggacttttagaactggtgatgcttttttttaaatttcttttttcctttttttctattttcatatccttgctcagatttttctcatctcatgcctgaattcaatagtaacatttggtttcaatcttatggttagttcaaccacatgtattgatcttctactaggtgccaagaactttgatagttgctttacatatattctgacttagtctttacaatatccttgtaagtgtaggtatgataaaataattcatgttttcacagttttggggattagatctaagagtagtaagattacaatattatagagaagtaggttccagagctggaattcaaactcaggtcttctgaccagaagttcagttctctattttaattttactgtaactacttcaataattatgagatgtatgattgaaataaaaatatattttggaggctaatgaatattttacaaatatttgttgagtacccatgtcaggcactttgctaggcacttgaggtacaataatttcttgtccttgtagaatttaatggggagagggaagaactccccacccaaaaaaacaaagtgtgataaaatgctactactgtatataaaagttctgtgagaagacaaaggagcaaacacaattctgagcaattccaagaaagctgcctaaagaagtgacatctgaattagggcctgaagaataaaaggaaactatagaaggagcactttacagggagagggtgcagcatgtacagacaccagaactgaaagaaacatgtgctttggagtagtaaggaattatgagattggagtcagagtatgctataattggcaaggtagaaaagaaaccagggaaaaggactgatgaaagactataggccaggtagtaaatgacctaagtttagcctagtcaggctaaaaaatttgattttaattgcctttcactgcctacaagataactacttttaaacagttggaagaaataattttcatcaaaaacatattaagggtgttgggaaagattgaaaacaaggataccaattagttagactgttgatgacataggcatctaagaagacctgatcaaggtctgagttaataactatagctatggggacaggaaaaggaacaaagaaatattttagaagtgaagttgattgtacttggatatgatgaggcttagacaacccagagattgtcagctttaatgaattggtatgtcatttattaaaataaggaaatatgtaagtagaagcacatctttgaataacacattttgggggaaagataggggaagataatttagacattttaaagtgatgttcttatattctttccattttcctttgaagaaagtagcattgatattttggttgggaaaatacatctcccataaaagcatgtctgaatagtctatttgctgatattgctgtaattagaaatttaaagtatgatttgctataagttaatggtattgaatttgtttcaggttatcttgtaatgattatgatgttggtatgactcctccaaaccaggaattcagacaatacaaaagatgggtagatagcattctaggaatccaaagtatggtacagaagaaccactttaagttggtttcagcaaaagtgaaagggtttaagaaaactgacttctaatgcatctaccatctctgtgacattgggaagacaactctggaccataatttctgtttttaaatagaaagggggagaagcaactgtgtaggatttcattttgattcagctttaaaatgctatgatcatttgtatctgggtctataacctctaaaatagtaaagataagataattcttgtcttttcaatcagtgattaggaagggaaatccagaatactgtattgaacccttcctagaaacatcctaaaattgttctgcttaatgagttgatgttagatgttccacttaccaacctgttggcctgattataatatgatctttatcaaaaaccagtagatatatagtatgtaaatggaaacatcacagtatcctagatcagaccgcagtagttgctttcaaaaatggctgtctctttgaaaaagttcatgccatcctcttaaacgtttttttatcccagactaattttctgctcaactgggtatttgggcagcatgcattcatttactctgtgtttatgtgatttgtgtgtacatggaaaaaatttatataaaatgtgatgaggttatcagttaacattttaagaaaacagctcttcatctgagtaatcatttatgtaattaaagctaatttattagtaattggttattaattacaaatatatatcactaatatgaaacactttttacatttatttcaagattgctagacatcagtacccttaatattacagttcatgttatattgcagcaacaaattctgacatatgttttgttctactatattttcctcacataatagctgcactttgatgtgtatatattttggcctgaaattagaggtgtgacttacgagggaaattttttttttccttcagctcctatgttctacacctcctgctgcccctatcctttgccaccagtgttctcaggtcctgctggggggacagagaagatcagaggtgaagggtagagatggcagaaagtggggttggagcagtgggctggaggtagggtagggagcatgcagagaaagatcaaagattgatcagtgggaggggggaagggggttgacggggagcaggaaacatggtcgttagagggcaaataaaaattatctttaaaaaatttaaggtctaggggcgattgttacttggatattaagttaaaattaaatatgctacttggtttgtaatttgttgccagtgtgaccctatcacagataaaatttaagatttaccatgctgtcttaccaataggttatctgtcaaattaatcactgacaaaacttgattttcattgtagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagtaagaataattatcagttattaataacattttacatttcaggaaagaattcaaagtttcatttaatgcttttcaatatactcttaatttcctgttaattttttttctctgtatattttcctgtttttcaaatttagtatatgtatcggtgtttaaagtttttttacccagcactttgggaggccgaggcaggcagattccttcaggccaggagtttgagaccagcctgggcaacatggcaaaactccatctctacagaaaatacaaaaattagccggacgtggtggcacgtgcctgtatcccagctacttgggaggctgagatgggaggattgtttgaacctgagaggcagaggttgcagtgagccaagattatgtcattgcactccagcctgggtcgagaccttgtctcaggaaaaaaaaaaaaagttttttcagttgtctagaaaaaataatttttaaattaagacaggaatcagtgaacttgtatcccatcacatcccctagactagtcaccaagggatatcacctgtgccattctgatgatccttcatgacttttatgtgcttgtaattatggagtcactacccccaggctacaggaagcattcacaatgtcttggaactgagggaatccttgtaatcactgcatggttcgaagatgagagaaaaggaagtgtcttctcttgtgctgtggagtagttctttggggtcaaaaaatgtgttcttggcatctgatatacctaagggcattctcccacctcacccccttttaaccagaaaagaacttattgctcaaatatctaggaagttggagattagcttttgcttgttctgatgtggctatatccagattctcaaacaaagcattagcagtttccatctctccagtttccctctgtattaatttcagtctcagaaaggttttctccatatgatggctaagatggccccagagttgtccctgtcagcttagcagtcctctctgagttggggctctcattagttggtgaggagacagttattgactaagctgatcacagtgttcatgagaattctagactcagattggtcaattttgaagttctgtgggcacaaaaccaaacttactagagttaactacttttttgcctccaactgggataaacactgtggtttaccttgccaaaacatactgagaaaataatttatgtatcttcaattttcttgctcttacctccaactcatttgccacagggcgaatacagggtccctgctttaggcttttttcatcctcactattgtggattatggttagggccaaacaacacagcacagaagtagaactttcttcccttaggtcttggctgttctttaatctacagccatggttttctgtagtacactccttggattactttcctgcttccctctccttacattttgaaaaatcttacctgaacataaacttcagagataccttttttaacacatggaggcacaggtacatattcccaccctccccacccgctacttttctgacctctttattttctaagattaaaattctgaaatctttgttatttatcttttattcagtcctctgctttcattagtacagattgagcatcccaaatccaaaaattcagaatttgaaatgctccaaaatctaatgttttttaaacactgacatggcactcagaggaaatgctcattggaacatttcagattttcacatgaaggatgcacaaccagtaagtacaatgcaaatattcaaaacctaaagcatttcatggataagggatacgcaacctgtatttttttcatgcttctgatatctgcttataatagcaaaagtttttctggtttttcatggttagacaatctaagagttgacaatgaccccagaaatttagaagttgaataactctataacagaaactaattacatgagattaatatcttaatctttcattaactgtattgtcatctcagtagttcaatttatccagcactttttttaactgctcttatgtagaacgtttgcctaattgctgtatttattttactctaattgtgtttatttaggtatttccttgaaataactttttctcatgttttaaattttcactttattccagtctgtcagttatctcttgatatataacacatcaccacataagttagtagcttaaaacaacaaccatttatttgctcatgattctgtggattggcagttttgcctgggctcaatagagtggttgttctgttggtctcacttggagtaactcctgtatcaacattacatctgacaatgcagctgggcctggaggcccaggattgtctcattcatgtgtctggcaattagggcatcttgtttctcctccacttgaccccctggccttcagtagtctaaactctgctttgcatgtaatggtagaaacaacaagagggcagaagctgaagcagcaaggcctcctgaatcctcttcacatttgcacagtgtcactttcaccacattctcttgtcatagcaagtcattagatatgaaaaatggggaaataggccagttattgatgggagaggagctttggataaagtagtacacaagcttgggcctgtgagttgtcatattacacctggggccttctccacatggttgttcatctatataaaggagctgtctatgatatacatgtgctggtatgtttttgttttatttttatttcaatagcttttagggtacaagaggtttttggttacctggatgaattcagagattttagtgcacctgtcacctgagtagtccacattgtaccaaacatgtacgtttttatccctcactccccttccaccctcccccttctgagtctccaaagcccattatatcactctgtatgcctttgcatactcatagcttagctctcacttacaggtgagaacaagttgctgcaaaagacattatttttttcctttttatggctgagtagtagtccatggtttcatggtgtatatataccacattttctttatccacccattggccaatgggcacttaggttggttctatatctttacagttgtgaattttgctgctataaacatatatgtgcatgtttttttttttcatataatgacttcttttcctttgggtagatacccagtagtgggattgctggatcaaatatctccttttagttctttagggactctccatactgtttttcatagaggttgtacttatttacatacccaccagcagtgaataagcattcccttttcaccatgtctatgctaacatctcctgttttttttactttttaatggccatttttgtaggagtaaggtggcatctcattgtggtttttaatttgtatttccctgatgattagtgattttgagcattttttcatacgtttgttggctgtttgtatgtcttcttttgagaaatgtctattcgtgtcctttatccactttttgatgggattatttatgtttttcttgctgatttatttgagtttcttatagattctggatactagtcctttgttggatacatagtttgcaaacattttctcccattctatgggttgtctttgttatttattttgctgtgcagaagctttttagtttaattaggttccatttatttatttttggtttcgttgcgtttgcttttagaatcttggccatgaagtctttgcctaggccagtgtccaaaagagttttcccagtgttaatttctagaattttaatggtttcaggttttagatttaagtctttgatccttcttgagctgatttttgtttgagctgagagggatccggtttcattcttttacatgtgacttgccaattttcccaccaccatttagtaaatagagtgtcctttccccagttatgttttgtatgcttttgctgaagatcatttggctttatttctgggttttctattctgttccattggtccatgtatacaatatgtttcttaacttttgaccatagtatttataaacaaacaatgttagtgaaaaaacaggtagtcaaattttaatgaaaatgggggaaaacactagaataatttaagtacccaagagatataaaacgctactcatttaaagctcaactaaggaacaaaaaatataatgaacgtatgaattattttattaatttgtcagcaagaaagtgatttccatgaaggggaaaggaactaattttatggtgtacccacaacatatttggcactgggtttatgacataactaatttattccttactgcaattttatgaaatggactctcatttcccacccattcagccccacccaccattttcagatgagaaactaaggttcagtgacttcaaggaacttacttaaggctgcgtaataactaatgtagttataagttgaactcatagcttttttacttcaaagccaatattaggttttctcattcagctctgcagcataaggcatttttatatcataagaatgcaaaattgctgaatgtttatatcagagggtacattaatatattggtttctgtgctgcatgttaccaccttacagtatttaaatctggcaattttcacttgagttattctacatgtataatgaagaagaagaagaaatgttgtgtattttaagttcacaattcttagcaaatgaagtaaagaatttgtattaaagacactgaatatcctttgtatgatacactctggcaatattgctttcctacaattatatgttccagttatagtaaagagatactagtaaaaacaaaaaaatctctttttttgccccctagaattttataaattgtgtttgcttgtccaatttaggaagcgctatagaaatgaagggagtcccagccctagacagtccccgaagcgccggcgtgaacattctccggacagtgatgcctacaacagtggagatgataaaagtaagcagactctgttttctgtctctctatattcatattcatttgtaaccatgaaaccatcctttcatactagtaggaactgatgaattaagatttttaaaaagttgtcttgctttgctgcctctaaatatctccttttgtgactaaagtatgtgttagagtactgtcattttctactatttatagtaaagccatatttttatttttactaaaattattgtcattttaaaagtttttaaatgatcttgatctcttgatctcatgatccacctgcctcggcctcccaaagtcctgggattacaggtgtgaggagaaattattataatctatatgtaccatgcagtggttactaacctggtgagagtgtgattgcttttatcttttatatagatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcaggtaataaaattgaattgtgatctagtcactgtttcctaggttagtatattttatacacattttaattctaaagtaatgctaaattggttactttacatgctgccttaaattttatgcaactttttaaagaaaagtttagctgccctatcaaaatgttacctgttatcacattaataccaacattataatagaaatacatacagtagtgttaatcagtttaatatcaggattttagtagtatgtcttggtggaagggtttatgtgttcaagtcccttattgatgcctatgattttaaccttcctgctattcttcatgcagtcaaggctgcctcttttgaccacagaaaataagataggggagtaggaggagatcaaataatggagtgattagttctattaatgcctaatcattttatgtacttcttggaagatattttatggttatagtggaaatagacaaggaaacttttttttttatttattagaactttgagagaggaatttttcttaaaatgatttatatatttggatatttatagagagaaatgtatatgtagaatatagaaatatatagaacatatagagacaatatggaacatagaaagttacatagaatatggaaaaaggtaaattatgttttaaaggaccttgaaatgaagcattttgtttctattttatcatgtgctaataactctttatatatggtatatttattttagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagaaacaaataaatccgagagaactgagagtctggaaggtgagtgctacctctgttgtctgtgatactgctttatttcttttcagatttcgtgggaaacaactattttcttttgaaagggcacccactaatgggcaaattgactccattctccattcttctatagaggaagtagatttcagaaggaaaaggcctgtaagatagagatatatatatttttttaatgtggtccccttagcagtaccattaaggcagatttggttcacataaacctaaatgaaataaaagattgtttagatgcagtgtgtatagatgttgaagaataaccatcacatccttttcttagatgttaaaaaaataagattacaaaaattgaaatgacttcttagttcagagagggattcaaataattattagtgaatccctattttctagggcagttgagaacaaatatatgaaacaataacactacctaaaactgtatttaatgtaggattgactagaatcccactggtactccctagtcctagaataggaatgctaagtccgcatcaactcagagccagcctcagctatgtgaaacctcactctccatgcttctgttctttacccttcagcccccatttactagacaagctgactcatgcctttccattctctgcccttctttgtacccactcataccatttcctgatagacctttttcttttatctcatctttcttactcaaaattcaagtcccaatttatacattattttctcgatgaagccttctctgctcgaggcacttactgtttcaaattcatctcttcacattacattttcatctcaattttgagtataaatagcatcaaatcataaagcatggttctgatggaggtacaaccctgggatataattgaatataattgaattaatcattataatagctctcttgtgattggagtcagtatccctcatctctaaaatatataatttgctggttatgatcacagataatatagaatagaaatgtataggtgaatcacttgctatgtgatgtaaagtttttactcaaagtaggaaaatgagttggatcaacttgaaaagttgaaaatcctattatgtgcatttatgtttagatgtatgtttatatgacaaagttactaaaattggttacattagaagtgacttagtgaggatatggggagattattatagaatttaataacatggaaaatcactagaatgactagaaacatctcataacttcttatattttatttgctgcaaattcatacccataaagcatatggttacattttgaaacttagtattgtagattcagtgaaatgtatggttagctagtgattgtaaacgttaagtgtattctgtaattttaggattaagttcacaactaactcaccaagagacaaagtttagcataggtggttgaaaaaagttggtaaaataaaaaaatagaacatacactagtggaactaacaaagttatttttaattgtattaaagcatttttctaaaaattgtgttcatcaatgcaagaagatcattgagatagggaggaggaattgagatgttgagagagaattagacacttcttgtatttttacctcactgttgtaaagtttatataatgagctaaataatatgaactaagatttaagcttcgagtaaattttttaaatgtttgcaagtttttaaattactttgtttagataaattgtgaaaatttgaaaatataacttcaaaatcttttgaagttagatttgtctgagttttaaagttttaaattatcaaaaataatacacagtcaacattagtatgttagtagtagcttttatttgtcatatttttattgtgatcttataagctgttctcataattgctgtccagattgtattcttgctattaaagtttaatttaactaattaaattttatttttgttttcttttgatattatcaagtatttgaataattaagagatacagttttctgatgaaaagatgtttttcacattgttataatgtgtgtaccctctaccttttggtttgacttagtcatcctctccctttaatgttgtctttgatctgaaattaatttgtctatttagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccaggtaactatttgcagaggtggttaaacatgaaaattatctgttatatgatattaaagtattattaccttctactctgtaaaaattgacctaagacacttagaatttttccttttacattttacttaaggttgaaaggccaataaaatgaaaattatagcctatatgcctactcctttttaagtaggcattgtctatgaattagaaagggcctcatttaaaatagcaaaattctaaagtttattttccagaatttaagaatcatattatatgacttggaatctaaacaaatactgattgtctagcaatgttctttctacatggtagttatatggtacaaagcttcacaactgtggtgacacaagccaactttttaaacaacctgtcaaaaatttacagtagttgaaattatatttgaacactatatacctctatcaattttctaaatttggtaattattttgacttacagtactttgtgtgttgctggaactcattccagtgattataccatgaagcaacaccccttaatattcctcttgaatcattccaattagtgtctgattgttactaacaacttttttaaatcacagtgaggatcttttctttgattatataaaatatgaaatttttattttaatttgctcttatattttgcaattttttctactgatgtagaaggtatgtatgattgttatctttgttattttctggtatcaggtatttctaagtagaacattatttcttcaactgttccttcgcagtggatggattatttgctctcagtgttaataattgtcactctctgactcttaaagggatttcataatgaaatagttgtttttaaaaattaaaatgtatgtgtgcacacactgcaaacacatgtactcctagatttaacccttaaaaggattctggtaccaagtttcaaaagatcagacccaatctgagtgaaatcaatagagttctttcattggggatctcccatggagttaaaatgagttatttgtatgggtgggttgggttacctgttttcttttggtgggaaggttttttatttgtcagagtccttagattctgagtattatatgggaaggcttttattttaagaataggacatttttggtttaaagtacttttcattttttctgttttctccttgatttatgtaaatgtctatgtagataacaagactgctatttcttggtgtaaaacaaatcttactttttaactttttacagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaaggtagtttcattttactttaactatataatgtctgttaaccatttaagatgccatctgaaggggattctgatctgttcttatgtagcacttaacactgtgtagaaactattttttgagaaatcattttataatcattatttaaccctcatggtcaaagtttctctttaaaatttattttgagaagaagagttatcccacagaaaagttgggaaaagagtacaatgacctttttgtatgaaaattacttattaacaggccaggcgtggtgttgcatgtctgtagtcacagctactcagggaggttgaggcagcaggattgctggagcccaggaaattgaggctgcagtgagccatgattgagccaccacactccaacctaggtgacagagcaagaccctgtctcaaaaaaaaaaaaacaaattaaccaataagttctaatatcaaagtgctcagtggtttgcccttggctaaatgaagcagagccaggaaaaacagactacatatttttcatgtctaaagaaattgggtattttggcagccctttcccctagacatctacccaaatgcaggtgtgtaggttgagtctttaacaaagtgattaagagcttggtctgtaaggccggatgatctggatttcagtaggcacaccacttactggctattacttaatctgtgtgttagtgtcatcatctgtaagtcaggaataatcataccaccaacttcctatggtaattaggagcaaatgagttattacaggcaaaacacttagaacagttcctggcatatagtaatacccaataaatattaactgctactttgaaaatatcctatcacgctgatttttgacctcactgcagcaattttcagttattccagattatctagcttatggattctggtggtaggggttgtttggttttggttttcactgtctctgtctcatctagtacctaccttagtttattttgcaacttactaatactttattaatggggagggacgagtagatggtaaaaagaaggaaaaggaggtaaaaggtgaaaggaacaacattaattaacaattttacgtcatgtccctggacataaaagtttagttagtattaaatttttcactaatacaaaataaaaaaatattgttttatgagttttatgaattcatgcccttcctttactctattagcataagcagtaaatttttttattttaatatagcccaataaacctagagtatacatgtacaaaatacatataattgttaacgtgtattaaccgaaaaatgacccaagacttagttcttgccctactgtatctgccttgtttggttggttctgtgaccttaagcaaataactcctgtgagcctcaattttatttgtaaagtgatggaataaaacccctaaaatcttacccacctctaaagatatttgtttctgtgaccttttgctagtagcatttcaagttaaaatctggtttgattttgctacccatgaaatacagttcggcccttacttattgatgacttaacctaaacagtgaaaatatgcactgtaaagggtggggtgatgtggcttaacaatcagacttcttctatttttgctgctatggtggttgtattagagaactgatgtattatcttgaataaagactttgtcttgtttactgccatatccaaggtctaattatctatctatattttctgctattgcccagaaaagtgcctgacatacatagtaggttttcagtaaatatttatgaaataattgatactgatttttcttttccattttgtctattcaagtgtaccaacatgaaagaaaacataatcatatttcatatataatttttaaaagaaacaactaaagcttaaaacagaaaatttataagtgtactgaaattgaaattgcttttgtctgttttctaattgcgctaaggttaagttcattttttttaatttttaatttttaattttcatgggtacttagtgggtgtatatatttgtggggtacatgagatactttgatacagtcatgcagtgggttaataatcatgtatggaaaatagagtattcatcccctcaagcatttatcctctgtattacaatccaattactgttttagttatttttaaatgtataattaaattgttattgacaataacagtttctacaacagggtgttatagtcaccctgttgtattatcaaatactaagtcttattcgttctttttttttttgtacccattaaccatccccccaactccccacccccacatctccccacccccacatctccccacccccactacccttcccagcctctactaaccatcattctactctctgttggttaagttcttttgagctaaacttttaagaatgcatttagtctgtttcttgagtaatttggtgctgctcagttcaaaactttaaagagactggaaatttagtcatgttttatactccctgaggaggtttgcaggtatgtgttttgtaatctactattttgaaagccaaaaataaggatcccaataaacagaaatgtgtggtaatgaacaattttcaaggaagggtgtaggctcaatgcatttcttttatattatatctgtagtggaatggtagttaatgtttttgtttttgtttttaatcatgtgcatatatgactatatcattggttggtacaaacattggtatatctgaatcatctgaaaaaactgccccttttttcccttaaggtattctagtccaactatggtgattctcattctgcaaatctggtgatagagcccagggaatgttttttaaaaagctcctcagctgatcctgatagactccagtgtttgagaactagtttcgggcttttctatatatttacacctttcttatgttacacatctattgactaggtgtgttatttaagactggtttcttgttaactatctaatctcaatacttacactttgcagcccagaaaattgaaatcggctatgtattgcagcttcattttgttctcagtaaaatgtgtcttttatttttacccaggcgtttactgcttttctttgtgggttgtaaaagtaacctgcttgagcgtgttgtatgaatagaggcagtacctgctgtctttcgtactcttgaccgactcttatttatttggattactgactggtcctgttctgttattttgacttcctttgtgtctatttttaacctaacctctttatattttattctatctttccttaattcttctggggtttttttgtatgttcagtgttttctcccctaccttgcatgttgtgacttaaaactaagtgatttaaatttaatacattgtcccaggtttttatggtgaccaaatctaggacaaagtttgcaggttatctaacaatcactttcttaactaatttttttagaggtcacagacttgaatattgttataacatttgaatcttgctataataaagtcttgaaatctaaaactctaaatagtagttgatggtaagcagtatactgaattagagttcaatgattcttaacttgaacgtttctttaaaacatcctttaaaaacgttctttaaataaattccctggggctgggggcggtgactcatggctgtaatcccagcactttgggaggccgaggcaggcagatcacttgaggtcaggagttcaagactagcctggccaacatggtgaaaccccatctctactaaaaataccaaaaaaaaattagccaggtgtggtggtgtacgcctgtaatcccagctactcgggaagctgaggcaggagaatcgcttgaatccaggaggtggaggtttcagtgagccgaggtcgtgccattgcactccagcctgggcaacagagagatactttatctcaaaaaataaataaataaataaattgtttaaaattaaaaaaaaaattccctgggctctaccttgagatccacatacagtctgcttttcttatattttaagtaaatttaaagtggctatcagaatatttattcttgtttgagactaccaacataactacgtgttgaaggtgcttcacagagaatatattgcctttaatgtgaaataattttcaccaatgttgctaactttaataaagtataaaatttgtagaatattcagttaagtagttggtaacccttttctattttagtaaaacttaatgcatgtttacttttttttgaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaaggtactgttatttccttggaaaaaatacaaagtgaatagtgtgaatggcctatttttcatttggttgttttaaattgagattgcaatcttatgtttttatgagtttggtttcctaatcttttatacatgtaaaaagaagaatgccattaaaatgtataatatgctttattttacttcaacagtattaatgaattttgttttaataaagtttaaaatattccatttctgttaaacgttttttgtgaaaagctttcaacaagcaaacgtattacaaaaatttatttaaattgaaactcaaggaaaaaaatttcttagagtgatgaggatatttatgagagtagtatttatgagaatatacaaagttggaagaaagggaaataaagcgactctatataagcatttgagaggaataaagagattgagaagtaagaggaatagaaattagatttggaagagatctgttaatgaaatctggtaaacccaagatgaaaacattttagactctttaaagttaagaaactgggatttttggccgggcgtggtggctcatgcctgtaatcccagcactttgggaggccaaggcaggtgaatcacgaggtcaggagatcgagaccatcctggctaatacaatgaaaccctgtctctactaaaaatacaaaaaattagccgggcatggtggcgggcatctgtagtcccagctatttgggaggctgaggcaggagaatggcgtaaaccaggaggcggagcttgcagtgagcagagatcgtgccactgcactccagcctgggcgacaaagcaagactccatctcaaaaaaaaaaaaaaaaaaaaaaaaactgggatttttatttggggtggtgagtggatgggtataggtagtacagactgagtattcctaatccgaagcttttgagcatcgacatgaccctcaaaggaaatgctctttggagaatttcagattttggattcttagatagggatgctcaactgggtaagtaaatgtaatgcaaatattccagaatccaaaaaaatttccaaatctgaaacatttctggtccaaagcatttcagttgaggactactcaacctggatgacaaaagagagttggtgtgattctttgcttagaaagtttagagtaatgataaaatggttaacttcactagctttttacttggggcagttaggaaaacagaattatctttgactatataacattgctaaagaaaagattacttcattaaagaaaaatactcagatttagggtagtgggtaggggggattcaatttttaaaaaacagaagaatgagtttatctccaaagattaaaatggaaacaaatacgaggaacaggagatttttaaaacatgtcttgactgtataatcaagttttcctcacttaaaagtctggttcaagattacttttgacagaatcactacagtcattctcctttgctccctgatttcagtatgcacttttctttgttttgtattttgtaacattccctggtcccttctctatgacaataactttccaaaaaatgctaatgtaactttaagtcacaataatatagatacatattttagtataagggaggtagtagttcttcagcatactgcatgattagctgtcttctaaaggatttattcagttttcgagctcactttttatgggacattgaaagattggtaaggagtatagaatagaatgtttggcttacagaaggaaaaactatgtgaggaaggaactcatggcacttaccttcatagaactgaaggattgtcaagtaaaggtaagattgaattacagtgtagcaccatagaagagcttttattccatcacatggaagaaatagtgccattcaacaacagaacgtgcagtgtgttttttgtttgttttgtcattggaaatgataaagtaaaaaccggttgattacctgtcagaaattgttgagaggattcctactttaagcaagaggttaaactaggtgccctctaaaagtttcttttcaaagattcattgagcccaaacacattttctaattttgctttgaaatccaataaagctaatttaatatccaaaatgaaatactcttataactttgatattttgggtagaggttaacctgcccatctttcctactaataatgtacatcttttttaaagtttgtttttgttttcttcaaatagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctggccacagaatttgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtggataatattgttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgttgtctttcagtttgaaatctttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcattaattttgttgatctttccatttcagtattttgaatgacactctggggaatccaagtttaaatggtgaaatatttttattaaataactttctacatgcatctgtaaacatactttctcaactttattgagctgtttctttcatatttttttttcttttttaaattatttttatagagatggggtcttgcctgggctggtctcaaactcctggcttcaaagccatcctcccgccttggcctcccaaagtgctgggattacaggcatgagccaccatgcccagcccttttttttttcagaggcagggtctttctctgacccccaggctggagtgcagtggcaggatcatagctcactgcagcctccaactctagggctcaagggatcctcccacctcagcctcccaagtagctgggactacaggtgtgcatcatcataactggctaattttaaaaagaaaaattaaaaaaacactttggtaggccaaggcaggaggattgcttgagcccaagagttcaaaaccagcctgggcaacaaagtgggacaccatctctgcaaaaaatacaaaaattagccaagtgtggtggcacgtgcctgtagtcttagctactcagggaggctgaggcaggaggattgcttgagcccaagaggttgaggctgcagcgagctgtgatggcgccactccattctagcctaggcaacagtatgataccctgtctcaagtttaaaaaaaaaaaaaaaaggtgggggggggatcttactatgttgcccagatgatctcaaactcccagcttcaggcagtccttccatctcagtctcccaaagtgttcggattacagccgatagccaccacctggttatactgtgatagaagtacaattggagtagcttaggtaaagatgggaagtaaatagacatgaataaaatgtaaattgcagtgattgcaattaaagaaaaaaccaaatgactgagatgagaaataagtgtagcgattgggagttgggtactacttcagattatcaagaaggtcttacgtatgagatgagtcctaaaaaatgaaaagaagctagcaaagagcaaaaggggaaggagtatttcaggcagagggatggggatatgcaaaggcctaggaaaagagctttggtgaattccaagacgaaaatactactatggctcaccactgggtggaggggatgggggttgctagagagaaggtctagaacagtgctgttcaacagaatattctacaatgatggaagtgttctgtaaatgctgccccccaaaaaatggccaatacaagcttcatgtggcttgtattaaacacttgaaatatagccagtgtgactgagaaactgagttttaaaattttgtcattacttttaaatagctgtatgtggctaatggctaccatttggggtggtgtaggtatatatcttggcaaagccttgtggaatatggaagtgtttcccacagtagagtataaaacaagttctgtatgttctagttactttgcatggcaagtggtactgattgttttagtttactgtggcaatataacatttctttttggaataaatgttaataactaaacaaattaagtagtcagtgtggaaataggacagaaattactggtgctcagataattgaagtttagaatatgtaggctatgtatgaagttggaatttcatttgaaagcaaaagtaataagtaataataaaaggataaaaggcattcaatcacgtcaaaacaggcaagcagaagagaaaaagcaatttagaacaggtgagacaaatagaaaacacacggatgtaagcccaaatgtattcacaaattatgttaaatgaaaacattcagtatccaattaaaagacaaagattatcaaaccacagaaaaacaactacatgttgcttatgagactgacctaaaacatagggagctttaaaagtaaaaggatagaaaaaagacaccatgtaaacatcaagagaaaacgatgttaatgttaatcagttatccctatgtatttcatatgtattgctgtaatgcttgccaaatgccggttttctaattccactgttttttctacacttactggaattcccttatccatttatttctcctttattcacttatttatgtcagtataaactcatagattcctattttatttcatgggttataactcattattgctcaaaatatccatgttttagacttgttaattaacttccgtgtgtatgtgtgacaattccaatatttaatgccaattcagaatctgtttctattgtgtgttgtttctgttggctctttttcatgttttcttccctactcttaggtctggttatctttcactatatgccgaaatcgtgtttgcaaagttgtttgtagaaaaaaagtggaggtctaagatgctgttgtccagacacaagttttttttgcttctggggtcactgtcagactgaaaacatcttaatcctgttttaggaactaagatgatctgaatccccagatgactcgcatcttggctgcagtatatgcatgggcacttgtagctcactgtcattcccagggttcagactttgaggtctagatccaaagtacaagggttcataagagcctccattcttggtggatcccatgtgccagtgttttctgccttccccaagaggacatcataacttatgattggttcctcagtctgttttccagatttttaaatggcatctgggcaaaattgaccccaaatgtcaggttcacccctgcatatctatctcctgaattttggcccaagattttttcatcatcttactggcttttcagtgttcaagcagaatttttaaaataaatgttttgtccagcttctccagttcttagtgtgaagttgttctgaattatctcatctcccattaccagaacagtttaacttttttctttacttccatttcattgcatttctccattttattacctgtactcatttggtttcccacagtgtgtatttttctttttgtataactcctttcctaagctcatattttttctttctgtgatttcatcatctcttccttcttgtttcttgttttgtggactttcttcatggaggcagttgaatcactagattttaatattcatgttgaatttttttttttcttgagatgatgtctctgttgcccaggctggagtgcagtggcataatcatgattcactacaacctccacctcccaggttcaggagtcttcccacttcagctttccaggtagctgggaacacaggcacatgccaccacacccagctaattttttattttaactcttttgtgccaacaaggtctccctatgttgcccaggctggtctcaaactcctgacctcaagcaatccttgactcgtcctcccaaaatgttaggattacaggtgtgagccaccatgcccagcctattcatggtgaaatgttgcagaatgatatccatctgttctgcaaaatttttcagatggtgaatattatctgttaatttttgctaatttctctagtttttttaatatagtatctttgtatcagtcttacggcagttcctttttcttactcaatactgaatgacttgtaatataccattgtttgcaggaaatcagccatggtagccttccagacgtcacacacatgcttcatcttttctgctgatgtcatagaagcatgctggctcatgtaaatagggctccttgtgattgcttgtgtaggtggcccttcctcctctcctcccctgaaccaaaccaggtccaggaggaccttcacagccaatctcgctcttctctgctcctaactgattgttccaaacaagggacatagcttttgcctttcaaggggaaccctcacattcaaaagcggtattttttgctgagatttgctactgcctggtccctctcaactcttactgcacttcctcctttcactgtctcctgacactacttctgctaaatctcagctgttctggcagcccttatgtctattttgacatctgaagattatatcttatctcctagattcactggaaataaactttatggagatttttacagtctttttgttgcttttatacaatttatagaagaaaaacagatttatgcagcatgtccctactaaatttctttccaagctaaaattcaatccaaaagtcactttaatcctcagcttggatagttccatcgggatgcattcttaggtgaacacctataatggattaatacttgggattatggtatcaatataaaccaaacacataaatgtgatttacaaaataaaggttatttgatgttatcctggtaggtaggaatcatattctctctttagtcacatttcctttacaataaatatatcacgtggctacctctaaaagcaaaggagactggcatattgagcatttcacttttctagcccccttactagaaatgaccagaaaggatgagggttgggttataggtgttagctttgccaaccaaccaatagtgttttccataacttcaggagaaacataagtaaggagaaataatggtacccgttaaggcctgttgatgccaacttcataaaactaaatagtccagaacccagaacaagttctgattctaactctgccacaaactggcagaatgaccctgagcaagccattgtactttggcttcctcatctaccaagtaagcaggtggtagagaatcctaggatttaaacagaaagctgacatacgatagctcagagacatgtcaaatgtgtgttcgtttccttgtcaggagctgagagcatcgtttagagtatagggtaggaaaatgtctcattgtttagtagcaagaggaataggacagtattttgactaaggaaatcctctaatgcttctcaaacccttctgtatcacagacaaattttaatgcagggtaggatttctaggtcaggattttctcctgatgctaacacagagtgtatatgtgtgtgtataaaattatgggcccctctccttgaatgtggactgaacttgaccaacttctaatgagtggaatgtggtaaaggcaaaagtatgtggcttgagagtgtaggtggtggcttgtttcttggaatattcattctggggaatgctcagatgctaggtcatgaaaacatttcaagccaccctgaggagttcatgtagtgagaggccaaggcctcctgccaacagtcgtgtgaattggctgtcttggatcctccaagccctagttaggccttctttagcttagtttttttgttctttttctttttttttttaactggatttgttcctttatcagaaaaggtaaggaatatgacttttttttttttttttgagatggaatcttgctctgttgcccaggctggagtgcagcgacactatctcggctcactgcaacctctgcctcctgggttcaagagattctcccacctcagcctcccaagtagccgggactacaggtgcccaccaccatgcccagctaatttttgtatttttagtagagatggggtttcaccatgttggccaggctggtctcaaactcctgacctcagatgatctgtccgctttggcctctcaaagtgctgggattacaggcgtgagccactgcacccagccgggatatgacatttaaatcacacttttttttaaacgtttgtctgtttatgtaaacgctttaaaataaactgaatctgaaggatagctgagacctgaagactcctggactataacttgagcatttcccattgtgcatcctatataaactcttaactggcagcagaattctatatccaagaaaactgagtcaaataacaaaagtctactcaaatgagataaacatgaaaattgctgtataaactgtgaagtactatataatgcaagatatctgtggccgtcatttccatcttaccagttctttgtagagaagtagtatgggctgaatcgtgccccccaaattcatttgttaaagtcctaacccttatctcagaagttaactgtatttggagacaaagtctttgaagaagtgactaagttaaaatgagcccattagggtggaccctaaagaatgtgactggtgtcctaataagaaaaggaagagctatgaggggcatgctgtgcaccgagggatgagcacatgaagaagcagcagcaagagggctgctacctgcaagccaaggagagaggcctcagaagaaaccaaccctgctgagaccttgatctcggacttctagcctccagaactgtgagaaaataaatttctgttgtttaagccacctggtctgtggtatcttgttaaggaagctctagcaaattaatacagtctgcttccagtgctaccacttctccaatttgtatattcccacagccacagttcaagtataggtttgcatcattttcttttaaacactcccaaaatgagatttttattaagcattataaattgcatttagttgcctttaactatatggccacaatctatctacaattaatttaacccaacagtagttcattcttgcatgacaaatgagttagggcaaatgagttagggcaaaatgccttccatttttacaggatacctccttagcacatgcaggcaggaagcagggaattacatcttatttctgatccctaaagtgtgataaaaagcatcagaattgtatgaaacgaatatgagtaataattctgattgtaaagtacattgtttggaaactaataaaaggcatcaaaatgatgcaaaaaatcagttaatattgaagatatagatggatagatagatgattggtagatgattgatgatagatagatgatagatagatagacagatagatagagctcatcatttcttcatttggaccattcagcagcctcttagctgttgcttactacctggacaccttcagcccccttcttcctaatttgtcctctaccctgcacccggaataatatctctaaattatccaaaaatacagatatgatcaacctggtttctggctgtggcattgccactgtcaagttatatacatttaaggcaatcaacctctgtgagtgtcactttcccaatttataaattaaggcgattgggttgtaccttaagtttccatgactttctttgtcactcctctgcttaacagtctggatgtttcatattttccatggaacaaagtccaaacacaccactcttcacaatctcaccccaaaatggaccttctaaccacatcttcctcccaggatgacttatctgcttcctacacccaatagaccttcacggctccgtgtgcttgtcttctgtgagactttgagtatcttaggtattgcatcttatgcaccttcctgtccagtgtagggcacgctgcccggcataccagtagtttctttaaaaatgtttctttaaaaatgttggctgtttcttcctcccccttgaatactgactgacccctgctgaccatccctccaatacctccttcacctattaagtttgtgtttatccttccgatacattcttcgcactttttcaatgaaacctttctcttcccattccaaattaactgttctctccacactttgtttttgtctgttataacatgcctctacagtacattggactattacagtctctacgatatcacatctcctaaattaggactctagttggttgtataggtgtcagcctattttccatattattggtaaaagataagcattggcatattaaaatttagagtttatttaagcaaacggtgattcctgaatcaggcagttccaaaccataagtggttggggcaccacctgaggtggttgcattgaaagcttctagagggccagtgcagacactgaacaaagacgtgttttgattggttaagtttgagcaattaccttattggaactatcccagtgggaagctcaagacaatgtaactaaatgccagttagctgcctgtgattggctgaacctatatttcatttccttttaaattctgagttagaggctgggcgtggtggcttatgcctgcaatctcagcactttgggaggccaaggtgggtggatcacctgaggtcaagagttcgagaccagcctggccaacatggctaaaccccgtctctactaaaaatacataaaattagccgggcgtggtggcaggtgcctgtaatcccagctactcgagagactgaggcaggagaattgcttgaacccaggaaggggaggttgtagtgagccaagattgtaccattgcactccagcctgggcaacagaacaaaaactctctcaccaaaaaaaaaaaaaaaaaaaaaaatattctgagttaggtttcagtttgctcacttagcaacccagggcactggagccgccttagtctaacagcctcccatgtagttatttgaacaggataatccacatgaattcaggagccatttctaattgatctttttagtccccactcctacgctgctccagtgaacagctttttcacttgaaaacggggaacgctcaaatgttccctaaatcaagttgaagtaaaatttgtctactatgtcataaaatttacggcatattttttcctttggatttattcctttaactaagggcagaggaagtttgtgatggaattaataaaattgatcaggttctagctgaatccacttcaagctttcattctttcaggatagctattttttcatattaagatgtaaatataggtattaaaaatttcttagccctcattaatttttactttcttatgcctagacttcagttctctgcatcatttttccatgacaattaagtttcatctgtagtgatgggggaaaaaaaagaacaaaataattaaaagcaaaaaaaattatttttaaattaaaactataatacagtttttacatctgcggctgtgattgcagctcgactgttagcttctttcttgctgtttcatatcctccacggacacacaccaattgctttcctctgcactgctgtctccagcacaatatttatgaatttattataactgttacaaatcaaggccgattgaaggcagcaatcagcttcgtcaaaatttttactatggttaaccagctgcctgggacattcaccatcacaggttcaccttcagaaagttaacttgcaaacctgttatcaaccactgataagcactgttagagggatgattgcttaattaatctgtgttttgcgctaatgacgatgttaaatgggttcatccctgaatttgattgttcacaaagaatgtgaattccctaaagggcaaatatagacaggtttcctattaaaatgaaccatccaaccaagaagctcttttagtcattttgaagtttaaaagggtagctgataatttcaatataacttcatgacatttctagtggctacatgtgacatattattaccatatctcctgaagctctttgccagttcctttgggaaagaattttatattacatttcttaaatagataccggcttttattttcgatcaagactcctcagggtgcagcataaattaaacttgtggcacttatctttcacaagcagactttggaggggatgggaaatagcagacgccaatagcatcatcattcagtcaaaaatccattatgttaaaaaacattccatatacgggctgggcacggttatgcatgcctgtagtcccagctatttggaaggctgaggtgggagaatcacttgagcccaggaatttgaggctacaatgagctatgatggtgccgctgcaccccagcctaagtgacagaacaagattttgtctctaaaataaataaataaattcatccaaaatgcaatgtaattaaaccagaggaagatcgtgttggatgggggagttgcatgtgtgtgtttaaagttagggaacttctgtttactttgcagtggcctatcgtggcattcagggagagactataacccagacctccgttgattatggcttgcactggcattccgtggatactggtaactagctgatccctagcatgtgccccagggtctctttaccatcttcctttcctggtgaaatatcagacagaccaaatatttacaaaaacatagagggactctgttgcttgggtgagggtacatgcaagcaaggaaactttatggttcacttggtgaaaaggaagagtggattttcctgctctttgagaaactgagtctgggcttccttccattccttaagcccaggttaggcagagatgcctgttttcagagtgactgataactacgagccatggataccgttcttctgtctccctgacacccactccaaaaactgtgtggaaatttctttctttcctctttatctctctgtgtgggaagaaaaaattcctttgtttatgatatacaggatgagtaggaggcattttcttgatcttgaatgtgttttgtatgcataaattgaaagttacttcagttatgaaaatgtttttttcctgctgttggtgcataatattgagtaagcctttttggtattttaactgtgagaacagcttaagtactacgaattgaaatgaacctgctgagtataagtagtaactgactttaatgactttaacaacaggttcataaaacacattaagatataagtttaaataatgaactctctgaaatctaagtacatacaaatttacatggtagatgagctgctttaagacttattcagttggacacagttttaaacattgaaaattgtgaactaaaaacatctatattgaatcaaaaagacttcaacctaatcttatccataagtaggctgaaataatattttatttgaatgaaaatcccaaatgcccagggtttttttcataacactgaaatgtaattcattactttatttcgtagctcagatattattgtcctatacatgatgcagttgtttgtcctagaggcatgccctgtctaatacttagcactgtggtatattaaaatagattgggtaaatgaaaattaactactggtatcagttggctagctagggatgtcattctgttttacattcctatttttatagtcattatataattatcaatattcagctaatgatattgaactttccctgagtctcacacttttgtgttgcaaaagtggcttactgcaaagaaccacccttccccatatgacttagataagacatgtggacttaacgactttgtttatctgtgataaggccagacctggatcctccaaattctcattttgtcttagtccactttatgttgctataaaaaagttaatacagactgggtaatttataatgaacagaaatgtatttgactccaagttctggaagccgggaagtccaggagcatggtgccaacatctagcaaggatcttcatgctgtgtcatcccatggcagaaagtggaagggcaaaagagcataagagtgagcaaaagaggaaaaggactaaagtcatccttttttttcttcaagaattcacttcttcaatgacctattctctcaataacagcattaatccgtttacgagggctaagccgttatgatctaatcacttcttacaggtcccacctctcaacactgttgcattgaagattaagtttccaacacatgaactttggggggtcaaaatcaaaccatggaatgctctttttctcacaaatgatttgctgaacggtttgccccactgaccaatatggattaaatacccattgacttgatgtgataaaattttaatcaagtctccccactccccagaagctcctggatcttgacccacccatgagcttaaagaacaaggaacaacccttccttgacttcccctcctgagaatcagctgattacaagacaagatacttcctaaccagctgtgccatcacaccatccattctatgtcccatcacaccatccattctaagtccccacatctgtcctctcttgcttgtgaaagaaaagccctctttgcttgacttttgatgcttcaggtcatatggtcagagtgttcttcctattgcaacagttccttcccttatagcaaaaatctcctctttttgaaaaaagtctccccttacctaggcctggatttattttaattgacatggtttagggtttaaaaatagaattcaggtgatgattatccagagactctgaccaacatttgctgtaaaatgtagcatgtctgcaagtgatatccacgtttgtgtgatatatcttttatcaatgtagaactttacacttcacaaagcccttgtgcccacattatcagattttaatccttattatgaactggagtgaaccatgagggagaacttcctgatacaa

SEQ ID NO: 1786 - DNA, 71765 bp, Homo sapiens
  ARG2 gene - 67156409 - 67188173 of chr14; NCBI Entrez Gene ID: 384; Build 35; sequence includes 20,000 bases upstream of initiation codon and 20,000 bases downstream of termination codon of the gene
gtccgggctcgaccaaagaccccaaagaccctcccaaagccgaaccccctccttcgagcgcggggaggggccgacttgccattacctcgcagagggtgaagagtccgtaggccgccagccacaccgtgcaggtgacagcggtgagcgaacgcagcgagagccgagggcagctgaggcagaattcccggcaggacggggagtagtagcggcgctgcagcgccaggcggccgccgcagatatccgaaaagctccgctcatcctccatgacgcccccactcggccgcccgcaccgcgcggcgctgcactgcgctcgccggccctggccgtctcgcccgctccagacccgcttccggcagccgcgtcaccacgccccgccctaagcctgcgcagcctcagttgcgcgccgagagctctgctgggggctgatggttgtgcgttcttccgggccggccttgactgtcttcgaaaaaacctcgtcggggcaatagttaagtggaaagattaaaatcgtttttagaccgggcgcgttgactcaggcctgtagtccagcactgggaggccaaggcgggaggatcgcttgagcctgggaggtcgaggttgcagtgagcggagatcatgcccctgctctctagcctgtgcgagagagcaagaccctgtctcaaaacaaacccacagtttgtttttgttttgagacggaatggcgcgacgtcggctcactgcaacctgcttcccccgggttcaagcgattctcctgcctaagcctcctgagtagctgggattacaggcgcgcgccaccacgccctgctgatttttgtatttttagtagagacaggtttcaccatgttggccaggttggtctcaaactcctgacctcaggtgattcgcccgcctcggcctcccgaagtgctgggattacaggcgtgagccaccgcacccagcccaaacccacagttttaatcatgcttttgcttggcaagccgatttctctaagccagagtgagccgcaaggagagcccacgggtattcatttcacttactcttttcctgtgccgggtagtttgaggtgcttgaggatgcagcagtgaacgatgttgatgacagtctctgccctcgggcagcttcctttctagtaggagacaatatggaaataagagagtatcgttggcaatactatgctgactggcagggatggactgaggactttacatagggcagtcaggcgaagtctctaagtaagaggacactgagttacaagggtgacgagccagacaggactgaaggagctctggaggaggaatttgccagaaagaaagaccaggaaaggcaaacccctcgaagttggaacaagcttggcttaatgaaataatcaaaaggcgagaaaggttggtgtgtggggaaaacagttggaagctggggaggcaggtaggggtcagatccaagagggtcttgtagggtctggtaaggagtttggatttcactgcctgggagttctgtctcccaaatgactgcttggaccgtggtagacaggcaagacctggctgggaattaagcaggagcgggagatgcagaagaaatggataataaaattactaaactcatgagtaatagtggcctatgagttccatttttacttctgatgtggcccaggagtggctatgtggactgtcaaaacacttgtgatgggctgggcatggtggcacatgcctgtaatctcagcactttgggaggctgaggagggcagatcacttgggtcaggagttcaagatcagcctggccaacatggtgaaaccatctctactaaaaatacaaaaaaattacctgggcatggtggagcatgcctgtaatcccagctgttcgggtggctgaggcaggagaatcacttgaacttaggagttcaagaccagcctgggcaacagagcaagactgtgtctatattcatttaaaaaaaaaaaaagatccatggcataaaggtctcaccagctttaagtctctctgatgaaaggttccgtttcttcatcttcattcagaattttatttccctttcttttttcctaaaggatttcttcaagcacttctttatttttctagttttatttctgtgccccgaatctgacaattaatacactccttttattagtccgttttcacactgctataaagaactacctgagactcggtaatttataaagaaaagaggtttattgactcacagttccacatggctggcaaggcctcaggaaacttacaataatggtggaaggcaaaggggaagccaggcatgtcttacatggcagcaggaggggagtggggaagtgccacatttttaaaccgtcagatctcgtgagagaactcactcagcatcacgagaccagcatgggggaaatccgtccccatgatccaatcacctcccactgggtccctcccctaacaagtggagattacaatttgacatgagatttgggtaggcacagagagccgaaccatatcaccccttttactattgcatatatcatgtgttttataattataaaagtgatatttgcttattgtggaaaatttgaaaaatacagaaaagaaaaaaatgtaaaccacccatatttccatcactcagagataagtactgttaatgttttggggaagcctgtagtcctggagttcttaacttgggctccacggatagaatcagtgtttcatttttagtttcattaacttctaattaaaatttaacatttcttttgattatgaatatgggcaacaaactagtattagtagagcttgtgatttttgtcactgacagaaatcacagatattttcttttcacaataattgtttcaaaatgtcatttctagtcattgctacttcaaaattgcagtaattattaaacccatcactagctattattatttaatgtgtcaataaagagaaacatatcactgtaacacatttttaaaatattttgataaccatattttaatttagttgattttcttagaagtcctatgtatttatacattttaaagcattattataataaagggtccattcatttcgccaaacttccagagggtctacaatacaaaaggtacctgtacaggctaagaagtttcttttctttttctttctttctggtttgttttgttttgtttgaggcaaggtcttgctctgtcaccgaaagcggagtgcagcagtggtacggtcatggctcactgcagtctcaacttcctgggctaaagagatcctcccacctcagcccctcaagtatctagggctacaggcacactctaccacatcaggctaatttttgcatattttgtagaaatggcatctcactatgtttcccaggctattttcaaactcctaggctcgggtgatccttcggcctcagcctcccaaagagttgggattacaggcatgagtcaccatgcccagcaggctaagaagtttcacaattatagagttatagaaagaaaaaggccaaatgtactttacttaattttttaaaaatactcaattattaggaataaatactgtggtagtctaagatctctaaaatcctttttctttttagagagagggtgttgctctgttactcaggctgcagtgcagtggtataatcataactcattgtgaccttgaatgcctgggttgaagcgttcctgttgccttggcctcctaaagtgctgggattgcaggcatgagccactgcacccagtcactaaaatccttattactgctttgtgggttgtttgtttgtttgagacggagttttgctcttgttacccaggctggagtgcaatggcacaatcttggctcaccacaacctccgcattccaggttcaagcgattctcctgctgaggtcagcctcccaagtagctgggattacaggcatgcgccaccatgcccagctaattttgtatttttagtagagatggggtttctccatgttggtcaggctggtctcaaactcctgacctcaggtgatctgcccgcctcaacctctcaaagtgctgggattataggcgtgagccaccgctcccagccctgcccttgttttttgtttttgttttttttttgagacagtcttgctctgtcgcctaggcaagagtgcagtagcacaatctctactcactgcaacttccacctcctgggttcaagcgattcttgtgcctcagcctcccaagtagctgggattacaggcgcaaaggttttagctttcttactgggatggataggcaaagaatgtctgttccatctttcagaaatggaagtctcctcatctgtccatttaaggaaatgttttaattgaggtatatcctccaagcagtaaaacagtctgtgacttacttttccatactctaatggtgtcttttgatgaacagaggttttaattttcataaagtccaatttatcaatcttgtcttttatggctagtgttgtataatattttgtcctgtttaggaagctttgcctgtcttgcgggcatggtggctcatgcctataatcccagcactttgagaggctgagccaggaagatcgtttgagctcaggagttccagaacatgctgggcaacatagcgagactctgactctaccaaacaaaaaacaaaaaacaaaaagctgggcatggtggcacagctactaggtactagggaggctgaggcagaagggttgcttgagcccagtaagcccagcttactgtaggaggctacaaaaagctgtgatcaagccactgcattccagcctgggtaacagagcgagaaaaaacaaacaaaacaacaacaacaaaaaaaactttgcctatcttttttttccctagaagcttaattattttacctttcatatttaagccaatgatccattttgaactaatttttgtttgtagaggttaagggtcattttgtttcccagcagcacgtgttgaaaagactacccttcccccctaattgagatagtgcctttgttgtaaataggtgaccacaaatttctcggtctatttccacactctctattatgttctgttgttctattttgtcttcccttgtgctaatagcaacctgtctcaattactgtagctctacagtaggtcttgatttctcatactgttaagtctttcaactttataccttttcttcaaaattgtattggctattatagggtttttgtattttcaccaaaaattttgcttggattgtactgaatctatcaatcaatctaagggagaattgacatcttaactatgccgcatgttccaatccatgaacctggcatctctccatttattgaagtcttctctaatttctctcagcaatgcttaacaattatttgcacatctttcattagacctcatttgtaggtatttgatgttttctgatattctcataaatgatgtacattaaaaatttattaactctccctttttatttatttatttttagagacaccatctcactctgtcacccaggctagagtccattggcacaaatatcagctcactataacttcaaattcctgggctcaaggtattctcccaccttggcctcccaaagtgctgggcttacaggcatgagctattgtacccagccttgccactctctttttagtaagatgtgtttggtatttacctaacatcaaattgaaattttatagaacaaaatacatccataatcctgccacctaagtatttcctctttacaaaagctcctatgtcatataaaatttatattaaataaatttatatgcttctctcatattaatttttttttatacatagtctcgctttgttacctaggctggagtgcagtggtgcaatcttggctcactgcaacctctgcctcctgggatcaagcaatcctcctgcctcagcctccccagtagttgggaccacaggtgcgcacccccatgtctggctaatttttatatttgtagtagagacgaggttttaccatgttgcccaggccggtctcaagcaacctgccagtctcaagcaacctgcctgcctcggcctcctaaagtgctgggattacaggtgtgagccaccgtacctagcttattagtatatattttgtatactttttctcatgttaatgtgtgctttgttgtcagccattaacctagcaatggaaagaaaaaatacttatttttccccgacattaatctaccatagtttacttactgtcaccctgttgttctcatagccagtgaaaatggctagtaattgtttcaagtaaggaagaatgacagtgggaaaaaaatagaagaaatgaaacatgaaagaaatctattggcagaatctgatacagcgcagaaagtagtggtttttttcatggagtcacttctccatcttgtggatttctagaacagtagagcttaatattttcaacttaagtctaggaacacacctggcttttatgtggaatgtttctcttcccttgtaatatcaggatactttttgttcttgtgcactaaaggttttttaatgtaataagccaagcttgtgagaaagtttagataaaagatggatctaatttgatgggcataggttttacaaatagattcaattagaccataacaccctcagctcagttttattattttgatcaagccacagctgtgtaggcttggaaataagttacctttatgtaactatttttttatgaagatttcaaaggaaaggtaaaaaagccctggtttttgttgttgttgttttttgttttgtttttgttttgagacggagttttgctcttgttgcccagactggagtgcagtggcgtgatctcagctcactgtgacctctgccttctggtttcaagcgattctcctgcctcagcctcccaagtagctgggactacaggcacgtgccaccatgtccagctaattttttgtatttttagtagagatggagtttcaccatctttgccaggatagtctcgatctcttgacctcgtgatctgcccacctcggcctcccaaagtgctgggattacaggcgtgagccaccctgcccggccaagagccctggtttttaaaaagcctgatatattcaaaatgtgagaggtaaaccagcagcagtggctgggtgcttcttcaaaatacagattcttgggtctcacaccaaacctacagactcagaatctcagttttagcaagattctcaggtgatactcttagacattaaaatttgagaagtatatatataactcttaattaagaattgagaagtatataactcttaattgagtaagtatataacttgagtaagtatataactcttaattaagatataactcttaatactggattctctaccctgctgcatagtacaaccagctggcaagctcttaaaaaccactacacctgggtccatcccaggtaattaaatcagaatgggcagtgtgggaaggagaacatgaacatgagctttgtttgtttgtttttgtttttgttttttgagatggagtcttgctctgtcaccaggctggagtccagtggcgcgatctcggctcactgcaacctctgcctcccaggttcaagagattctcctacctcagcctcccaaggagctaggactacagacgcatgccaccggggccagttaatgtttgtatttttagtagagatggggtttcaccatgttggccaggatggtcttgatctcttgacttcgtgatctgcccgcctcggcctcccaaagtgctgggattacaggcgtgagccaccacgcccggcctggacgtgagtatttttaaaaagctcccaagttatttttagggagctgccagagttgagcactcttgggaggatatctttccctctgccatcccaggctctaaagttagaggcctgtaaattaactgacaatagactttaatagaagaaaatgttaatttacctactggggtgttgtgtagtacaatgtaactctctgaatagccagagatagaggtatccagtagggcctttgtatttgtggattctgcatccatgaattcaaccaaccaagggtggaaaatattcagagagctggtttggtggctcacgcctgtaatctcagcactttgggaggctgagacaggaggattccttgagcccgagagtttgagaccagcctgggcaacaaagtgaaacccctgtctctacaaaaaaaaaaatcaaaaaaattagccaggtgttgtggcacgtgcctactgtcccagctacacgggaggctgaggcagcaggatcccttgagcccaggatgtcaaggctgcagtgagccatgttcatgccactgcactccagcctgggtgagaccctgtctcgaaaaaaaaagaaaaagagaaaaaataatgtctgtactgaactcgcgtagacttttttcttgccatcattccctaatcaatacaggataatggctatttacatataatttacattgtattaggtataagaagtaatctagagatgctttaaggtatacaggaggattgcataggctatatgcaaacacgatgccattttataccaggaacttaagcgtctgtagattttggtatctgagggaggtcctggaaccaatcccccactaatacagagggacaactgtatataccaccttaaacaaaaggagggaggcttagggcttcagtgggaatgtgtggaaggttctattgtgttttttgatgccgaatgaatctgaattaggactttctggtgctaagcctcagtcttttcccaatcaagaaacttcctcccaggaaacctcagaaatttatttgtcacagtcctggaggctgggaagtccaggatcatgttgcctgcagatttggtgtctggtgatagcctgtttcacagatgacatattcttgttgtgtcctcacatggtacaaggggcaaggcagctctctgggcagttttttacaagagaactgaatagaaaacaacaaaacaaaacacaaacagtttgattctcctgttgtttctcacaacacagaaaacttctgtgaccaagcgtatggggggctttccccatacaccaagaaagcagttcgacactatccacctggaagtcacgtcagatcctacagaacttgtcaacaactcagtcccacaaaagtgcccctgacttgagacatcaattgcaagtccgagcttctggaacttcccaccaaccagctattaattggcattcccatgaagctccttttgggttcaggtaattttgtataaactctgtctttgctgcaactcccactgttctcggtgtctttttgcagggcagcaggcaagaagaatctgtcaggctgtgacatctgtgccacttgctcataaaggctcacagaactcaggggaatacttacgcttactggtttattataacgcatattttaaaggatacaaatgaataaccagatgaagaggtacatggaagtctgggaaggtcctgagctcaggcgcttttgtcccatggagttggggtgcaccgccttccctgtaccccatatgtggaagtcccctgaactcagtccttttgggtttatacagaggcttcattatgtagggctgattgattaaatcactggccattggtggccaactcaaccttcagcccctcttccccttcctgaagatgtgtgtgtgttgggggtggggcaggggtatgaatttcaagtccctgagcacatggttgcttctcctggcccctaatcctgtggttacctagggactttacaaaactcacctccttaacataaattcagatgtggttgaaaggggctcattataaataacaagagcctttcacctttattgctccagagctgtttcagcaaccaaggacaaaaggccaatttaacaaaacatattcttgaagagaagaaggggaagggggtggggatccgctaggggctggcactaaagggactggtagctccagctttcagaggagaggagtttcttggccctggagaaagggcgagtctgcacaaggctcctgtcctggaaacgctgtgagattgagagggacaggcttccctgatgagcccagtcccttcctttcaaccttgggagggatgaagggaatgagaggaggagaagggccaacggagaaggcagaatggctagtcaagggccgtttgtgtcctgcttctccccagggctgcctccactcctgtggctgcttcgagggttgccagcggcggggcagaggcgccagtctatggtccggcaccaggctgttaaatgcctattcaaggatccacattccctgagaaaccacctttgcagaattttaagtaatgaaatataacatgactgactccattttgctactagtcttgcaagctaaattggttgggggtttttgttgttttttgtttttgttgtgtatattctagtgcagaggccaagataactataagaggaatttagtttatagctaaactttgaggcaaggagaactgacgcccctccttgttcggagatcgaagccacattcatatgacatggttacaattatggtaggggcttgaactttgctgaagaattgtggtaggggcttgaacatagttaaagaatgagctgctgttgcttcctctgttttctgtaagttgcttactgccccaaagtcatgtaatgggggtctcaagattgataacttcctcaactactcctatagatgacctcactattatgaaacctagagacctggtcttggagatccttttcagatttagcatttcagtagatcaagagaggccccctggtcctgacatcacccacacttcctgggaactgactcagctgtgttaagacagttttagaggcccctgtgattctatccccagccaatcgtttcagttccccagctccctgcctaccaaagtacccttaaaaaaccctagcctccaaattcttggagagaggggtttgagaaatttctccctgttctcctcacttggcttgaccctgcaattattaattaaattatttctttgctacaacttctgcggttctcgatggtttttttcagggcagcaggcaagaagaacccatcaggctgtgatacctgtgccacttgctcatgaagggccaccagctgctggagccgtacctgatggtgagtgtgaacgaggtgcacgtgggccagaccagcaccaatggaggaccaccaaacccatgtacaatgaggagctctagactaacgccactgatggcggccgtcatccataagatgcccctgggctatgaccacttcatgtaaacgtgtatgctgtaattaattctttctttctttctctctctctttctttttctttctttcctttccctccctccctctctctctctttctttcttttctttcttgagatggagtctcactctgtctcccaggctggagtgcagtggtgccatctcggcttactgcaacctccacctcccaggttcaagtgattctccagcctcagcctcccgagtagttgggactacagccaccacatctggctaattttttggttttttttttgtatttttagtagagatggggtttcaccgtattgggcaggctggtctcgaactcctgacctcaggtgatccacctgcctcagcctcccaaagggctgggattacaggtgtgagccaccatgcctggccacatgtaccctgtaattgtatcactggtaaactgagttctttccctactttgtatcggttgcaaagaaaaaacaaccaattggaaaaacaaaaggcaagcaggttttatctctggccaacaatagagagctcttgctctaaagcaatgttccccaacctttttggcagcaggaaccagtttcatggaagacaatttttccacagaccagggtggggggatggttttgggatgacttaagtgcattacatttatcgtgtactttattgctattattattacattgtaatatataatgaaataattatacaactctccataatgtagaatcagtgggagccctaagcttgttttcctgcaactaaacggtcccatccatgggtgatgggagacagtgacagatcatcaggcattaaattctcataaggagcatgcagcctagatccctcacatgcatagttcacaatagggtccacactcctaggacaatctaatgccactgctgatctgacaggaggtggagctcaggtagtaatgccagcaatggggagtagctgtaaatacaggtgaagcttcactcgcttgcttgcccacctgctactcacctcctgctgtgcaacttggttcctaacaggccacaggccagtaccagtgaatggcccaggggttggggacccctgctctaaagaccccttctcccagagccataggaagctggggaattttatggagttagatgagggaaggggaggtatgtaaatatgtgctgggagcccaagatcataaacatgcatcttcatactatgcatgttcagaaaatggtgggcattttcttctatgggtgggattttgatattgtaatgatatcttaatgatctaaaggtaacaaggagcttccggttctggttggcaccagttttgcaccagccttatcttcctctggtaattgacgaagggttctgaagctcctgtggcttctcaggtcatctggtgttcttttaagcaaggtacctatagataaaaagactagaaaaacactgtttaagaaaaaataatgagctttcacagctgtttatggtttaagaaaataggctgggtgcggtagctcacgcctgtaatcccagcactttgggaggccaaggtgggcagataactggaggccaggagttcgaaaccagcctggccaatgtggtgagaccctccccatctctactaaaaatacaaaaaaaaattagccaggggtggtggctggcacctgtaatcccagctactccggaggctgaggcacaagactctcttgaaccagggaggtggaggtcacagtgagccgagatcgcaccactgcacgcctgggcgactgagggagactctgtctcaaaaaaaaaaaagaaagaaaatagtgagctttcccagctatatttctagggctgccctggtaacaactccagtgtggactaaaaggaagaagctgaggcaaaattaatataactagagaatttatttgggccaagcttgaggattgcaatacaggagcatagattcaaaagattgctctgagctatttttttgtttttttttttcactgggagtggctgtgcactgccggcatggccaacaccttgagcaccttccaaggctaggtgaatctgcagccagagaggaaagcatttgtggtaataaccctaatagtgcaagacatggtgggtcaagcctgttatcccaggtacttaggaggctgaggtgagaggattatctgcgactaggagttcaagaccagcctgagcaatatggtgagatcctgtctctaaaataaaaattagccaggagtgggggtgcagtcctgtggttccagctatttggaaggctgaggtggaggatttcttgagccaggagttcaaggctgcagtaagctatgatcgtaccactgcactccagctcaagtgacagaacgagaccatgtctccaaacccaacccctccccaccaataaaacagatcaatggaaacaagattattctcacatacctgaggcagcccacctactgctcttactgcaggaagtttatctggggagtatttgggaaacagggttatcaatgccaagtgtgcacatgtgttacccataaacactgccatcatctaaccattacagcctgtatttgccaaaacaatattaaccaagaagattcaaagattgccaaacagaggttcagaatcaacatctcacacaacttcagcatccacaactacaaatcactaccgctttgcaatcactgtggcgccttgctttgggggataatgggtcttcatttctgaaggctctagtgtcaggtaaaactttgatgaaataaatttgttataattttcttttggttttgttttcttttttgagacagggtctctctctgtcacccaggctagagtgcagtggcatgatcacagttcactgcagccccgacctcttgggctcaagggatcctcctggctcctgtttcctgagtagctgggtctacgggtacacaccaccacacccagctaattttgtttattttttgtagagacagggtcttgctatgttgtctaggctggtcctgaactcctgggctcaagcaatcttcctgccttggcctcctgaagtgctagcattataggcatgagccactgcacctggttcttttctctcttgttaatctgtcatttgctataggagtggtggctgttccttacgatggatgaggaaaggtatcacacttttctgccactacactgcctttgagaatttgtagtttacccttctctgagttcccttggatttgcagtaaacaatggtatgctagagcctgctcttagcagcttgcaatttttaggaattttgtgagccagttgtcgaacacaaccttcattaagaatcagattacagtctgggtatggtggctcatgcctgtaatctcagttttgggaggctgaggcaaggaggatcgcttgagcccaggagtttaagaccagtctaggcagcataatgagaacccatctctccaaaaaaaaaaaatttgctgggtatggtggcacgcacctgtagttccagctagtcaggaggctgaggtgggaggattgcttgagtccaggaggtcaaggttgctgtgagctatgattgtgccactgtactccagcctgtaataatttaattacataaattatattaaaaccaaagataatatagactccagacttatcactgcctaattattttactatgtcttcctattatttatgtccttgaggttttttttttttgtgttgattgtatctgtatggtagaaatactgtataaatgagcacctcttcacaactccatgttcagtgacatcacaatgggagctcataaataagaaagtatttacaccccagaaatcagcaaacctgacaattgtgtcttacttattcccactccctcacagttccccaccccacaactcccagcaacctattaagggatagagtgtgtgttggcagccacatgattaaaggaaagaggccaaatctctagatcctcctacaaaggaagaagaaaaatagagcaagctggtttgaacctgagaaggggtcctagagctatgcactaacagggtacaagttttaaagtaaatttttaaacttaactcattctttatgactttagaattttatttttgaaaacagatttttaaattaaatgccggttctgaaaataaaagcaggtattcattttcaactttggggtttgttttttgttttgctttgagttgctgttttatgaactttggggttttaaaaatgaattataggcagtacattgagctccataaagacagtgccggggcaagtgagagccggatgggccctaggcaactctgtgcctcgctgaggaaaaataactagacataggcaaaggagatcttaaaaagccaagaggcaaaatgccatcgtatgtattttgtgtgcaaacttgtccggaggagcgtaagaagaaacacccagatgcttcagtcaacttctcagagttttctaagaagtgcttagtgagggggaagaccatgtctgctaaagagaaaggacaatttgaagctatggcaagggcagacaaggcccgttacgaaagagaaatgaaaacatatatccctcctaaaggggagacaaaaaaagtttaaggatcccaatgcaccccagaggtctccttcagcctttttcttgttctgttctgcgtgtggcccaaaagtcaaaagagaacattctggcctgtccattggtgattcggcgaagaaactgggagggatgtggaataacactgctgcagatgacaagcagccttaaaaagaagtctgcaaagctgaaggaaaaatacagaaaggatactgctacatattgagctaaaggaaagtctgatgcagccaaaaagggagttgttgaggctgaaaaaagcaagaaaaagaaagaagaggaagaagagggagagaatgaggaggaggaaaatgaagaagatggtgatgatgaataagttcgagtgcagttttttttcttgtcactaaagcatttaacccccctgtacacaactcactccttttaaagacaaaaaaaatttgaaatgtaagacttgtttttaaactgtacactgtctttttttttttttgtacagttaacacactaccaaatgtgtcattggatagccctgtcctggtgatttttttaatagcctccatactgtaccttgtttggtacactgtgggggctgtaaattgacatggaaatttaaagcaggttttcgttggtgcacagcacaaattagttatatatgggatggtagctttacatcttcagttgtctctgatgcagcttatatgaaataattgttgttctgttaactgaatactctgtaattgcaaaaaaaaaaaaagttgcagctgtttgttgacattctgaatgcttctaagtacatacaattattattattattgttgtccttttaaaaatgaactataaactatttcagacatggaataaataataatttgaattgttaaagataataggactacaggttgagtattccttatcctaaatgcttgggatcaggagtgtttcagattttttttttttttaaatatttgcatatacatatgagatatcttgggaatgggatgcaactttaaacatgaaacttacttatgttcatatacacctcatacacatatcctgaaggtgattttatattttaaataattttgttcatgaaacaaagttttgactgcattcttttatttctatttttatttttatttatttatttttttcgagatggggtcctcactctgtcacccaggctagagtgcagtggtgcaatctcggctcactgcaacctccacctccctggttcaagcaattgccctgcctcagcctcctgagtagctgggattacaggtgcacgccaccacgcctggctaattttattgtgtttttagtagagacggggtttcaccatgttggccagactggtctcaaactcctgacctcaggcaatccacccacctcggcctcccaaagtgctgggattacaggcgtgagccaccgtacctggccctatttttattttttttagagacagggtcttgctctgtcacctaggctgcaatgcaatggtgcaatcatggctcataggcatgagccactgcacccagcctttttttgtttttgtttttgtttttttaagactagtcaagtgcagtagtgagaaggggagaaaaaaatagaacaaggtgttccatctgtaactgactgtgaccaatctattaaggtaactcactacgttcggaccaaactgactgcattttcactgggactggtcacatgaggtccagtatggaattttccacttgcgttatcatgtaggtgctgaaattttggatttggattttagatttttggattaaggatgctcaacctgtataacaatctcctgttcactctcccagtgcataataaagtggaactagtaatttatctctgactaaactataggtagtggaaaaccactgaaaatgacatgcaggattaaagtagcactttggaaaggtcggtctggtgatccacagtaaatgctcaagaagcaagaggttttttgttgtttgtttgtttgtttttgagacagagttttgctcttggtgcccaggctggagtgtaatggcacaatcttggctcaccgcaatctccgcctcccaggttcaagcaattctcctgcctcagactcctgagtagttgggattacaggtgcccgccaccatgcccagctttttgtatttttaggagagacaggagtttctccatgttggtcaggctggtctcaaactcctgacctcaggtgatccacctgcctcggcctcccaaaatgctggttttacaggtgtgagccaccgcgcccagcggaagcaagaggtttttgcagtagcacaggaagccctgaggcaacctgtgccagtatcaacttcagaaaacatttagtaaagggggaaaaaaattgaatgtagtgatgggcaagaaatacaaaagtatcaacataatttcaatgaactgaacaagtatgacagtatctgtgactgtgaatccctgaccacgcccccacccattcctggagggcttgttaaaacataggttaccggtgccctacccctagagttactgattctgtaaattcgcgagtggggcccaagaatttgcacttctaacaagtatctggtgacccatagcaggtgctcaagaagcaagaagtttcttgctgctttttatttttatttttttgagatagggtctcactctgtcactcaggctgagatgcagtggtgtgatcatggctcactgaagcctcgacttcctgggctcaagagattctcccactttagcctcccaagtagctggggccataggcacatgccaccacatccagctatttttttttttttaaatttctggtagagtcagcgtctcactatgctgcccaggctggtctcaaactcctgggctcaggagatcctcctgccttggcctcccaaagtgttggaattacaggtgtgagtcaccatgtgcagccagtttcttcttgatgctgtatccaggtgatgctgatgctgctggtctgggaccacactttcagaaccactgccttacagtggttattttgctaaggcctcaaagacatcattgttaaaccagcagggggagacaatatacaacagagcctctaaaaataaaatgtcttagggtactaaaactcctttggagttatggtgttgccatggagacctctgaactgttttggagagcagtgtgtaaattgacatgaggtgaaataaatttcaggagtttatgtaaaaaattaatttggtagaaataatgtctagattcttgcatgccatggtgtcttggttaagaacttggaatgtggagtcagctctgccacttacaagctatgtggctctgggaaaattacttatgtctttgatcttttcttcgctttaaaaagtaacctgtggtatagaattggaggggtaaagttcttggaatgctgagattattaaattattattcgttattaaaactctagttacttagcacttacagctctttagcttagaaatagtctaaatacgttgctatatttgcttttttaataaccagcgctcccgttattcaggtaaagaattaaaaacatctaaaaggtaattgctttgtaaatcctaacctctttcattcaaaatacctaaggtagatggctctttataaacgtgcccggctcagagagctctcatctatattatatctccgaatccaaatttcactgatgcccagtctaagagtgtttcctgggctttgagctttgagatagaacgaagcaggtggatcctggctttgactaggcagggccagaccaggcccgacccagccagcccatccgtagagtcagcatcagccgggcgtgaagattggtgtcggctcctgcgttccgccaagttcaggaacctggcatgggccggccgcctcccgcgaagggacacacctgttggtcaccgcgctcttactggccagacccggatattggccttctggcgtcagcggcaggggcatgtccctggccggagagcacaggccagagtggggtgacgtcatcgaaggcacgtcccagccttgcagagcggtgggcggggcctgcgaagaaggtgtgccgggggctggttggaggcgcgggcggcggggccaatgtggcggtgacgtcacggggcgggcggacgctggcgcgggtaggtaagagcagcggcgggcggtggcgctcactcccggcttccaaccgcgcggagcctctgccttggagattctcagtgctgcggatcatgtccctaaggggcagcctctcgcgtctcctccagacgcgagtgcattccatcctgaagaaatccgtccactccgtggctgtgataggagccccgttctcacaagggcaggtgagaactggcacctggaaccgccgggcaggatcctccgccccctagaacctggagacagcggcggtagggtgcgggggaccgggaggcgaggagaggatggggagaaatggcgaggggaagagctggccggttcccgctactgggcaccgtgggagcatgtgggatatcctccgacagagaatggagagggagggagggaggggtggagggcaccctgtttgggatgagggtgtgtttctgcggcctccccagaaagaccgagaaaacggtggatgcagcttggggtaatggaggggagagaatgaggaagaggattccttggaggggctggaggaggcgaaactggtcagaatccccagtggagaatcgatggaggaggttaaaaggagcgaccgaggatttaagtcttctggatccattcactcagaatgagcattaactgggagggaaattggagctggcctctccagcgcgggaggtggggaggagctgttttgttctcttcaatgaaggaaacctgcagtcgggagcgctcagtcatctcgaagcccagaagcccagtctctggcccgagccagccccacacacgcctagctcctggatcctaacctggctcagcctctcccgtcttggcttgggcagctgatgtgattccaacaatggagttggaaggacagtcattgatggaagggctgatgctgtcacaggttttcagaggaacctgctgggaactaaatgtaccaaatgggtttttttccgacaccttctctacctctaattgtgtaatttgtgtgactgacagaaaagaaaaggagtggagcatggtcccgctgccataagagaagctggcttgatgaaaaggctctccagtttgggtaagtggttagatttttagatattagtgcaggactagtaatagaccacttcagagtcttttctctgacatccagggactacacagctttgtgtttgggaacagtctgccacatcccgcatcctcctttggattccgtctgcggcttaagatcaaggagtcatcagggaaagtcttcttgcaataaagagtgtgttggaaggcaaggaggtagagtgaggcaaggtctgaacagctgtcagggaatgcaagtgatgctaagaacactagctccagcttcaactgcacagtcaacctttccccttaaaattccattttcctaactccatcttgagatgcttatgatttatcagtctcgccagttttctgtcttcaaattatttcctctctagggttaatatctttattactggaagcagtaatataggtcttataggctcactgatcttatatagaactaataggcttagatctatattttccgtgttctttttttttttctttttttgagatggagtcttattccatcacccaggctggagtgcagtgatgcaatattggctcattgcaacctccaccttctgggttcaagcaattctcctcccaagtagctggaattacaggtgcgtgccaccacacctggctaattttgtatttttagtagacacggggtttcaccatgttggtcaggctggtcttgaactcctgacctcaggtgatccgcccacctcagcttcccaaagtgctgagattataggtgtgagccactgtgcccagctataaatgccatttccatagtaagggagaacccttctcttagtaacagcaccaaatttgaatacctttataagcagggtgcggtggctcatgcctgtaatcccagcactttgggaggccaaggtgggtggatcacctgaggtcaggagttcgagaccagcctgaccaatatggcgaaatcccttctctactaaaaatacaaaaattagtcaggcatagtggcatgcacctgtagtcccagctactcaggagcctgagacagaagaattgcttgaacctgggaggcaaaggttgcagtgattgtgccactgcactccagcctgggtgacagaatgagactccatctcaaataaataaataaatacctttatggcaggaaggttcttctttatatccaatctaaatgtttctagactctgttcaaggccatttgctctgttcatgtttggatcattcacatatcttttctggtgacataagtgcaaaatgtgaggcagcacggagattatggagataataacacataatctaagttaactccccactgttgctctgaactcttctctgctggtcataagtccattccaagtgaagtcatctccttccaaaagccagaggaataatgaagtcactgaaacagccttgagttgaggtgtccttcatatacctccacctacatatggatatggtgacatggattcaatattcgaaccttgtttattaaataattgcagtttcttctttactaaggcctctcttagtcattttaataactctccaagttcaccactgaagattaaagacaaactgctaagatttagtcttcttttaatgtgtggcaagttaactaatgggaggaagtttttattcccgcccataaatgagcatactgtctcttaaaatagcttgtacacactgcctttttaaaagaatcattttacactgaagacgacaatctctggttatcactgtttttaaatcctggagacatctctgcagtccatctgaactcggccaagcattgctcaaattgctctaccgtctgtaggttctgccttaagagattcctgacaagaagcggtttcagcctcttctggaggagacctctataacaatcagctgaggctgctgaatgagggggaagggcacatttgtagcagcttctcttactcatgctttgtagacttcctttcctgtcacagctcttggtatttttccactccaacccaggggaagccattctcctgtaaatattactccctctttaaactccaacctaaagtgatggtgaggcttcagtttatatggccttccctttgactttttttctcaaatatatttaattgtacaattatatccttactgtgtagctgactggtagctcagtatcaccagcagtctgaaatagaatctcatagcctattaaataaaactgtggctctcagcagatttctagcatgtggttttggctaatctcctggaatatattggagaaaagtaccaagagacatttcagttgctctgttcctaaacagtaccaaaataacttgagtgttttgaacactttcaaataaacagcatggatcaaatttcaaaggagagactcatggaaaggtaactttcacaatccctttgttccttgcctttgctctgatgtcacaggctgccggtgttaccatagcatgagttaaatttcctgttttctctcgaatgaatgtatttgacttagtgtctgggcttgttttatttccttgggcttagtaaggacactcaacagtactctcaggtaaccttttttttttttttttttttttttttgagacggagtctcgctctgtcaccaggctggagtacagtgatgcgatcttggctcactgcaacctccgcctcccgggttcaagcaattctcctgcctcaacctccaaagtagctgggattacaggtgcctgccactgcgcctgactaatttttgtatttttagtagagatggggtttcaccatgttggccaggctgatctcgaactcctgacctcaggtgatctgcccatctaggcctcccaaagtgctgggattacaagagtgagccactgctcccagccaccttttatttttctttgagagagggtctcactctgtcactcaggctggagtgcagtggcatagtcacagcctactgcaatctcaacctcctggactcaagcgatcctcccactttagcctcttgagtagctgggactacagacacatgccagtatgcctggataatttttttttcttttgtagagccggggtctcactatgttgcccaggctggtcccgaactcctgggcttaagagggcctaagagaaatgaaaaggcattgctctggcaaggctgaggagcagtatatctgcactcgattttggttagctctgagaaccatggtaatttgtgaattctagccacctgttaccatgtgagaaggagtgggccttgtactcttttctccagtttttcaagaaaagccagaaatttgcactttaatgggaaatctgtgttgttttaaaatactgtatagtgacaccattgaaaatggtggcataggacctccaaaaaaggaatgagaactgtattagtctgttcttgtacttttgtaaagacatacctgagactgggtaatttaaaaagaaaagaggtttaattgactcatggttctgcaggacatacaggcttctgcttctggggaggccccaggagaattataatcatggcggaaggtgaaggggaagcaagcacgtcttatatggcaggagcaggaggaagacagcgaagagggaggtgatacacacttttaaccggatctcatgagaactctatcatgagacagcactagggagatggtgctgaaccattaggaacaacccccatgatccaatcacctcccaccaggccagacctccaacattggggattaaaattcaacatgagatttggatgggaacacagagccaaaccatatcaagaacattggcaaaaatgatcagaatcagctttttcagaactctggaaattaaccaaaggcttgcagcaatctggggagcatttattcaagaaaaacattgaatctcagtaagaacattaagaattgtggcattttaacttgccctgttcccatgctgccttttcccagatcagctgtagcctggacaaccgatagcctgcaatcacagtgaaaccaggaggctggcagttactgcaaaagggagaacagaggtgatactcctcatagaccatccccagaaaattgtcatttgactggtctgatggtttcctaaaattgtccattcacaaggctgtctttatttgaccaacacaagtcagtaaggaaagaatagtcttcagtaaatggtgctgggataactggatatccacattaaaaaaaaaaaaatccctatctcacaccatatatgaaaattaactcaaaatggaccaaagtcctaaatgtaatgctgaaaccatataactgttagagaacataggactggatttttgcgaccttgggttaggtattggtttcttagctatcccatcaaaatcataagtgacaaaaattaaacttgacttagctaaattaaatacatctatgtttcaaagagcactattaagaaagtgggggccaggcacggtggctcacgcctgtaatcccagcactttgggaggctgaggcaggcggatcacctgaggtcaggagttcgagaccagcctcaacatggagaaaccccatctctactaaaaatacaaaaaaaaattagccgggcatggtggtgcatgcctgtaatcccaactactcgggaggctgaggcaggagaattgcttgaacctgggaggcggaggttgtgatgagccgagattgtgccattgcagtccagcctgggcaacgagagcaaaactccatctcaaaaaaaaaaaaaaaaaaaagaaactggaaagacttcatcaatgtaatgaaaaaccaaaaaaaaaaaagagaaaaggtaaaaagactgcccatagaattggcaaaatatttgcaaatcatatacctgataagattctagtgttcggcaaacataaataaaataacaaccgtaaaaagacaaccaaatttaaaaattagcaatagatttaattagccacttctccaaagaagttatacaaatgggcagtaaacacattagtcattacggaaatgcaaatttaaaactacaatggccgggtgtggcggcttacacctgtaatcccagtactttgggaggctgaggcgggcagatcatttcaggtcaggagttcaaaccagcctgatcaacatggtgaaactccgtctctactaaaaaatacaaaaattagccggatgtggtggcacactcctgtagtcccagctactcaggaggctgaggtgggagaatcacttgaacctaggaggtggaggttgcagtgagcagagattgtaccactgcactccagcctgggcaacagagtgagactctgtctcaggggaaaaaaaaaaccacaaaactacaatgaaataccatttcacacccactaggatggctatgataaaaaagatagacaataccaagtattggtgagggtgtaaaaagattcgacctgtcatacactactggtgtgaatgtaaaactgcagccactttggaaaacagtttggcagatcctcaaagttaaatgtatagttactgtgtcctcaagcaaatccattcctatgtatatacctaacagaattcaaaacatatattcacacaaacttttttttttagacagtctcgctctttcacccaggctggagtgcagtggtgcaatctcggcctcagccttctgagtacctgggaccacaggcaagcaccaccatgcccagctaacttttgtatttttaattttgccatgttggccaggttggtctcgaactcctagcctcaagtgatccacctgcctcagcctcccaaagtgctaggattataggcatgagccattgcacctggccacacacaaacttatatacaaatattcatagcattattcataatggtcaacatgtggaaactcaaatgtacattaattgaataggggaggaaaatttgacatatccatataatggagtattattcagtcataaatggaatgaagtactaatttatgctacaacatggatgaacctagaaaacatgctaagtcaaagaaggcagacacagaaggccacatgttatatgattccatttatatgaactgtctagaacaggcaaagccataaagacagaaaggagattagtggttcccaggagctgggaatgactgctaaagggcatgggtttctttccgaagggtgatgggactgttgtagaattaggtagtgtcgatggctgcacaacttcttgaatatattagaaagcactgaattataaattctaaaaggatgaattttatggtatgtgaattatatctcaataattaaaaaactaggcaattgtgatcagtaaggagatatatatatatatatatatatatatctgaaacttctgaattgctaatattgatctgttttgtgacttgggtagtaattatagggtgtttacaactatctgttatacttatgtaagttttatgtgtttatattttatgaaatatacagtaaagacacattacaaatcatgtctgttgatagatatccatcttttcaagctctagttttgggcattgaaaagagatgaaactggcatctctgaggtgccttttgaacagtgtcatatctttgggacaagaattggttgctaggttgactcaacagcaaatatcagtgatgtttctgaagagactgtaaggctgtatgatccaccaaaccttctgcctctgccattcacactcttctattaaacacttagcaaggcatagtggctcatgcctgtcagcccagcacttagggaggccaaggtgggaagattgcttgaggccaggagtttaagatcagcctggacaatgtagcaagaccccatctctacattttttaagagtctatttccacagcaaggaagaaatgaaagtacagcacctgtcccatttcccacaaaaaagtctttgcctagggtctgcatatgtgactggaagctaaattattggaatgagcttgtttgtttaaggttattaaagttctgggttctttgacttctaaagtcactctgatatgtatttggaagagtaaatgtctagcaaattggctttatatttcctttagagatctagcaaagaccaaacctgctttggacctcatctgtgccacagtgcccttgggggatgggccacctgtagcagaggaataggagctgaggcatgagctgataagtggcatcactttagggccctctccaatctcacctggaatgtcactaatagtgacctatttctttgggttcaagcttttcattttctgggcctcctttatattgcagattcttttattttatagataggtctcactatgttgcccaggctggagtgtgggggctattcacagacataatcatagtacactactgcctcaaacttctgggctcaagcaagcctcctgcctcagccttcaggatagctgggattacagatgtgcaccactgtgctcggctgcagattccttttaggaggtgaatacataatcagtaatttgctaatgccttagtaaaaacttagtgatgtgcctgcatagagggaaatctataatagacactattgggatttggcaaatttcaatgtagccgtatatttcccatttatgacagcaaagattttaacttaatacctcttatttaacttaatacctcttatcaaaagttttttgatacttaacatttaccatcttctagacactgtgctaggcatttgctattatcccattttcataatttgtaaaaagcaaattttgaccacctcagccattaggatggctactatcaaaacagaaaataagaagtgttgatgaagatgtggagaaattgaaactcttttacactgttggtaggaacataaaatggagctgctatggaaaacggtatggcaactcctctaaaaattaaaaatagaattactatatgatttagcaattccacttctgggtatgtacccaaaaggactgaaagcaggatcttgaagtagttgtgtacccatgttcacagcagtattaacaatagccaaaaggtggaagcaacccaagtgtccattgatggatgaatggacaaccaaaatgtggtacatacatataatggactatcattcattcttcaaaaagcagggctgggtggggtggctcatgcctgtaatcccagcactttgggaggctgaagcaggaggattgcttgagtccaggagtttgagaccagcctgggcaacttagcgagtcccaatctccacagtggggggaaaaaaattagccaggtgtggtggtgcatgcacatagtcctagctattcaggaggctgaggcaggagtattgcttgagcccaggaggttgaggctgcagtgagctatgatcataccactgcattccagtctggcagcatggacaacagaataaagcctcatctgtttaagaaacaaaacaaagaaacctgacatatgctgcaatatgggtgaactttgaggacattatgctaagtgaaataagccagtgacaaaaggacaaatacagcatgattccatttatatgaagtttttagagaagtccaatttataaaaacaaagtggaatatcagttactaggacttggtgggagaaggaaatggggagttaattattgcttaatgggtacagagtttgttttgcaagatgagttctggagatggatgatggtagtgatggtagtgtccaatcaacttctcagtcttctcggctcttactacaaaggaagaaactgtactacccagatttcttttttaatagaaatgttatttatagttaataacgaatgcactgcataaaaactttatagtttcattattgtgaaatgtgttcaagatcctacagtaaaagtgaaacattcccaaggacttgcgttagtgaagactacacagaaaacctttctaaggatttgtgtggatccgatagatacttggcaaatttttgagttgtacattcttacagaaagtccacttaaaagtgatcatttgtaagacaaaaatataaatagtttcaaaaatctttaaaaaatcatcctaaatgcatgatcttcacctccagcttctgaagagccctcgttctcagtgtcttccttcccacatttcccaccacagccatctcatgatcctcaagctcatgcttttccagttcgggtagggactctctcaactttctccctgtcatcccccacatcagttgtattgacaaagaacgtcagaggatgaaggtctagttctgtattaggtttgtgcaaaagtaattgcggtttttgctgttgaaatgggtatcatagataacagtgcccatggtaagggttcaaaattaacagtggaaagaaaaatagttcatttcactctcaagtaaacaatttggaaagtagtccagagctggtttagtggttctcttcctttaagttcagacctagattcttatctggtgctactggcaaggcctctgcctaatggtgccagatggttgtagcctcagcagcaggatggaagaatgaacaaagaaaggggcaaaggcagttctcttcccttcccaagaagttgctgcgggacacggttctgcttatcctattgtccagaactagttcatgtgaccacatccagttacaagcgaggttagtaaatatagtttttatgtttatttatttatttattttagatggagtctcgctctgtcgcccaggctggagtgcagtggcgcgatcttggctcactgcaacctccgcctcccaggttcaagcaattctctgcctcagcctccatagtagctgggattacaggcagctgccactgtgcccagctaattttttgtatttttagtagagatggagtttcaccatcttggccaggctggtctggtctggaactcctgaccttgtgatccacctgccttggcctcccaaagtgctgggattacaggtgtgagccaccgtgccccgcccatgtagcatgtagaatgtagtcttttctaagaggttaatgctcccagctaaaaaccttttctttccggaaaaagggaagaatgaatgttgggtaactaacactcggcagtgccctctccctatgctctagaccccctcccctctgacagtccctgctccagcattatccctcccctcacctcgtgtcatggctcttctctcctaacctgtcctttcggtaattaattgtgcaacccttaccctccaccatcccccttgaccttaggtagccctctagctgttgtccagttattttgtttttcttcagagccaacttcctggctttctcattgccctttcacatttcagcttgttataatgtggcttcgtaggccatcattgcaataaacctagtattgctgcagtatctgacctactttctaatacaatgaacagatgaacagtgtaacattcaccttatttacaccactaatctttctttattgaaaccaacactattctctcttggcttcaactcttcaaattcctctagtaaatcctttctttctttctttttttttttttttttttgagacagggtctcactctgtcatccaggctggagtacagtggtacgatctcagctcactacagcctccacctcccaggttcaaacgatcctcctactttagcctcccaagtagctggaactacagggacatgccaccacaccagttaacttatttatttttagatacagggtctcactatgttgcccaggctggtgtttaactcctggcctcatgtgatcctcctgccttggccttccaaagtgttgggattacaggtgtgagccactgcatctggcctacatcctctttttctagctacttcttacatgtcagtgttctcaggattctgtccttgattctcctgctttatcctgtcttggttggcagtctgcttccatggctttactgtcacctgtatgctgatgccacccaaagctctatttttttaaaaattttttgagacagggtcttgctctgtcacccaggccagagtgcagtggtgtaatcttggctcactacaacctctacctcatgggctcaagtgattcttccacctcagtgtcccaagtagcttggaccacaggcttgtgccaccatgcctagctaattttgtttatttttttctttttgttttagagatgaggtctcactatgctgccccaggttggtctcaaactcctagactcaagcaattttcccacctcagcctctcaaagtgttgggattacaggcatgagccactatgcccagcaaaaactttatctctaatacttatttttcctcctaactgcaaacctgtatacagatgtcttccatgtatcttatctttttaactttttgttatggaagtattcaaacataatgaaagtagagatggtaacataactgacttgatatatccataagccagcatcatcaccaatacgtggcaatgttttttacaccacctccagaccattttggagtaaatcagacatcttgtttcatggactggacagcacctttgatcacacacagtgtatcctaactttattatggccacccagaggggaaacagacttctcatatcttaacacaggaggtggttttgcaaattggagcaaggtgcccaccatttgtacccaggggagttaggctcttacccttctgtaggaactgagaggttgaggcactatctccctaaatgtttgcatctccaggagatggcttcctgggtccttgaagaagcattcctgggttgtgagacttgtgagaggcctatttagtcattatgaagattcacataaatttgaaaagcacacaaatattatgaaatagaaggaaggaagggaggtctctttctttattttcaacagggagaattaagcctcttaattttttttttttttttttttttttttttttgaggcagagtctcgctctatcgctcaggctggagtgcagtggcgtgatctcggctcactgcaagctccgcctcccgggttcacaccattctcctgcctcagcctcctgagtagctgggactacaggcgcccgccaccacgcccggctaatttttcgtatttttagtagagacagtgtttcaccatgttagccaggatggtctcgatctcctgacctcgtgatccgcccgcctcggcctccgaaagtgctgggattacaggcgtgagccactgcgcccggccaagcctcttaatttttaattagtattgttcacattgcctgattaagttacactttttaggtttattttgttgttttttgtttttaagtttgagttgaattcaaatgaggtccacattgctttatactttaagacctttgtaggttctctctttttttttcttctttgcagtttatttatagaagaatctaggtcatttgtctgcagaatttctctgtttagatccctgtggtgtcctatgacatattctatggcgatgtatacttcatcagaggtgacatttcagcgatactgtcagccattgacgattgcctagaattatccattaacttgtctccatgtgctttcaacaggatagtctctaacacatcaatgtcaacatatcccaaactgaccttatcatcttctccctcccttcccatgcccctctattgctggacactctgttccctctcatttatttctttagcttcctgtggcactctgcttctccagaccattttctacactgctgtctgagcactagatccaaaatgcagatttgatttgtcttcctggcttagaaaccacggttgttccccaccacatttaggacctgggccttgccccggctcctgccgcatctctttgcagtcctctaggtgcactctgggttcggaggaattgtgcattgttctatagggctgaaggcattctctcctcctcagtaagcatttcttcctcctctcttattcctggctaatgtcttccagactcagatattgctgcttctgagaagttctcctgacccttctcttcctgggtctctgttcccgccacaccctttgtacatctggttcatagcaattagcactgggctgggctgccactttctctgcctgacatcctaccagcctgtgacctccttgaagtctgcaccataccttatttctgcattcctaggatttagtggagtgctaggcacagagtatacttttgttgaaggaaaaaaggaagcaaagcatcttagctttctcctgtaacttcattcacatcacaacccttgatgagttttcccaaaccagtattttgtttctctgaaaatgatctgctacttagaagccacctggtctcccagatttttaaaacgtatgactcaaaggataactgccatatatcaaactttaactcttgcaagctaaatgttagtaggggctgggtgcgatggctcacacctgtaaccccagcactttgggaggccaaggtggatggatcacttaagcccaggagttcaagaccagcctgggtagcatggcaaaactctatctctaccaaaaaaaaaaaaaaaaaaaatttagctaggtgtggcttctgtagtcccagctacttgggaggctgaggtaggaagatggcttgagcctgggagatggaggctgcagtgagctgagatcacaccactgcactccatcttgggcaacagaaccagaccgtgtctccaaaaaaaaaaaaaaaagctagtaggtagtaatgatgatgagttattgctcccttttttgaaatacatttttaaaccaggacatcagtagataatgactgctttcttcaagtaaggctgacctctaattactttagacagatggtgcattgttattttaatatccaaaatagtacaattcagaggcagaacctaagagattacagtggttggcttaaataatttaacctttgaataaatttacttatccctctctattaatgaccaaaccttggaggaaggagatgttacaagggctggttggagctgtctcctctgaaactctgaagaaatgaactgggacagatatctcaagacacatggttctttggctgggcgcacggtggctcacgcctgtaatccagcactttgggaggctgaagagggtggatcgcctgaggccaggggtttgagaccagcctcggtaaaatggcgaaatcttgtctctacaaaaaaatataaattagccaggtatggtggcgcatgcctgtagtcccagctactctggaggctgatatgtgagaattgcttgagcctgagaggttgaggctgcagtgagccatgtttgtgccactgcactccagcctgagtgacagagtaagaccatctcaaaaaaaagagaaaaggttcttaaggttgtacagtctttgggagttaaatgcaccaaataaaattcagatctctgcattttattggtagtaaccaaatgagtttacctaaataacagtctcttcaaaggttattacccaaattacattttatggataagagaaattctacttacttcaaatggcctgaattaaccctggcatcccccattccccaccctccagtttagacttctagtaacattgcaactttatttttaataagctagtatttcaagtacaagcttgttctaagaattagcagtcacatccctttaaaattccaggaattcggccgggcacggcggctcacacctgtattcctagcactttgggaggccaaggtgggtggatcacctgaggtcaggagttccagaccagtctggccaacatggtgaaacctgtctctactgaaaatgcaaaaattagccgggcgtggtggcaggcacctgtaataccagctactcgggaagctgaggcaggagaattgcttgatccggtgggtggaggttgcagtgagccaagatcacgccacttcactccagcgtgggtgaaagagcaaaacttcatctaaaaaaaattttttttaaattttaaattaatttccaagaattccttttgcatggggctaaatctgccatgtaaaatatttgagtctgtaactttaaaagccattagtaccctctcagcaccaagtgaggatgcagagtctttgtttttctcctgatttcactgacttgttattcctgacaagtcacaaacatttctatcctattcatatttagaaacaatttggaaaaactgcacactaagaggcccctagcttttctccatgtctgttattctaccaatgggttgcctgtggctcagcagaccctcctgtgtgtcagcccactttgaaacccatctctcttgacttgctatgagccctggtagcaacaggggtcacagcagtagggagaatgggatagtcttatgctgtcaaaaaaaaaaacccaaaaaacaaaaaaacaaaaccttactcatcatgtaatcatatatgagctctaaccaaagagtaattcagttgctgttaaacagttggagctattcagccttgctgaaattcttcctctgcaatgtgtggatagtgacaccagcagaggatgtgagaatgagcacgtatctgtagagcgtgtagcacagtgtggtgtgtagaggcagacaattattatccatttcctgtctctggcttctttcagggatttactcactagccctgaaatagaagtgctgttcacagatattgctaaggtcaggtaaggctgttttgatttcttccttacagcctggttgcatcattctgttgatgcacttgtgttcttgttccactctgatagagcctggagaggtttatcaaggccaaaggtaacatctgggcctgaaagatcagagtagtactcggtgtattttattaccagcactcaggagagaagcaacaaggctgtgccagtgtataaacagcaagtgaaaaatgagaccctttcacattgttccaaatctatttgacatgagaacttccttgaaatttcaggctcctcttgtcctacaatgtcctcttagaagaaagagcagcaatgaaacactaggtctcatctgacctggacttacagatgaattgacctgatgcacagttagagaaagggaaagttcccacaggcataacagccagacacatattccttacacattacaatgtctgcatttttcatcattaccctaagcttcttgaaaaattagtgagaccgtttcttatgacctatgaaccagaagaacttgccacagcactctgataaagaaatagctttaaggctgggcatggtggctcacacctgtaatcctagcgctttgggaggctgaagtgggaggatcacttgaggtcaggagttcgagaccagcctgaccaacatggcgaaacctcgtctctactaaaactacaaaaattagctgggcatggtggtgcatgcctgtaatcccagctacttggggaggctgaggcagcagagccccttgaaccagggaggtggaggttgcagtgagccgagatcatgccattgcactccagcctgagcgacagagcaagactctgtctcaaaaaaaaaaaaaaaaaaaaaaagaactttaatattactcagttcatcctgctgttacaaaaagttaacttcccatcagcctcctcactcctcttaaaaaaaaactgtagcagatgggttacaattcatgttttctacaacaacatactagaaccagggttcagataatcctagaactagggttctgttctaccagtcctttgggtattggtagtacccaatactattggcacagtgggcattagaggagaaagctcttaagaggtgacatcaggctggcatcatgtatttgttgattcagttatgtaattaactagaatagtttaacataaatttgtaatcctagagcaactttcatattttgttcttaaaggttatggcagtagaataaaaaagtactcacggtggcatacattgctagctgtccaccaaaatccattcgcattctgttctggacataagctagacctgcatttgctggccagtgccaaaagtgagcaggagtaatgtgccactttcaggccagagtcttgaaaagaggaggtgtgctttctcaatgctttcttcctctcccgctgccttgaacctggggagacctagacttagccacacagatggcaaagtcctaggcatgagagccacaagccaggtctctgaattactgcataaaggaaagcctcctgctgacctggaatatctaccctggatgctaaacaaacaagaaataaacttgtttgagccatattttgggctcaaacatattttgctatgacagttaatttactctaataaccttacttaaaataatattatgtattatgcctataactagcccaggcatggtggctcacatctgtaatcctagcactttagaaggccatgatgggagcattacttgagcccaggagttggagaccagcctggaaaacacagtgagaccctgtctctacaaataatccaaaaaaaaaagaaaaaaaatgattaaagtctgaaaggatacagtagtaaaacccgggcagtaggtttgggacctctgatatacacgttatccaattttacagagaatttcaaaacaaaacagtgcaagtacaaactatttgtcataggagttcttctttgacgcccctgatcctcagtgaacttcccctgactcctttaggactcattgtcccaagtccttacctggcactgaaactgtgcaaattatagagttgagttcgttcttcctgaatattctagggggaaaaaagaaaaaacagagttgggagcaggaaggtaggccactcaggcagggcctctcaaggtataaatccctttagaggaggctggcccttagctttgtggatgcagaaacacaaggttgctgagtgcatagctcatcaggctttcagacccagactcatgctaaccatgctggatcaaccaaaatgcccgtgcataattatgttaagcagtagtccttccagtgtccactgtctagaagcttttgcccatattaaggcatgtgggaaaccaactgaatagccagaatgctgtttggtgagatggcatcggagtaaatggagttggacaatgtggacagaatccactacccaggttgggaattaatctgatgaacccccgacagaagttagtaacccttctagcacctgtaatgagagcagagtggtggcctgaattagcgactgaaatccttctatgaaattcagtctctcttcctgggaacgttactgtaagattgccaaattctctttaggttcctttttaggctttgtgcagcttttttctaatacaagtgagtactgttttctgtcacgtttatctgagtctacatcctggtttgcatgattggacttgggtagtcccaaagttctgtgacttatccactggattgagcactttaatttccctgtatttcttcttggtcctatgaggattgaatgaaagtgcttggcaaatagttctgaaacgttagttaatattatttaactccagtttggggccttttatatgactattccttagagtgcaattaccaaaatataaatttataaagattataaatcttttataattgtacacctaatattataaaacaccaggcataccctggtgtcttacatctagtaagaacctaatggttgatgtgatttaaggagagtgctgagataaacatggaggtgaaagtagaaacatccaggaattgtccattcaagatctgtacagtacactgggtgcagtggctcatgcctgtaatcccagcactttgggaggccgaggcaggtggatcacttgcggtcaggagttcgagaccagcctagccaacatggcgaaaccctgtctctactaaaaatacaaaaacaaattcaccagacgtggtggcgcacacctgtaatcccagctacttgggaggctgaggtaggagaattgcttgaatccaggaagtggaggttgcagtgagccgagattgtgccactgcactccagcctgcatgatagcgcaagaccctgtctcaaaaaaaaaaaaaaaaaaaaaaaaagtctgtgcagtccaggattgtgttgtcaacagacagaggaaagacttgatattgacttgaaggttaattaaagctttcattctcttaagtctaaagtatcctctccatattttgagatttggtgaagtccataatgactttactcaaacctttttgtctttttttaaaaaaataaaagatttttatagatgttttatttggttcacatttttatcttggttcacaatgtctttggcctgttgtcatatttttctcctcctacccctgctctgctacctttttatctggttgtctggatcttctccaggttggggccttttatatgactatttcttaaagtgtaatgaccaaaagataaatacagaattcttgctgtaggtgtatctcacctttaagaataggtctgggtgacacaagggctggggaggaaaaaaagaataggacaaagttttctgtcttgtttccaatatctcttgcggtggcaattccttggttggcctcatggctttttgttatggtcactgctcctcaaatttttatatttcttcagaattttggctttggattgagtttgggttcaagaggtagagctcaaaattataatttaaattcatgatgagtccatgctgctcttaatccgaacctttaacacaaatctctgcaaatattaagatacgccacgtcttatcttgttactgcccctttcccaccaataccaggaccctaagaatataatctatgtcaatgttctgttctctgatagttcagatccctttttgatacagtcagattatttagtcctcatcctaaatgtagcatccaacttaggtggggaaatattcaaagctgtgagaatatagcactagttcttaaagtgttggactcatgaggaattccttaggagacaaactgcatagtaaaggatagaggttgagcgtccctaatccagaaatccaaaatcggaaatgttccaaaatctgaaactttttgagcaccaatatgacattacaagttaccctgaacacactgtattaatggtatgtcatattttctgcttttaagtacttatgtgtgaaaaagtaagaaaataactgcctatcagtagcatataaattcagagtcaggaagatggtgatgccaaacaatcatattgtccacatgggtggctgtgatagtgacacctttgttttctgatggtttaatgcacacaaactttgtttcatgcacaagatgatttaaaatattatataaaattaccttcaggctatgtgtataaagtgtgtatgaaacacaagttttgtgtttagacttgagttccatccctaagatatctcaatatatatataatgcaaatattccaaaatctgaaaaaaataaaaaatctaaaacacttctggtcccaagcctttggataatgggtactcaacctgtacaaactttggagccagatggcctagatttggatcctgattctggcacttaatagctgtgtaacttgggcggttacttctctttgcttcagtttcctcatccaccaaataggcacattttagttgcctcacacaactgttttgagtcttaaataagaatttatgttaagcagctagaacaatgcctgggatcttgtaaataatcaataaatattagatatttcttttaggatgtttcagattggctatttataaaagtttataatatgtgaatttcttggccaggcaggtggctcatgcccataatcccagcactttgggaggatgaggcgggaggatcagttgaggtcagaagtttgagaccagctggggcaacatagcaagaccccatttctacaaaaagaaagtttaaaaaaatgagactctctttgtgtatttttttgctaaattaatagtacttaatttcctttaaaattgttggttcttaattttctttaagattgttggttctttttgatattttatttctactctatcactccaggatatctgaggtctaatggttaaccatttttttattgttgggttaagtcaatcgatatctcttagtttcagtttccaacatctgcaaaactgttcataataggatcgagataatcttcccacaatcatttgacattttaaattttactgtgacaaaatgattatgatgtgtactttgtcacgtattatcattgtggcccaggctagttaagagttggagatagcacagaaaattcatcttgtcatccctcatttgcttccaggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaccacaggtaagctgggagccaggcgtggtgaggggatggattacatggtgcttggggctcataacttagcttctttatctgtttcttcatctggagaaaaataccctacagaatttttagggtagatattaaaatgaacagcaagcatttaaatgtctaagatcctgagctgctcaaggggcactgtggttttctttgtatgacacattgcacagtaagaatatgtacattcagacacagcaagttcagaggtatactaggcaaggttcctaggcactgtgttaacatgcttgtctcctggaaagctttcttgagacttatcttatgactttggagaattagaaagatccattgataggctgaatgtgcaagtttttgttagcatttctgctaatagacctgttagaaatcccctttggcatgttactacattttctttttttttttttttttttttttttttgagatagggtctggctctgttgcccaggctggagtacagtggcatgatctcagctcactgcaacctctgcctcctaggctcaagccatcttcctacctcagcctcccaagtagctgggactacaggtgcatgccaccatgcctggctcatttttgtatttcttgtagagacagggtttggccatgttgcccagactggtctcgaactcctgagctcaagcgatccttctgccaaggcctcccaaagtgctgggattacaggcatgagccactgtgcccagctgtggatacattttctgcctccacaatatggaccctagtgactcatgcaatcagtcctttgatcctgtctcctcctgaatcagcatgtactttattgagcactgttctgatattttctcagcagtgctagagattgcaggaaatttgtgatatattaaggcctagatgaaataaatatacatggaataaacaaaaatattgaattctacagaatttcaaaggaggaagagatcagtctggactaaaatagatttcacaagggaatgtgatttgaaataagcaatgaaggtcttcagtaggaagaaggcactgaagtactaggagtattgagcactccatacatattctcagttaattctgctaacaatgctaggtggtagatatggttttatcatttactgctggaagcatgtagggacagatatataagaacttatccaaggtgggcacagtggtgcatgcctgcaggcccagctactcaggaggccaaggtgggaggattgcttgagcccaggagtttgaggccagtctgggcaacacagtgagatcaggtctcttaaaaataaataaataagaaagaaaatataacttatccaaggactagaaccaggaaatagagctgggattcaaatccagtgtgactcttctggtgattattttccctgaggtgctgagaaagcttttcagatcactgaacagaaatgaaatctttgttacatctggagaagcaggtagattcctccttgggagtaaaaaaaaaaaaaaaaaaaaaaaaaaaaaagactcaggttgaagaaaacggtcacacccaggttccctactgagatgactaggccattcaattaaatcaaccagagggcaagtctcctgcctcctttctcagtgtagtctctggaaatttattaagtctgtctgctgttctgagttctggtcaagtctcactgtttggggaccactgatcaatgtgattaccacagatcttgttttcttttcctgtggctatctatattgcagccatgttactgcttaccagctcaatgttaaagcttaggcaatctgaaattctagagaggaagagataagtgcataacttgaatagctgttgaacattttcaagaagagccatttttaggtcactgctccttttatgtagtttaacatatattactactttaatcatcaaagcaactctgatttacacaggccaagtattattattatccctatctcacagaaaaggaaactgaaatctaaagaaattagatggtttgtcttcagtcacacagctcttccaggactaaaactctagtattctgacttaatccactgccttttcactagaccatgctattcctcaaaagacccaaccagtgtgggacatggcacctagaatagctgtctcatgctatattgaccaagaaggatggttgcagtcctaagatgcttaagctgcatttcccatctatgtcaaattccttggttactgggaagctttccaacatttatttcatcaggtgtattcttagaattgagacagaacagttggctaatgtaagcagagcccaaggacaaggaaaggcaaaaacagaaatacactttaagatcttatatttgaggctgggcatagtggctcacgcctgtaatcctagcactttgggaggctgagccaggtggatcacttgaggtcgagttcaagaccagcctggccaacatgttgaaaccccatctttactaaaaatacaaaaaattagccaggcatggtggcatgtgcctgtaatcccaattactcgggaggctgaggcaggaaaatagcttgaacccaggaggcggacgttgtagtgagctgagattgcgccactgcactccagcctgggaaacagagcgagactccgtcttaaaaaaaaaaaaaaaaaattgaatgccatgctaatatatataaggtaacatgcaatacatctttttactcagtggtctaaattaggtctttaatggtttaccctgttaatgtctccaagagcttttcttacagattttggtgagtcgttacctatagactgtaccatttacctagatttcttttttttttttcatttttggagacagggtgtgactattttgcccaggctggtcttgaacccctgggctcatgtgatcctctcacctcagtcctctgagtagccaggattacaggtgtacaccatcttgtctggcttaacttgatttcattcattgaacaaatatttgaggttcttttctgagcagggctaatggataaaattatacggatttggggacaggacagcagtgacatctgtcacactgcagggtagcaagtcaccagcttcgaatctctagggctttatcactcaagattaatttttgagaactacaactacaggtcttgcctcacccaaacccagtctccatctaggccctggctttgcactgtggagagagtataagttgttttggctgaggacgtttgttatcggtcatgtttgccaagcagagggccttcaagattatacttgttctttgcagcctggcaatcggtaccattagtggccatgcccgacactgcccagacctttgtgttgtctgggttgatgcccatgctgacatcaacacaccccttaccacttcatcaggaaatctccatggacagccagtttcatttctcctcagagaactacaggataaggtcagtgggccaaaacgaaaagaaaggtgaatggcttgcagggttttgctggagttggtctagttcagttaagattttggtgaagggtgggttgagtgtggattaccactccttcatttgttcatcactattatggaccaggcagtctgccagatgctaggggtataaagactagacatagtctctgttctttgtaagaaagcaaggagggggtagtaacaatagcgactgatatacccacagcctgaggacttcttggttagaggctcccaggccatactctcagacacactgatctagaagacaaataaaaccatgacctctgggtaatattttcctgagcagttcagaatatatgggagtccatgttaggcacagactagaatctgtatatccctcccctcagtgagggaccaagtcaaaccaggacactacaaagattattcattgggcggaagtcctgtgtcggctgttggcaacttgagatggcaaccaggttatgcttcaagaaccaatctgtaaacaagtcagtaatgtgcaatgggatagaaaagggctaatcagcagtattcctgctactaggtaagttaatgagaaaccaagacaaccttagagattttattcgtcttgagaaagcaatactgtgttcctcagctgcccttctgaaacatttccaccttgtgtcacttctccttcccagatcaagtgtgtcctgtgttgctctaaacttaccctgtgggtggcagaagaaagcagattgcatacccacggacgcacatgataatgatcttggtgagaacaagaattcttgattaatcctgtccatttctccctttcataggtaccacaactcccaggattttcctggatcaaaccttgtatctcttctgcaagtattgtgtatattggtctgagagacgtggaccctcctgaacagtaagttgatgcatttggctgaagtttagggcctgtcctagccaattatgttctatttgaaaggctgatgcttaacttggtctattgcaggtcactacaacaaacccaccctctcccccaaatacatatttgttaaaaatgctctttaaactaaggactcctccctttatatctcatcacagttttattttaaagaactatgatatccagtatttttccatgagagatattgatcgacttggtatccagaaggtcatggaacgaacatttgatctgctgattggcaagtaagtaactataactgatgtcagggcaaacccccaatgggcaacacacttttagcctgtttcttgaggacagcagctttacttttaaaatacaaagcaaaaacatacacataattttaaatagttcagaaaggcaaaatttgaaacacaggtcatattcttcctctggggtttttgggaggaggtttcctctaaatcattgcctagatcttctgtctcatgaatttttctttatctccatctttaatgcttatcttctgagatgacaagcatttattgtttcaactgtcccattcttcccagcctcacgattgtttcatctgagttttatattaagcaaatcttggcagtgtagaaagatggcagatgaatactaatcaaatggtaattttaagagcattttcccaataccaagtctttacttctgggtgattaatgtcagaattgttatctggtagtatgtcatttcataagctgttaagaaacttagttgttagcttcagcctttggacactggggctataatgaagttagaaatggaagatgttaaaactgcagacctaaaattagagttcacttcagctgctgttacgttcagagaataagagcaaccataacttacatcaagccaatttaaattagactaatttaaattgtctaattaaattgtctctagatgagagcccaatctcatctagaagtgaagaaatctctctattgacagttattagtataagaggttctaatacccagtgtaaggcagaaatatacattggagttagtctgtctgaggtatgcagaacaaatggcagtatcatgaagtggtatgtaggaagttaatattgccaatctcagtaacttccaagaataggaagcctggaaatgtattaacagctttattaacaaagtactaggactaatagcaacaaaatcaaggagttgcaaccataagaaggatgagtgtccaaggacaaccagttaagtattattttaagtattattttatcctcttcctttttaggagacaaagaccaatccatttgagttttgatattgatgcatttgaccctacactggctccagccacaggaactcctgttgtcgggggactaacctatcgagaaggcatgtatattgctgaggaaatacacaatacaggtatgtagcaaccaggtctgcagcctgttaactacataggtaaatatgctagagtctcttgcctgcaaaggatcttttctgctattccacatcattgcagagtttgtttttgcttaaacttttgtagctaaaaattatatggccatgctaataaaaaggatatagtcctttagagtcatgcttggacatggctcttaccaaattacactaaggtaataatgagtaaaaaattgtatatttaaacaattaaatacaagaataaattgtcaaactgatgcagttctttgagttatctaaaggcagattaagataagaaggcaagataagataagagtgcaaggctgtaatttgcactctaagagattggttcattgggagttgtgaatttggagctaaagctgatctcttgaagaaatctgcaaactggacaatatcttgggtcctttatgtagggtaggtcttgtactagagcctgaaaggatttctaataagggggatacagttagatgagaatggctgatggaaagagtactaagatgaattctacgttatcaagactggctacttttccaaaactcatacttgtttgcaaacagtttccatttctgtcagaaagcttctggttttaaagctacttcaaatgacctttcattccaaaatttaaagaactaccaaatcatactgcttcagtaaccatctgatggaactagggtatagatagagaccccagattgaaaggttcagggctatagagaacccttgactagctgggatagaaactcacattgagaaatggtctccttagcgccacagcctgccagaaccttaggcagtacaaaaaggcaggcagtactggtctaattctcagatctgcaatcttagatgttgccagtggtccttaggttattggccagagaacttgggggttcaattctctgctttgcttcctaaaaacaccacttagagcaggggttaataacctctagcacttatatatggcatggcttgtctctttgttcctatgctacaatattttactccaaaagacactcatggggctaggcacagtggttcatacctataatcccagtactctgggaggccaaggcaagaggattacttgaccccaggggttcaagaccagcgtgggcaacatagtgtgaccccgtttctacaaaaaataattagccaggtgtcccaactacttgggaggttgaggctgcagtgagccatgattgtgccactgcactgttataatgctgtcaactagatacataaagcagtttgcttaatttatagggtggcaatagtctggaaacataagtcatgtatatatttctaatagtgcaaactttgatgaccacttctgggatatgctaaaggtgcaggtttagtcagtggaaatcagagacaaatcaggaacacaggtccatgtgcaggaaatgatggaaatgctacagtaatacacctgttggttgcagtttggcactgtacactcaactatgcattgctaataagggaagatgctgaacggacatgatggcattcagcacatcatgtactatagtgtaatatcaataaaccattaggtacatttgcctgtgtttccagactttatggccaccctaaatattcttagatacttgtattcctgaatactagcttgttcagatcacccttcatccagaataaccaactaaaaagttaaattctatagagaagtgaggcatttagaggggtgagcatagtagcaggtctggataggttcttctggtttaagcttcccttccacttgctccaggccaaaggaacactaccgagaactttgacacaagttctcaaaccttaacagaaggtaactgaagtccagataaaataattaacatatggctgaattttctcttgatcaagtacaagacactgggtcagtctgctgggagacaaaaagatgttgttagatgtggaacctgcctccagagctcaggcctgcaggggtgagaatgaagtttgcagtaataactacatttcagggcatatggtgtggtgctctaacagatacagataacacattagagttcaaaagtgggaatgcagtttggctagtgcaagtggcagatttcctctgccttcatacttgattcatttccaggcaggcatctggaaggttcctagtcatactggaggtggcatacattttgccaacaagcaggatgaaaacctcccccacccaacaccaagccttttccttttccagaacgcctgacaattatgcctgttatgttagttgaacagggatggtttatttcattatcttaaaaggtttcttttaatctactatagcacaacagtgttttaacttaaattcatggccaagaggatgaggtgcaaggggcttcctaaaaataggtattttctactataaaatggactcttgtttttactttggcttgttctccctgtcccagtgggatgaccctcactgagagtagcagcaagggaacctgaggttttgtcacactttgttcttccagggttgctatcagcactggatcttgttgaagtcaatcctcagttggccacctcagaggaagaggcgaagactacagctaacctggcagtagatgtgattgcttcaagctttggtcagacaagagaaggagggcatattgtctatgaccaacttcctactcccagttcaccagatgaatcagaaaatcaagcacgtgtgagaatttaggagacactgtgcactgacatgtttcacaacaggcattccagaattatgaggcattgaggggatagatgaatactaaatggttgtctgggtcaatactgccttaatgagaacatttacacattctcacaattgtaaagtttcccctctattttggtgaccaatactactgtaaatgtatttggttttttgcagttcacagggtattaatatgctacagtactatgtaaatttaaagaagtcataaacagcatttattaccttggtatatcatactggtcttgttgctgttgttccttcacatttaagtggtttttcatctttcctccctcctcccacagcctggctatacagtgcatccttgaactgtcagcccacagcagcaatatgcttattctatccacatccctaacatcatgcattcacaaggtcaaagttctggtccacaaacccttccctatagaagttcaatggctgcgaaagaatttgtagtaaaccaggcctcccaggatggcgagctccagtaagatgataatggaaagcagcagcttgttggttgtcactctacaaagagaagcaaagtggggagtagtcagaagtttggataaccttccttctaaacattttggggttagacctgggaccacggctggatactctgaggctgtatgtttgatcacacagccacttagcaggaagtactcataaggttctttagctgtcacttagggataacactgtctacctcacagaaatgttaaactgagacaataaaaaccaaagcataaaaatggattctgaaatgttgttcaaatagtagttacttcctttaaaaatagcttttctagaaagaagggttagctagaaaaagtaatcaaatagacatccagctcaggatgggtcctgccctaggataagtaactagaagcctgggtaatacctttcaatcccttgtaaacttcttccctctgccctatttttccctttgctctcctatcaacccaaatgggtatgttataaaggtagtataggagcttaaaaattttcctatctgttgtttacataaagaatccaacctctggttctcatgttcactctaggtttctccctagtccacaaggaatttatcactgtaggaaaatcccacccctcctgctagttccatgagtgggttgtagttttgtttcatgctaggccacctgtgcccaaggtcacgtacaataccctcttacccccaacttcaacctcagtggcagtatttctgccctggatttgttgctgttagcactcgaggattttgttttttatttttggtaaagactactgtattggtggcagttagtacaattcaaatattgtcttcaaagaaggacttatttattctctatggactaggagtccatacagagctgaatgaaactgaatcaagtcactgctgtgatgactgaagtcaatcccatttcttgggaaatgaaaccacagccagctgatgcatggcatatgctgtttcactaactgagaaccatggtggctctatacaggaggtcatcagctctaccaccctttagatgcactggaattccattcttctcctgaaacagcttgtgttttctggacctttattttcaaaatgcctgcatgaagcaatgctcatggtcctctgggcaacctgacagtgccagcagattctgcagcatcttgactcagttactgcccaagaaccctgacaactccacaagggttttatttttaaaagtctacttcttccctacaatatagaacttccagaaaaggagctgactcccatgaagggcaagcagagccaaaagcaagtactatgcaagtgaaaactactttctaatcaagattttacaaatatatttcttttttttttgagacggagtctcgctttgtcccccaggctagagtgcagtggtgccatctcggctcactgcaacctccaccccccaggttcaagcaattctgtctcagcctcctgagtagctgggattacagtgcccgccactacgcctggctaatttttttgtatttttagtagagacgggtttcaccatttgagccagactggtcttgaactcctgaccttgtgatctgcccgcttcagcctcccaaggtgctgggattacaggcatgagccaccgcacggggctgagattatataaatatatttcaaggaataggaagctgttattcccatgtgttgccttctctaaagaacatcagctgtgattaaatgtcctttcagtggagaaatttttcactgctccaagtcaaagcagtatatacttttaacaaatgattttatcctgagttatttaattatccaagaccatattccttagcgtctttattctggtctgctgggtggtactgagtatacagggactatgcgtcaactgctgaggtgctttatgaggacctttgtaagtcactattttaagctttttggttgaaagccactgagttaagagaaatttcatgactttaataaaacttactttctggacattgaacggagaatcttccgacttttgctcaagttttcacttgtgtttaccagctgagaagagaaaatagtgattatttccctctttaaaaagtatactctgtacaattgaatatccctagattaacagtaggcattaagggatatatgttgaaaaattccaagaaatcaagccaatttaaatgatggcctttgagtgtaagtagaagaacctggaaaggacaagatattttagtactcatcaagtaggcttaagaatcatcttcccaggttgctgctggggatggactcctgagactgagctaatcttctaccgtggctactccaaaagggaaggcttcaagtgtagccagcagactggccagccagtgactgtagagcaacttaagatttgaatttcatcagccaaattccaggacagcctcttgagttggcatttgtttttgtaggctggtctgttactgcttttgggatctggtttttttctttaccctcttaagagacagttacattgaactgtgaaaagaattaacctccatggaactttcaactgcttgctactaatctggacagctggaggatatttcacctccagcagatggctacttgccatctgttcccattccccagtggccttggtaagctgacctctcagctcgttccttggcttttatttatttgaaacagggtctcactccgtcactcaggctggagtgcagtgctgcaatcgcagctcactgcagcctcgacctcccaggctcaagcaataaccccacatgtccccaagtagctgggatcacaggtgcacgccaccacaccctgctcctttttttgatttttagtagagatgaggtctcgctatagagatgaggtctcgctctagagatgaggtctcgctatgttgcccaggctggtttcaaactcctaggctcaagccatcctcccacctcagcctcccaaagtgctaaaattacaggtgtaagcccggcctccttggcttttaaattcaaccaatctacctggtatgttcaaaaaccaaaacccacacaatctgtaagcaagttacattctccatagcttgccttgaatgtagtactttattgtgaattttcactgaagagggcagggcattactctgacttaatggagaactgaagctattaagaaaatctactcaaatcttcacactgagctagtattttcctgtccaaatcttggccacagtatgtttttcaaattgatttgccttctgctattaagaatacagcattccattggtaaattgtaccaattaaaaaattttgcccgggcgcagtggctcacgcttataattctagcactttgggaggctgaggcgggcagatcatgaggttaagagatcgagaccatccttgctaaaatggtgaaaccccgtctctactaaaaatacgaaaaattagccgggtgtggtggcagacgcctgtagtcccagctactcgggaggccgaggcaggagaatggcatgaacctgggaggcggagcttgcagcgagccgagattgcgccactgcactccagcctgggcgacagagcaagactccatctcaaaaaaaaaaaaaaaaaaaaaaaaattccagctgggcacagtggctcatgcctgtaatcctagcgctttgggaggccaaggtggaatgattgcttgagcccaggagttcgagagcaactttggcaacataatgagaccccgtttttacaaaaaattaaaacaattagccaggcacagtagcacatgcctgtatcgcagctacacatgaggatcacttgagcccaggagtttgaagctacagtaagttaaaattgcactgctgcactccagcctgggtgacagagcaagaccctgtctctaaaaaactaaaaaattcctatgtaggttaactcatttatggaaaggaaaaaataaatgagttatttttctgaggctctcagagtgacagcagactagagatccctgatatagtcatcatttgatttaaatatttgttttctttccacaatgatccagcttaccttactggataatccttagacatttttttccctattacttttttttttttacttttacttacataacagtaaagggttatagtccaggattgaagcataatttataaatctataaactgtggtactattttatgaaatctggaaaacagccttggctctaaataacaggatataagcagatgatgttttcgtaagaatagcagaataccctattagatgtgtgagaaattaaaatctcagattggaagctttgaatccttaagtgccttttgacatattatttctcttgccaaagagagaatgcagccactttatccttattaatttctgtaatcttgtaagtgtagaaatcaggtccttccatctttttttcccctcactgaagcaaaaatttccagtgatgtctaaatcttaggggtaaaattgcttctaagggacatctctcagccaagcaaactaaaaattgagcaaagcggccgggcacagtggctcacgcctataatcctagcactttgggaggccggagcaggtggatcacctgaagttaggagttcgagaccagcctggccaacatggcgaaaccccatctctactaaaaatacaaacattagctaggcatggtggcgcatgcctgtaatcccagctactcaggaggctgaggcaagagaatcgcttgaacccaggatgcggaggttgcagcaagtggagatcacgccactgcactccagcctgggtgacacagtgagactctatctcaaaaaaaaaaaaaaaattaataaataaaaattgagaaaagcataagaacttaaaaaagactattccctgaatacagaactgctgtagcttttggccttagtacggtttccaggtgcagtggccccctaattaccccatacttgcccctttccctgtctgcccagacttactctactcttggtacgttctaactggtctcgttgttcccccagctcttctatgatttctgagccaatctggtcagtctctgtggcaatccgatgagaacgttcaatactttgggtggcccggttcaggctttcagtgccctgcagaagcattgccctttgagactgtagccgattctgaaagaagtatggaagagaaatgttagactttttccattataaattcattgccagcatattcctcatcaccttccccatgttagaagggatatagtgagcaataattttcattccttttaagacagaaccaaagaagctaatgattcttttcaaggtcacagactaaagcaggacctgaaatccaatcaataggatcacaatacccccactccactgccttttacacttacgcgaggcaaggaaagatggattaaaaatactggagcactttccctgtgtttgtaatgaatctgaactggtccatgtgcctcctggactatcaacttctgaaaggtggcagcccagatgtgggagctacctgataatgcatatagcctgtaacttcgatagtgctatgggcaaaccaactaaactctgcagccctagaaaaaggttaattcactgaagattcccactagactggtactgaggattgacggaccatgaataagctattctgttcttcgttttaagcctccagcacctggtatttccaggtggtctcccatccaagtactaacctggcctgactcacttggcttctgagatcaggcaggttcagagtggtattgcctagatgactacattcttctttttcagcttctaaagaaagcatgtagaagtctgagacactaccacattctggaaaaaacgtatgtggttaccctcttggtgagccccagaaagaacttcacctaaggtcaaacaaaaaaccttgagcctgccacactgggggtgatttggtctcagggaaattagtatctggggcttgagcaagcttccccacctgccctaatttctcaactgccctaattttctaaatccccaccgaagttttactccacctgtaatcctaaatacagacagcaggaagaaaaaagtagccttgtcaggccagaattaacaaccactgacagaaacggaggcagctccaagttcttagctgttcaaagcacgcgcgcgcgtgcacacacacacacacacacacacacccaaaatcaaaagggacccagctcacagaggcctagtacagagcaagtgaccactggcagtaggaccatcaaggagccaaaagattggctcccagaacagaagtagcaaggagcattttctttctttctttttttttttttttttgagacagtctcgctctgtcgcccgggctggagtggagtggcaagatctcagctcactgcagcctctgcctcccgggcacaagcaattctgctgcctcagcctcccaagtaactgggattacaggcacccgccaccacgcccagctaatttttgtatttttagtagagacagggtttcaccatgttggccaggctggtctcgaactcctgacctcaggtgatccaccagcctcagcctcccaaggtgctgggattacaggcgtaagccactgtgcccggcgctctgtagcattttcacttaataaatggcatacagaccagtagacgaggaaaccactgaatgaggttcaaataaaaccagttaggttagcgcaaaggaagaaggaaaaaggttttcaaaataaaagatgcagattttcaactgagtaggctaaaaaatgactaagaaaagatcagatcacataaatgaacttcagacagatttggaacaatactttttctgaaggtatggatacctaaattatgttttaataatttctgaaactcgccaggcgtggtgggtcatgcctgtaatcccagcactttgggaggccgagacgggtggatcacaaggtcaggagatggagatcatcctggctaacacggtgaaaccccgtctctactaaaagtacaaaaaaaaattagccgggcgtggtggtgggcgcctgtagtcccagctacttgggaggctgaggcaggagaatggagtgaacccgggaggtggagcttgcagtgagccgagattgcgccactgcactccagcctgggtgacagagcgagactccgtctcaaaaaaaataataataatttctgaaactcataattttaaagcaaaattgtttggacttcctccccaactttggcaacatgactaaagtcacttttacaactcccactttaaccagctccacctgcctgcctgtttccagtctccctttacaagtgatcttctgtcagcttctaatctgtgataatccctcgcgcatccatttgaaaattttaagtacttcattctcaagggatctagttttggcatcagcaatgtcaagccaatatcatcctgaatatctcttaaactataatcaggatgcatcgtgaaacaggatttgtttaaaattgtagtatgagcctttcagtctgcactggtgggcccctttccatttctctgccatgctacttgccagagaatttctactttgtgttgtgtttgtggaagacagaccaaatgcagcacatttaatctttcagacgttttattcctttaacgatctagctgctctagatggtttcagaatacagatgttcaattagtccaattttataaatcagaatcctgaaagctagagagggagtcttgctcactttctattaccacagaataaaatgataaaaagctccttctcgagaagcgccctgcattggctactgtatctcagttgctgggccatcttgacattaaggtaaaggaaagcttggattgattttgtaacaatattctgataaattagaaacctaactgaattttccaggcatacctgagaaagtgattctaaaatttatatgagagaataaaaaagatcaaggagaaaagaaattagatcaatgagtcagaatccagataataagaataggtaacatttacattctactacatacaaagcactgttttttttttattataagactgtattatattaaggataaaaagaaatctaaatatgcatatagttcgaaaggcctgccttaaatagagcagataccaaggggtaacaggaactggatgcagaaaagaggataagggtgaaaaaaatgaaacaagagtctagtatacactgataacatgaaataccccaacaatatagttaatttttgtaccacaggcccttaaaggaaaaaaaaaacaaacaaaacagctaaaacttaccatatgctcattctctacagcatatatgccatatttcatgtctcctcggcctccaggtgtggctgtcaaaggtgtgcttctcacctcccgatggagtttagcaaggtccttccggtagtttcgaagcttagacatcatggggtttcggaaagacaggggtgcataacgtagctcctcctccatctctgccagctgggaaggcagaaagtagtgagcagatagcctggttcttccctcactcatttggaaatatgcctagtttggactaatcaaactacttatttatttggactacaccaagtaaataaccatatgctccatgaggcagggaccatgtctggcatgttcccctcattctgaatgccttgcatagtgcccagcaagcacagagcaggcattcgagtatatgaactgaatgaatgaatggaaaaacagaagtactttatagcttactaaacacttttatatacattctccatttaatcctcacaacaaatcaataaggtaggaaatgctccatttcatatataagacttaaagaaacctctgaagatcgcacaaaaaggagtccgggccaggcacagtggctcaaacctgtaatcctggcactttgggaagccgaggcaggaggatcacttgagcacagcctgggcaacatagcaagacctcatctctatatatatataaaaaattaaacagaaaaggagtcaggattcaaaatcttcaaattctctcagctctcttcaatataccaagtttttagcctggtatgattgaacattgccatcaagaagtgctttgaagtctactgtattaaaaatgataggggtctggcatcagggttcttcccttctcctgctcctctttctgaaaatcaattaagtttgtctccatgtcagagagaacaggggcctacccagagcagtctgctttaggggaatcagacttccatttttctggggtaagtaaaatgtaacacctggacacatccacaagaggccctaaattattttcatctgcctggaatgggcagcataggattattacttttgctgagtttggagaaaacaagtatctgagcatcaaacaaatcagtagcagctagaagattttaaaaatgctaccaaggtattaactgaaacaggagaatggctacaaacaggtatcatggatatgcccagctgtacacaggtattaagaaaagctcccagtactcccattaggaagaagatagttcccacagtctagtggcctggtctttcttaaaacagatgcaaaacagagaaaaggatgcagatgtgcttccttctcagaacttcattgggataagtgggaaattgaaacactgatcttcaacaagcaagaaggaagttcgctggccaaaagagaattttttctccatctgctctcgggtagcaaatacagggccaactatttctgcggagtactagcagcgaccagaattttggccccaatcttaatgagtttgctgaagctagagtatgatgagatggagtcaaaggactcttgcttctatagggctagagcaaaaaaaaaaaaaaaaaaaaagttttttttttttaaagaaaagccacaggtgaagagaagcagttgttaaactgttcagtaaacggaaccaacttctgacaaactttgggtaccaactgagactcatgcatgtcttgcctgaggtaccaactccagctcctatgttgtctcttaagacagaaagggacatggttagaattacctctaaactacattttctgtgacagtaggtttaacaaagaacagtaaccttttttttttttttttttttttgaggcaggtctcactctgtcacccagactggagtgcagtggtgcaactgtggctaaccacatgcttgacctcccaggctgaagtgatctcccacctcagcctcctgagtagctgggtccagaggcatgcaccaccaaacctcggtaatttttttttgtttggtagagatggggggtctccctatgtcgcccaggctggtcttgaacttctggcctcaagtgatcctcccaccttggcatctcaaagtgttgggattgcaagcgtgagccaccgcactgaccagtaacctatcttaatggccagctcttaaaaacagattttaggccaggcacggtggctcatgccttgtaatccctgtactttgggaggccgaggcgggcagatcatgaggtcaggagatcgagaccatcctggctaacacggtgaaaccccatctctactgaaaatacaaaaaaacagccaggtgtggtggcgcccacctgtattcccagctacttgggaggctgaggcaggagaatggtgtgaacccgggaggtggagcttgcagtgagccgagactgtgccactgcactccagcttgggcaacagagcgagactctgtctcaaaacaaacaacaacaacaacaacaaaaaaaaaaacaacagattttaaaagactgcttgggtaaaagtatgagaatgcccttactactcacatcagcaatatattaccaaagagtcacatttcaggagcatcttcaggcttcacccatttgtttgccaaaccccctcaacaaccatccccatcaactggcttcatttagtaagaaatagtcaaaatcaagatcaatggacaggaacagttaatttgtgatcagctcatagcattacttctggaaaagaccaacaccaggtagaagaaacaaaatttgttccttgttctcaccgtttcatttgcttcctgttgcttttcatcaaaatccctgatcaatttcttcttttcttctagaaaagatagataagtttcaaatgcttattactgtttccacacatttgtaaaggccattccctctgcttcgaataagcttcctatggcagggcctggtggctcatgcctgtaatcccagcactttgggaggccaaggcaggtggatcacaaggtcaggagttcaagaccaccctggccaacctggtgaaaccccatctctactaacgatacaaaaattagccgggcgtggtggcaggcacctgtaatctcagctacttgggaggcagaggtagagaaatgcttgaacccaggaggtggaagtggcaatgagccgagattgcgccattgcactccagcctgggcaatagagcaagactctgtctcaaaaaaaaaaaaaaaaaaagaatgtttaccaatagtgactctctgaaacccctcaccactcccacagtgaaccacttctatgttaactcgtacactacttttctgcaaaataaaaattccacctactcggcttgctgagaggctgtctggtgtggtgcttgtttttctctgggtgtggcaccggcaatgacttgaacgatgagaacgttattcattcccctttcagcctttcccattctgtccctttggttgagtgtatctttaatacctaaaaattactaatctcccctttgaacaaaaatagaacaggcttcagcttcaaaacaaacatctaactaaaacagtattgtcttaattgtattttctgatagtttatactacaggttttccatctaaaatatgatagcaagtttcatttttaaataacattgttttaaataaatgtattttacatgaaataagttgacataaagaaaatgtaagtgacaaggctgggcacggtgactcacgcctgtaatcccagcaatttgggaggccgaggcgggcggatcatgaggtcaggagatcgagaccatcctgcctaacacggtgaaaccccatctctactaaaaaatacaaaaaattagcctggtgtggtggtgggcgcctgtattcccagctactcaggaggctgaggcaggagaatggtgtgaacccaggaggcggagcttgcagtgagccaagattgtgccactgcactccagcctgggcgacagagggagactccatttcaaaataaataaataaataaataaaatgtaagtgacagtaataatgatacttgcggatggcaaaaattatgaaggtggtaccagaatgctgtcacctggtaaacatttgtatgggggaaaggcatacaagcaccttttctggttagtcagcggggtgaggttctggtgccaggttcgggcctgcctcagcatgtaaacttagataatttccttcatttctttgggacctcacattctccttcattgactacaaaatgaggaagtaggtcattcccttatatctaacaagcaaaaattagctccttttaagaggagcttgattttttaaaaaaatttatacatccaaatgactgttctccctggaaatctacacataatctacttatcaccataaagttaccatcatttacaatgtttgtttgtttgtttcaagacagagtctcactggtcacctaggctggcaaaatacatgtaatataaaatttaccattttgaccatttgtgagggtatagcttagtggctaggtacattcacaccgttgtggagccatcaccactaactgttctccagaacttgtttatcctctcaaactgaaattccgtacccatcaaatacctccccattctatgaatttcactactccaggtacaccattaagtggaatcatacaatatttgtcctttgtgtttagcttatttcacttagcacaaagtcaaggttcatctatgctgttgcacgtatggggatatggccttttaaagctatgtatttttcaatgtgactcctaaacacaagccagcagcacttccaccaactaaagagcaatttttttttttttcttgagacagagtcttgctctgtctcccaggctggagtgcagtggctcggtctcggttcactgcaacctccacctcccaggttcaagcgattctcttgcctcagcctcccgagcagctggggttacaggcacccaccaccatgcccggctaatttttttacatttttaataaagacagggttttgccatgttggccagtctggtctcaaactcctgacctcaagtgatccatccacctcagcctttccgctgcaaaagagaacagatgagccgggcttatggagaaatggcatgtgggtattcagttgctgtcctgagattttcttagatgatttgtctactctgattttcatcttaagacctggctttttttgagactgtgtctcactctgttgcccaggctggagtgccgtggcgtcatctcagctcactgcaaactccaactcctgggttcaagtgattctcatgcctcagcctcctgagtggtggggttacaggagtgcaccaccacaaccagataatttttctattttttggtagagagggggtttaaccatgttggccaggctggccttgtgtggtccacccatctcggcctcccaaagtgctgggataacaggtgtgagctagtgcacccggccaagccctgacttttgaacccaatcctacataagatgtaatgtcactgtaatgctttatatggatttacattttgttaatcacaacagcatctaatgtcagttatatctttttttttttttttttttgagacagtctcactcaggctggagtgaagtggcatgattacggctcactgcagcctcgacctcccaggctgaagcaatcctcccacctgctcaagcaattctcctgcctcatcctcccaagtaactgagactacaggtgcaggttaccacacacagctaattttttttttggtagagatggggcctcactatgttgcctaagctggtcttgactcctgggctcaggcaatcctcgacctcagcctaccaaagtgttgggactacaggtgtgagccaccacacctgtccttgtatcccactttttaagtgaccataaatcattttggatgcgtatattctataatctcaacttgagaccaagttcctctgaaacatggaaatttattttgtcatttttactgtgccatagatcctagaactataaacctccttagatgtggctactgcctgaaagggcaaatgacaacacaccctttactatgtctcattcattgttgtgtgccacccccttaatatacacaagatacttcagacaattttctccataccactcacaaaacccatggctgtttgttgtttaaaaaaaggtagaggaaggttcaccatggcaaatggtatgactcttgaccatctatgatgtaactgaaatgagcaccaaggcagctattactgttcctgagggggatgtgttcttagctaccagtactgaaataataccgacagtcaaaaacggctacttccatggagcagtattgtattattttgtaataagctgtcccaaaagtgctgagcatcatcactgctctgagtcagcacatctccaaactcaggcatgctcactcctgatccaagccagacagtaagaagcagtactgtacacatatgtacattcccttcctagctccttcctttcctagacttttctacaactgtgtttagtcataaattctcctcctttattcttcctttgttaatgggtatgaaaatccgcattctcaagaggcaaattctagaatgattccaggaatgtaactacataaatgaaagggggagaagaagaccacagaacctctctcctttcactaacttctgtgtgctagaatattccatttcctacctgatttcataaaacacatttcctcttataagtgctctataacaacatacttttacagaacttcactacatttatgagatcctttctggacttctaagatttaaaacaaaacaaaacagaaacctttgaaatcatttcttgtgatgataaagccagggaggcagataattcaagagactgatctctacccaactgagagggatcaatagcagctttttaaaaattctttaggctcagaattatgaaaccaatgaatgctagagctaggatgtacctcagcgatcatctagtctaacttcctgcctttaccactgaggacactagaccctggagaaactgagtgcctgccccacagtcattggaacagcaaatgtatggcagcactagttctggaatgcaagtgtgctgactcccagtccaaggcttttctgtatattaaacaactgtatactgtatacaactgaggggcatttttgtgctcccagagtatagcctttaacaactggtaaaatctgttgaaaaaacaaaaaacctcttcctctttttagggagttagaattgatgctacaatcaactacaaacagcaaggtggcatcctggggagaatgggcaccatgaacaagaatgaaccacttcaaataccactatcccccaccccacaagcctgcccaaatcagtcacatgtgagggactctctgggaccaactctgtctcctttgggaaactgggtggatgctgacatggagtaaaatggaaacagacagctctgaaaaacagcactacagaaagcctaccttaatgtttgaccaaggtgggcagcctctcttccttatggggatttgaatttccagcccaagaatgcctaatcttggccctttaaagttgtggaaacaacttcagtttcaccagctcataaatatgtggttactttgcttttggtgcctcactgtggcaaaatggaggacttacaccctttatttgtacaccgtgacagctgactagatcccacaccatacaagagttaaaagcaacagagatccctctcaaccaacctgtttcctcatctgcaaatagggactataagactactgaccttgtaagggttgtttgaaagggttaaaagaaataatacacataacattcacttagcaagtgccaaatataataagggctcaataaatagaaaccaccattgtttctgaaagtaaatacttaggaagaacctaagagcaaaaaccaaattcagtagaaaatatgaggagttagaggccaggcgcggtggctcacgcctgtaatccctgcactttgggaggccgaggcgggcggatcacgaggtcaggagatcgagaccatcctgggtgacacagtgaaaccctgtctctactaaaaatacaaaaacttagcccggcgtggtggtgggcgcctgtagtcccagctactcgggaggctgaggcagaagaatggcgtgaacccggaaggcagaagttgcagtgagccgagatcgcgccactgcactccagcctgggtgaaagagcaacactccatctcaaaaaacaaaaaacaaacaaacaaaaaaaatgaggagttagaatagttaaaattctacagtctgtaagtaattggtgtttatcggccagctgattatagtactccatagtgactattttttctggctctgaaaataatagggtcttgtgttatacatactgatctaaatgatttaaaatggaaaactttcaatatttttatgatacacgttaagacatatggagagatgtcttcaggtatgacaaaaccaaaactagaaatcatgaccacaggcatttaacattgattagattaagaaattatagcacattatagtactctgaggtaattggagagacctcttcagaggttgtaaaaccaagagtagaaattatggccataggtatttaatgaaatattaaatggattaataattattgtaagtggtaatggacagttacacaaaaacttcctaaaacaggacacattgtctctagtatcattcaaaggcagaaagtgaatggagactgtactttggagaaatacagtttttgttgttttaataggtggaatatacccatttttaaagtaatgaaaatgtggacaacagaatagaaataaatcacaatcatatatcaatattttctttccaacaattcacacattccatcatccaataggtatctatgaagcacctagtctgtgctaggcactgttctggtacttaggaaacacagtgaaaaaaagacaacattgagcttatattctagctcagtggctttcacacttagccttcatcagaaaccccctggagggctgtgaaaacacactgcttgttaaaactttctgattcaataggtctggggtggggcctgagaatttgcatttctaacaagttcccaaatgatgctgatgcagctggttcatggaccacaatgaaaccactgtcctagtgaaaggaagacaaacaatatactgtaaatatcataaatgtggaaagtgtctaatatgtcagaaaataagtactctggaaaaaaaaaggtaagaatagttgtatacagggctggtattcttaattttcatttaaataaaatggctagtagctctattatcaggcagtattctaaggactttacatatattaactcatttactcctcacaaaaaccctgtgaagtagatactatgatttatccccatttggcaggaaaaactaattgggttaaagtaacctgtccaaggtcacactgctactagaaggtgaatttaaactcaggcaatctggctcttgaattcttgctgttaaatattatactatatggcctctcaattcacatacttcttcataatttttttttttttttttgagacggagtcttgctctgtcacccaggttggagtgcaatgatgtgatgacagctcactaaaacttcaaactgctagactcaagtgatcctcctgcctcagcctcctgagcagctgggattacaagtgagcagcaccacactactcagcttttttttttttgtagagataggtctcaccatgttgccaaggctggtctccaactcttggcctcatgcaatcctcctgcctcagcctcccaaaatgttgggattacaggcacgagccaccacacctggcccccgtatgttatttttaatggcagaagaagaaacattttgtaaggctatattatgtcatgatctctgttctacaggtacctttgatattctcatccacaacccaaactctgcttctcctcttatgtttcttacttaagttcatcattcacccagttgaccaagtgaaaaaatgcagacaccctggaacctttctccctcactcctcatatccattgaggctggttaatttctgcctcaaaaccaactcttgggccgggaactgtagctcacccctgtaaccccagcactttaagaggctgaggtgggtggatcacttaagcccaggaattcgagaacagcctggataacatgggagacccttactaaaaatacaaaaaattagccaggcctggtgccatgcacctgtggtcccagctactcgggaggctgaggtgggaggatcacctgagcccgggaagccaaggctgcagtgagcagtgatggtgccactgcactccagcctggatgacgggagacaggagtgagaacctgtgtcaaacaaattcccgttagcaaggtgactgcccaaaaggctcttaacacagtcccctgtacccagattcttgtgctctctcttgtcctgtctagccattaatgccctccttctaaaagaaaatccacatcaatcaactgctttacgtcctttactgactttccatatcaagtccaaatgtctcaatgtgacactgagatcccctcacaatctggctgtttcacctgcccctctactactactttcccacatacattctaagctccagagttgggagtattccatgttttactcctgtgttgcctcttcgcatttcccatctagcaaactcccattcaatcccttatattcagtttgaagttttttgaagcttccccctcttccccatgctcaagtccagccctttttatggtctcagagaactttattttaggattaatcacacacttggttgtaaggtttgttacctttttttttttctgagatagagtctcgctctgtcgcctgcaatctctgccccctgggtttaatcgattctcctgcctcagcctcctgagtagctgggactacaggcacatgccaccacacccagctaatttttgtattttgagtagagatggggtttcaccatgttgaccaggatggtctccatccgtgaccttgtgatccgcccgcctaggcctcccaaagtgatgggactaccagcatgagccaccgtgcccggccgtttgtttctttttaaggtaagaactctggaagtcctcagagcctagacagtggctgatacataataattctcagtgtttattgaaaaatgactgaattcaattacagagcataagctacatgcaaggactgtattatgtacattatgctgtgcctaataattcatgatgggcattaaagctctgaaaactttatgatgtggtctctgaactagaaaaagaggattcagagatgaggcaccatgtgtttgcttagataaattcaatttattcaacaaacatttattgagcagtgtgaatgaggtagtgaataagaggtaaagttgttggacttattataattctagggatatgtatatattttctttacttatccattaaacaactatgtctgttaccagcaacttagagtattttgtggttgggcgcagtggctcacacctgtaatcctagcactttgggaggccgtggcgggcagatcacttgaggtcaggagtttgagaccagcctggccaacatggtgaaaccccgtgtctactaaaaatacaaaaattggctaggtgtggtagcatgcgcctgtaatcccagctactcggaaggctgaggcatgagaatcacttgaacccaggaggtggaggttgcagtgagctgagattgtaccactgcactccagcctgggcgacagagcaagactctatctcaaaaaaacaaaaaaaagaaagaaaaaagaaaagaaattcacatatttctgattgtcctctttgcaggatggagaaaaaggctgggtagacaacaaaggtgaatgtaactatcttagctttatgttgctataacagaatagctgagtctgggtaatttataaagaaaataaatgtattt

SEQ ID NO: 1787 - DNA, 348747 bp, Homo sapiens
  IGF1R gene - 97010288 - 97319034 of chr15; NCBI Entrez Gene ID: 3480; Build 35; sequence includes 20,000 bases upstream of initiation codon and 20,000 bases downstream of termination codon of the gene
atcccctgtgacccagctattccactgcttggcaaacaccctagagaaactcttacacgtgtgcttaaggaaacaagtgcaatatccttcactaaaattggcaagtgtataggggaaatacagttggagcatgctgctcaaaacctatagaactttgtcaccccagcactaacaaaagctaccatgttttaaaaattatgacacaaacagagttggtcccatgctggcattgttcccagcatcccaggtgcctgtccttttcagccttcaacccgaggctcctccttctgggacaggtaggtagagaacattttcatcaaaattaaaaatatggcccctggactgtattttttaaggtccgaagttttaatacaaggagaaatgcttccaatttctttttttgtttgtttgtttttgagacaaggtctcgctctgtcgcccaggctggagtgcagtggagagatctcagctcaccacaacttccacctaccaggttcaggcaattctcctgcctcagcctcctgagtagctgggattacaggcgcccgccgccacggccagctgatttttgtatttttagtggagacgggctttcaccatgttggccagactggtcttgaacccctgacctcaagtgatccacccgcctcagcctcccaaagtgctgggattacaggtgtgagccaccacccctggctgaaatgcttccaatttcttaacgttattcttctgcacccacagcaaaaccatatagcttaatagctctatggaaaacatagtgctcctcgaagtcactaaccctgtaagtattcgctccgaaggaagacattttagtagattttcagctccaggtctgtattcattgctacgactttttttttttttttcttttttttgagatggagtctcctctgttgcccaggctggagtgcagtggcgcgatcttggctcactgaaacctctgcctcccgggtttaagcgattctcctgcctcagcctctggagtagctggaattacaggcgcccgccaccgcgccccgctactttttgcagtagagacggggtttcaccatgttggccgggatggtctcgatctcctgatctcgtgatccacccgcctcggcctcccaaagaactgagattacaggcgtgagccactgcgcccggccgactttctcttttaattgctttaaaacagtaacatgttgtggaaaatcatgtgtaagctaacatgacttccgtgttctaacatcctccccttatttaccaactgtgtgttaggtaatttgtacaagaagtaacccgagttgtaatgaggatgtacatttcagcattgtttgttatagcaaagagctgggtagggaaactctgaaagtctctcacttggcagtggtaagtacaaccctgtatattcacatcatgggatagtatataataactaaggcaaatgagctagatccatgtctatcaatatacattggtcttgaaaacataatattagtttaaaaagcaaggtgcagaacatgtaaagttagaaaaataatgaaacaatactaaggattatatgcagcaaaaatataaaatgcaaatcagaaaaatacataccaaaataatggtcatagttttctctgtagtgggcaagaggaggataaaatcatggaaagggacttctactttatctctaaattttatttcttttttgagatggagtctcattctgttgccaggctggactgcggtgatctcggctcactgcaacctccgtctcccgggttcaagagtttctcctgcctcagcctcccgcgtagttgggattactggcgcccgccaccatgcccggctaatttttgtatttttagtacagacggggtttcaccatgttgggcaggatggtctcaacctcttgacctcgtgatcggcccgcctcagcctcccaaagtgctgggattacaggcgtgagccaccgtgcccggcctctaaattttatttcttttaaaccaacaaaattcaaggcaaaaatgagaaaaatgttttcatttgctaaatctggctcatgggtaaagcgtctcttcaatacttttctccttaattttctgtgtcaaaattttttcccaattaaaaaaataggaatttaactcagtttggtagacatttactgaatgcctagtatgtgcaatcacacccctaagtaacactggtgaaagaaatgacaaactctgctgacacatcatttacaaggagtggagacagtaaagaggtgtgtgagaataggaagaaggaaaagctaattccacctctggggaaccagggctgctcctccctgaaagacaccaggcttcgtagagtgagtgagtgaacagcgttcaggaaggagttttttctttgagggatgacatgtagatatagaaaggtttctttctaatggaaaacccaagaaaatgaaacaaaagaacccaatgatttcatcataaatggcacaagaaacccaaattccgctttttttttttttgagatggaactttgcgcttatcacccaggctggagtgcaggggtgcaatctcggctcactgcaacctccacctcctaagctcaagcgattctcccacctcagcctcctgagtagctgcgaccacaggcacacaccacaatgctcaactaatttttgtatcttttgtagagatgctgtttcgtcgtattgcccaggctggtcttgagctcctgagctcaggtgatccacctgcctcagcctctccaagtgctgggattacaggtgtgagccaccatgcctggccttaaatgtaatttaaataagacggaatttgaattccccacccatggaaagaagttaactccactttgctcaataaattcattttgtaaaacgtattttaaaaatgatcactatgtctgtgtttaaggcagactttgtaacgctataatactgtaagttgcatatttaacactataatactgaaagttgcataagttcttgggaacttatgctctcctttgacttcagtttccccgtctataaaaatgggtatgaaaataacgactatttctgtttgttaaggaaatggaggtggtgcgttgtgtgcaatgtctggctaagagctggtactcaacaaagttactttcctcttcttctgtaagaacctgtttatagatagagcgagactccatctcaaaaaaaaaaaaaaagaacctgtttatacgagcaatgtctacattgcactagttacaacaaatatttcttatcgattcattaatgtacattctcttttatcacaattttttattttaataattatttttataattttgaaaataacgaaagctacaatctgtttaaaggattctgcagtataaatccttccctagttctcagagttttcttgtaacacagaggcagtgaacactttggtgttcaaagtacatctgcaaaaggccttagaggtctctgaaccctagaaagtgtttgcaaaattgtgtgtatgaatagagacagatttttccagggagaggacccatgacttttattagattactcccactttactccaactgctactataaccttatattgtgtgtcttttacaataactcagctttgcaactatacaggaaattgaaaactacttgcccacctttatgttaataaaaaaattaagctggtgaattagactggggtatgaggataaaagagaatatattaacttagaaaagaaaaagaaaggagcatgctacagaccaataacaaggaagatgaggcagggcatagtggtgcacgcctgtaatcacaacatggaggttactcgggaggctggggtggggaggatcacttgagccccagaggtggaggctgcagtgagccatgatcatgccactgcactccagcctgagcgacagagtgggtaccatggctcacacctctaacccccaaattttgggaggctgaggagggaggatctcttgagcccagtagtttgagaatagcctgggtaacatggcaagatcctgcctctacagaaaattaaaaaattagctgggcatggtggtgtgagcctatagtcccagctactcgggaggctgaggcaggaagatcacttgagttcaggagaacaaggctgcagtgagctatgatcgcggcactgcactccagcctgggagacaaagcaagactccatctctaaagaaaaataaaagacaagaagtgaaaagaaaatagaagtaaacagcagctcagcgatggcatctaataaagtcttcttctcctctcctttttcctactaccctagttgtagaccaagaggaaatatttaatgaaaattcaatgcctttattgcaaataacaaaatttggagagtgaggaaacgtttttttcttttcttcctcttccccttcctcctccccctcctcctccctccctcctcctcctcctccttcttcttcttcgtttttttttttttttttgagatggagtcttgctctgtcgcccaggctggagtgcagtggcatgatctcggctcactgcaagctccacctcttgggttcattctcctgcctcagcctcccgagtagctgggactataggcgcccaccaccacacctggctaattttttgtatttttagtagagatggggtttcaccgtgttagccaggatggtcttgatctcctgacctggtgatctgcctgcctcggcctcccaaagtgctgggattacaggagtgagccaccgcgcccggcttcttctttcttctttctttttctccttcttcttctttttctttagagacaagagccttcctgtgttgcttaggctggtcttcaactcctgggctgaagcagtcctcctgcctaggcctcccaaagtgctgggattacagtgctgggattacatgccacctgcacatttctatctttatgctctaagtgctgcagatttgggggaagctctagctctgatgggaaatgtccggacctctttaattttcttcaccctgttccacaggtcggcgtctttatgccttcatgcgcccttctctcttcggtctctcaagagtaacttggtgctttcttctctgtggtcttcggagttctgcttattcctcttcctgaggccaggagactgttggctgtcctagtgatctgatcgcatcaacacccactttttcttcttggaagtggccatggtcacttttcccatgggcagggaagagcagcttctgaggattacacggagcacaaaggccacggaagctcccccccagtataggggtgggatcttagcacctaccagtaggttttagcttcagaaggagggccttgggtgctctgcctgtagggagccctaaaaccccatccgcagcatggcaggacaagccagtccccagcctccactgtcctgaggcgtcccctcctctgcccgcgctctctgcctcattcgtccccaccccaccacatggtctcctcttaggggatctcatgataggcagtggttttcaaacttttcagaaaaagtggtggaatcattcatttcaaattaatttttcatccaaaatctaatgtataaaacagcttgaagccaggcagagcttggatggtgggattggtcatttctttacctccttaacttcctttgactcctccacaaccccttcttttgacaacccccaggaggggctatatagcacccctcagattccagggacaccactgaggagccattgatggaaggaagcaaagcagtcactgctggccgggcacggtggctcatgcctgtaatcccagcactttggaaggctgaggcaggtggatcacttgaagtcagggagttcaagaccagcctggccaacatggtgaaatcctgtctctactaaaaatacaaaaattagcacacccgtagtcccagctactcgagacgctgaggcaggagaattgcttcaacccgggaggtggaggttgcagtgagccaagaccgcaccattgcactccagcctggacaacagagcgaaactccatctcaaacaaaaaacaaaacaaaacaaaacaaaacaaaaacagtcactactcactattcctgtcaaagttcttgttcacaaacagcaacatccaactgtaggcccttgatcagtacaggaatttattggaagactacactactggatagctgagaattataaggaaggctgggagaaccaggctcaaaaaaaggggaaaggaccatgggggactagatcagctgagctctggccacgcagtttatgttctgtgcagttccagagcatcagtcactatatttgtgcagtgccacccgggtaagttccgagcagggtccttgtgacccccttcagaggtccgtggtgtgcggatgctgggcagcccagaaggacagtgtccttcctgcttctttgtgccagctcctttatttatttcagctcctttcatcctctccagagcccatcctaaaatcaccgggggaacctcgttaaaatgcagatttctaggctctctcccacgccaccacctacctccccacccccaggatcctgtctgataaaaaagttctgggtggcagcctgggaagttccatttaacaagcacctcagctgattctgatgtgggtggcacaggaaacacattcagagaaacactgccctgcatgctaagctttatgattgctattttataaaggggtaaagtttcactcacccaggatcacatagctggcaactgaattcagacccttctggctccaaagtgtatgcacttttcaccatagtcaagacatctctcttcataccggtttctgaaacttcagtttttttcctgttccaaatgtcacttcatatgtttctttaaattgattttattaaaaataaaactggccaggcacggtggttcatgcctgtaatctcagcgtcttgggaggctgaggtgggtggatcacttgagcctaggagttcgagaccaacctgggcaacagcaagaccccgtctcttaaaaaaaaaaaaatcagccgggcatggtggtgcatatctgtgatcctaactacttgaaaggctgaagtaggaggatcgcctgagtaggaggatcgcctgaggctagagtttgaggctgcagtgagctatgatcgtgccactgcactccagcttgagcaacagagcaagacaccatctcaaataaaaaataaataaaaattggccgggtgcggtggctcacgcctgtaaccccagcactttcggtggccgaggcgggcggatcacgaggtcaggagattgaggctatcttggctaacacggtgaaaccccgtctctactaaaaatacaaaaaattagctgggcatggtggtgggtgcctgtagtcccagctactcgggaggctgaggcaggagaatggcgtgaaccggggaggcagaggttgcagtgagccaagatcgtgccactgcactccagcctgggcgacagagtgagactccgtctcaaaaataaaataaaataaaataaattttaaaaaaaccctagattcattttttaaaaaaagttattattttcataaatagaaaaccattattacttgctattcgctataaataggaggtaaccataaaaacaaactggcaaactgagtgcagtggctcttgcctgtagtctgagctactcaggaggctgaggcaggaggatcacttgaggcaaggagtttcaggccagttgcccaggcaactggtctttttttttttttttttttttaaatcttttaaaattagtcgggcacggtggtgtgcctgcagtcccagttacttgggaggctgaggtgggatgattccttgaacctaggagtttgaggccacagtgagctattttattttaaagagacagggtctcactctgtcacccaggcagtggtgccatcatagctcattttagccttgaactccttggctcaagccatcctcccaactcagcctcctaagtagctaggactacaggcctgagccattttgtctggtttatttatttagttttttgttaagatggggtcttggtacgttgcctaggctggtcttgaactcctggcctcacatgatcttcctacttcagcctcccacaatgctgggattacgggcatgagcaactgtgcctggcctgcagtgagctatgattgtgccactgcactcccgcctaggcgacagagcaagacctgtttcttttttttcttttttttcttttttttgagatggagtcttgctgtttcccaggctggagtgcagtgacacgatctcggctcactgcaacctccacctcctgggttcaagcaactctcctgcctcagcctcctgagtagctgggattacaggtgtgtgccaccatgcccagctaatttttggatttttattagagacagggttttgctatgttggtcaggctggtctcgaactcctgacctcgtgatccacccgcctcagcctcccaaagtgctgggattagaggcatgagccaccgcgcccagcgaccttgtttctaaacaaacaaacaaagtgaactgttagtgacagatcctgaccattctgaaaagaacagggctgaagtagtgtagccttcagacttggttacccctagtcctactccaaacacacacacacacacacacacacacacacacacacacacacacacggcattcatgcagtatacatgaagctttcttaacctgaggcccaagtatgggctcagaggagggaacagtttttgtgctgtttgatctattggaatgttttcctgagctgagcatccattgcccacattcgagtctcaaagaggctcactattgaaaaaggtgaaaaattgctgtttgaagtgaatgtttccaatctcgcttttctctttagcttatgttacgtgattcctcctcccacctaattttcttcaaggatcccctcccactgtgtcctggacttggtgctctttatccctcacaactgggtttcacagacctgttctgaagggacatttggcctgtgtttccatgaatgccccctggaagggcacaagacaagcatgtcctggccctgtagagaggtctgtgctgggaatggatcatgacatgaaacttcttctccctgcaaatgtctgctttgtaaatagtctgcacctttggtctggatgctgtaataagttgaagcatttcttagcagcatttatttttcttcttaaaaaattataaattgaggctgggcacggtggctcacacctgtaatcccagcactttgggaggctgaggcaggaggaacacctgaggtcaggagttcgagaccagcctggccaacatggtgaaactccatctctcctaaaaatacaaaaatcagccgggtatggtgccaggtgcctgtaatcccagtttctttggaggctgagacaggagaattgcttgaactcgggaggcagaggttgtagtgagccgagatcacaccactgcactccagcctgggcaacagagtgagactcgatctcaaaaataaaaaatacaaattataaattgaacaatgagtaaatggatggcagatggtgagaaccagggttctcactaatggatgggagcaagggcaaggggaaggaggctaggatgatccgtgtgctaatggagcagttggaaacttcagtaggaacttcgtttggcttcacagagatacagatggttacatattgaaatattttcagatatgtgtaaatacacaagttagtatgcacagatgtgtttccttatttcgtcagctgagaggacctagaagcaatgacaccccagtagcaacaagcacacctggcagctggcttttggtttctgaaagcgttttccagtttccactggaaccagggctccttggagaagtaactgattctagggctgaggcaggagatatatgagatcagcctggagtatcttgtagtgccggaaactaaaattgctaaaaccaaaacaaaacccaaaatgatgggggtatgtcaagtggacccaagaggcaaatgaaattactcccaatagccaaacctggaacaatctgagcaacataataaataaagtattactgggttataacccaaaatatgaaataaatatccacaagcctgtactgatataaataaaaagttattatataaataaaggagaatagacaaacctgctgtgcagaagaattgtagataacttacacagatatgtttcccttacggaggtggagcataagtgtgggataggcagagtgactttctttcaaagagtacaacatataaagagagagaaaaatagagataactttacagtagaaaacttgatgaacatcacctcaggcaggtgatcaatgttaacatcatgttgatagcatgtacccttgttatgatgtgatgagaacagcactgtacctctggagtctttctcccagaaacacattatccaacatggtgaaaccctatttctactaaaaatagaaaaaaaaaagaaattagccaggcttggtggtgggcgcctgtagtcccacttactcgggaggctgaggcaggagaatcgcttgaacccgggaggcagaggttgcagtgagccgagattgcaccactgcactccagcctgggcaacagagtgagactgtgtctctgaaaacaaaaaaaatcatcataataacgatgtcttaatattggttcattagttatgacaaatgtcgcatagcagtatgttaataatatggggaactgggtgtggttatatgagactctctgtactacgtttgcaacagttctgtaaatccaaaactattctctactaaaaagtttattttaaaaaagacaaaggaaaaatttataaaacagttcaagcctacaaaaaatacacaaaataacttacagacacacatgtacctgccatccaggtttaacagatattaacattttggatcatttgcttcagatatcttttgtcttttaaacaaataaaaggttgtcagtatagttaaaactattctctattttttatctcttccttcatcctgagagataatgtctcactgacgttattatctcttccatgaatattttatacttttgatacatatgtatgtatccataaacaataatgctattgtttttgtattgatagttacataaacagtagcatatcattatttaacctttgcaaattgctctttcacaccatattggctgttaaatctatctatgttgattcgcttagatctagttcattcattttaacctctgtatagtattctccctattctaccgtacaagtaaagcaccattattcatccttccactgaaggacacttagattgtgtctagtattttactattgaaaacaatgttccaattaacattcttgtttgtgtctcctggtgcatatatcaagagcttttggggtatcctccttatgaatggagttgctgggttgtggagcaggtgtatctttaaccttatggatattgccaagctgctctccaaagggtatgtactaatttattttcccaggagcagtgaatgagaatgcaattctccccattcatccttgtgaacagttggtactgtccaattgttaattttgccaaccaggttgctgagtatattttcatgcttattggacgttctggcttcttttgtgaattttatgtttatagctattgctatttttgtactggtttgcttataatgttcatatgaatacatatttaatttcttacagaggcaacacaaggttttcagctatcttagcccagcgatgtatcggagcaggctcacactgtcttacaagagacaactgtgcacaacttttcagacttctgtatccagtgaccttacattggtagctcaaattggccatggtgggaatatttctacaagggaaattgggaaactgcagatcttggctttccccaccccatagtccatgttaagcatttaccagcgtaccactatcttaacctccaccttggcccaagcatctctcacaatatgactgacttgaaaataaatcttgatctaagttggcttttcagtctgttggaactgggccttggacctctttcaggagcgatttcatcagggtttctgtaatatatgagaaattcaatatccttttgaactaatgcatcttctactctgaagtggatcactattcatttaaagcaaagtgagggtccttcggcagctcatcagtcacagtaatccaagcacagagtagaatccaagtatccagtgatcctggaactggaagggatggcaaatgtcaccccccaccacacacacccctaccatcttctcaatcttgtttctttggacaatttccacagcaggtatcagttcagtctctgcatggacattctgacgacagggatttctctcacaccacgtaactctccaagcagagactgcaaaataatactgactttttgtttcaattggaaaagaagaaaaattctttaaaataaatgaaatctgttttccttcccgttagtctagttctgcccattggcattacctggatcaagtcgaatgaccaatgggcagagctagactgatgggaaggaaaacagatttgaaaagtctaatgacttcttcaggtatttgaaaccagaaatcatatacgacctctcttaatgtctatgtgtcttaataattcctcatggatgtaggaaccagccttttccaggttcaggtccctgtggtccctgttcagttctctggttgatcaatggtactccaagaacaaatataaacaacttcattctgcagctgattctccaaattgcagagctgcagatatctgcataacttcaaaatcaccttattctgtagcctgttcatgaggccagaaatagagtttgctgctagtaaggagcctgacacaatgatgttgcatttaaaaatgtactgaagaaatgtgcaaatatattctacagaataaggttccactagaacttaatatcccaaagagaatgttttgcaggaacattctcaatgatcaattgaaggatcccttttgtgggttacctgtgaccacttccccctgccttgctgatgtttctgtttgtctttccatactcacattcttaggagaaaatatattgaaattcaaaactgctaaaaaatattttatgctatactttaagaaaccctggctgggcatggtggctcatgtctgtgatctcagcactttaggatgccaaggtgggtggatcgcttgagcccaggagtttcagacccaccggggcaacatagtgagaccttgtctctattaaaaacaaacaaacaaacagctgggtgtgatggcacactcctgtagttccagctactcaggaggctgaggtgggagccaagattgcaccactgcactccagcactccagcctgggtgacagagtgagatcgtctcaaaaaaaaaaaaaaaaaaaaaaaaaaaaagaaaagaaaagaaaaaaaacctctaatgtgtgaaaaatctgtattaataaaacaaattaggaagcgtttattccctgagcctggctgctgttgcctgtattaatttatagatttattaattacttgacagagaaggcaaaagtacaaaatgtacaaccaaagtatgagatatcaaggtaccactgtcaattaaaaatcaaaaaaagaagtcatattttagagcggaatggtcaacgtcaacatgatcatttcatagaggagaaaagagagaggtgaagccacttgcacagagtcacacagctttgcagagtagggcggggtagggcagaggagcagcttgtctcttcctggcatgctgctgataaaacatctcagagctggtggcattaatcagagggaacagaaattttgatttaaccccacttttcatgtacatctatgatgcatttcaacaacgaagaagcatcttttgtactgtctgccagacagggatccttactattgatatgtttgaaagttaattacatggaggagtgaagacggcacacccatctcagagactaaccaccgcaaatgacaagtgaaaaagacagagccgttacagctatcctggtcgggtttattttcccagactaccatgtggggagttgaacatacccaccctcaggtcggggacaggctcgtgacgatgctcagggtagtggtggagccccagaagcctccagtttccattttggacccacggagatctccagggtgcctatcactcttggcccaggcctgggctttccaggaacttccccgattgatgttttactgaacgtggtgccgaaagttagtcacaggaagacattatctcagctgtctctgcgcaaatgctctctgaaacctccacgttgcttttaaagcatcatggagaaatgtagcatttatgccttgggagccagctatctatgcagagctaaaatagaaaatcttctcaagttgagtataaacagatcctcaacaagactgagactcttgttgcttgtggctgtgtggggataggaatcagctacagcatcacttgtatttttcctgcccttggggtgctctgtggagaccatgtgatgccttccacagctaatgcccctaaggaaagaccttaggcagatacacactgaaagtatacacatctgtagacagctgtgggcaaggatgttggagtttagcatctctactaactcacctaatagtaaaaacgggaagcattgtgctaacattttttttagaacagctgcaactatctaaattataatacaatcttaacaatttaacattcagatacaattatgcagaatgaagtgcacccatcttaagtgtacagtctgatgtgtttctgctaaatgcatatactagcatagccaacaccccatcaagatatagagcattgccatcacccaagaaagttctttatgcctctccctagtcatttgaaactttccctctctacccacccagggcagccatgattctgatttctagctctagatcaatcttgcctgtttttgagctttacataaatgagctaatacagtatgtactcttttggcttatacattatgctttggagactcatttatgtttttgcatggattagtagtccattcctttttactgctaagcagtattgcattgaatggatatatcatgatttgtttatccattctccttttgatttacatttgggttgttttagtttttgctattatgaacaaagcacctattgacattcccatagaagtatttttgtggaattttcatttcttttgggtaaataactagggctagacttgctggatcgtaagttagttgtatgttttaccttataagaaactgtcaaacagttgacataatgcactcttaatgaagcttattacctgtgaagtgaggtcttttaaattttttgtcttttgatttttgtcttaaattgcatcgatattagatgtgtggacattcttctgaaatatcttaaggatcagaccttgattaactgtgttattttagtagatctttaatgcttctgagttatttatacggacagctcgaaatctgaacgactcccattggaaaaccagaatgatctctttcatggatctctcccatatttttatttatcttctttaatgttttatacatacaaaaatatgtagaacatgtgttagttattaagcatacttataaaatggaaatttgtaaatccgtcactcaatccaagagtgaactcatttccaaattacaatggaaacccatgtgcctatgggcttctcatcctctccaaaggaattcacatccttcattaattcttttgctaaaacaaaagcaaaacaaaggaaaaatattattttattatttaaagcaaaaaaaattttctgtaacttttaaagttttccttgctttttaagagctttatcaaaatggtgttacgctgtgtgcgtttttgatatttgtatatttttactcagtgtgtttcaaagatctgcccatgttgtgtggggctgtagtttattcacttttgctgctaacattcctttctgcgaatacatcacaatatactgtattacttgatacttgtcaattgttgtgctgtttctcacgtttgcacttgatgtatatgatatacattacattttttggggagtctggtacatttagcagaataatttgagatgaaactgttatcaagtaaacggcgtttttaaaaaatgaaaacaagcaatcagtttctgctccaaaagagggagaacctataagatacctgagtaaaatggtataaaataaaaagtttggtgcattgtcaatgtgggtataaagcaaagactccaattaatttttgtctacatgattttatttcaaggttgaaaaaataagtttgacttgtgtatgtaaaatataatcattgaagaaatacaaatcacctcctttgtccatgtggtcaagttagagcgtaaagacaacctaaatttttgttccttttttttccctaaatattaagctatataatgatacatctcccacttcactgtttaaaataacttaatacgattgatttcctactacttcaggaaaacacaaacatttaaaaaattcacaaataaaaatcattttagtaaaaaaaaaacacacaaaaacaaatcctacaacccctacaacaacctatatacatttaaaaattctatagacctctttatgttcttggggacaaataaacaggcatatttattactaatactaaaaatacattgggtagtatttgaagattttatattagcactagccttttaaaaatcagctctaaatttttgtcttacaagtatgtattaaaaattctgaaatcaagtataatgaaattatatatcaatattcctttgcatttaactccagagtggatctgcaggaatcaagaccaacctcatgcagagaacttaagaaatatttaaaaattagtagactggactttaattcttcatgtgtagtgcctaatttttaaataatacattttaagattctaataaatttatttcactgttaaatctaggaacatccaaaactgaaactctttatttaaaaatcaagctgaatttcagttaaacaaaaccatcccatcatatgaataactttcttaggtaaaacaaggtttattttctttctatacaactgactctgaattgagctagaaatttccaaggaggaaaatgatctaggaaacaactttagaaaaaaagggctaagtttccgttatgatagcttttgacttgttttcagctcttaaaaaattatttacgaacgatggatacacgttctaatgcagaagtattttagaattagagagtaaaagaaacctactaccttcctttacatcaggtcccttctaccatcctacccgattgtttgagacaaccacttcttatctcgacaattcacaactcttttattagctatcttaaaaaaatttattactggcatcaattagcctgagtcatgaaaccggaccacattaagggcgacacatggtccaatcactgtttgtaaaagtccacgtatttcaaactcctctctcctgccactgctgggctgtttccctctttgaggacctggtctccgcagcatttattcattagatggcagtcctaggggagtctcgctttggggaaacctctcctcctgcacattcaagaaaacaaccgcggagacttagggtcggtactggtttccagtcacttacgtagcaaacgaagcaagaggaacgtgcctgggaggacccgagacaggtgcgggtgggtttccgcagtagccgctgatcccgagtgcatgcggcgtgttcccgggtcgggaccgcggccaagggaggcttcccggccccagcctccaccccctcctcggcgccccgggacccggacacgccccccgagcttcggagacccgcagcgtgcacgcgccccggccgctccccgcagccgcccacgtggtggagccctgagctgcgcgaggccgcggagagcgctcagggcgggcggctggtccgggaggccacgccagcgcgacccagccgagtcggcccccagcccgggcccccacatttcctcccccggagggagggaggcgactctccgcgggctgccctccccagcgcccgccgcgccctctggcggccgccgcggggacgcgcccggggcacgcggcgctgcctgtctgggccccccttccggggcgcggggcccgcgaggggcggcggggtcctctctcctcgagccactctgggccgagccacacgggccgcgcccttccccctccgctccccctgagcccccaaactccgggctccacggtcgcaacgccgcgggcaccccagcctggcgtgaaagtgcccggcgtagtagcctggggggggggtcccctttctcccaggtgcgccccttccgccacgttcgggctttccagtacgcagcgaaaaaaatgccgcatgcacgcatttatttattttgcaacagctgcaagaaacaatgaagcttttcaagaaccggggaaacgcgctttccagccgcgctgttgttgttttcaatgaacctctcccagccccgcactccccgcccacccctcccctctcctgcccacccctcccctgcctagcctttccctggctacccacccctgccccgccgagaccggaccggcggcgggggcattgtttttggagtcgggcgggaggggagggcgcgtgcggggtggccggcgcagtgcggtgggggcgggagcgggtgggcacgcgcgcgtgtctctgtgtgcgcgcgggaggcggtggggcgggagatgggggcggcgcctcgcagtctcgcgccccacgcccgggctccgctccgcacgtcttggggaaccgggctccggttttttgcgcgcgccggcctgggccgggccctcggcgcgccgctgctgcggcggtggccgctcgagtgtgcgagcgggcgcgtgtgcgcgggccagggcgcgcgcgcgcgcgcgagcccccagtgtgtggcagcggcggcggcggcgcggcgaggctggggctcttgtttaccagcattaactccgctgagcggaaaaaaaaagggaaaaaacccgaggaggagcgagcgcaccaggcgaactcgagagaggcgggagagcgagagggacgccgccagcgagcctgcccacggccggcgctcgcagaccctcggccccgctccccggatccccccgcgccctccacgcccctcccgcgcgggggcagctccacggcgcgcctcgcctcggctgtgaccttcagcgagccggagcccccgcgcagagcaggcggcggcgggcgggggccgggcgggggccggcgcggggcgggcggcggcgcagagccgggcggcgcggcgggagtgctgagcgcggcgcggccggcccgccgctttgtgtgtgtcctggatttgggaaggagctcgccgcggcggcggcggcgctgagggaggaggcggcggcgagcggagccaggaggaggaggaggagggggagccgctcattcattttgactccgcgtttctgcccctcgccggcctcgcctgtgacccggacttcggggcgatcttgcgaactgcgtcgcgccctcccgcggcggaagctcgggcgtccggccgcctcccgcgcggccagggccgggcttgtttttcctcgcctaggcagatttgggctttgccccctttctttgcagttttccccccttcctgcctctccgggtttgaaaatggaggccgacgacgccgacagcccgccccggcgcgcctcgggttcccgactccgccgagccctgggccgctgctgccggcgctgaggggccgccccgcgccgcccgccccgtccgcgcacccggagggccccggcggcgccgccttcggagtattgtttccttcgcccttgtttttggagggggagcgaagactgagtttgagacttgtttcctttcatttcctttttttcttttcttttcttttttttttttttttttttttttgagaaaggggaatttcatcccaaataaaaggaatgaagtctggctccggaggagggtccccgacctcgctgtgggggctcctgtttctctccgccgcgctctcgctctggccgacgagtggagaaagtgagtatgtgcccgccgcccgcggccactgcgggaacttttcctccgaggggctgcgccctgtttgcgaaacccgagttgccaccgtcgcagctgtcgggcccccgggctcgggagcggcggggtggggcgcagggcggctctgccgggagggaggctgcagcggacccgggacccgggctcgttcgtctggagccccgcgggccctggctccgcgcatccccgcgcgggaagggcttttctctttctccgtcctgacagcccagccgtgtttcccggctaggcgcgaggactcggtagggaagttggtgccggggcgggctccgcggttcccgggccccgcgacccgcacctcgccccttccatgcgcaagagcctctccgcacacagcgctgatcccctgcggcgcgcaggcagcagcgacagcaccctgggccgcaccgcgtctccgctgctggggctgaccgggcagtggggagcgggcagccgcccggcccgcggggtgcgagttgccctcgaggggggaggtgccctgcggagaggccccgaagccccaggacacgtctccaagcgcccgtcgctgcctcccgtcgcccaacgtgcttttgcccctcgggctcctcgggttcctggccttgcccgtcactttggcccgctcctcgttgggttacctgcccccggcgtcccggggctgggcggtggggtgaggggaagcgctctctgggcagccccccgggaagtgcgaggccgggagtcttcctcagcttgtctcttccggggagcgccactgggtccccagttcagagggctctgggatggtctcccagtttctcccgggccgggggatggaggggtactagggccgcatccgagtgtgcgttggtgggtgtgtggtcggagccgacgtgcattccgacacacgtgctcgcagcgcggggtgtagtcgccgcctcacggggacacctagacgcccgtccctggcgagaggtgtcgtacgctgtggtttcagcgccagggtctgcggcggcgcggggagggtgttgtgttttgcgagcgcggagccctggccttggttttgttgtggtcggcgtcgtgtcgccctctcttctgccgccccgcacttcctttgtacgtagttaataagcagtgtcgctccacattcgctgtcttttgcaatctgatagcttttgttttggtggtgtcgggtgggggttagtagggaagcgcggggatgcggggagcgagaactccccccggtgtctacggccggaggaggtgggggttttattcttctgaaaaagttgaaagtgtggcttactggtacattcaagatggtagggtaatttgaacacgattaaaagtttaaatgtcgcagaactgggactgggaacggtgagggcgtgttggtgagtaatggttgccgagggtatgcaggtggtgccgattaactttgaaaaaatcacgactgagccttcacgagtgaggcggggaaggaggaggcagcggaggttgtatggccccatcaccggggcaattcagaaaggctgtttctataaacaaatccttaaacgtctggtaagaaatgagtccgcgacggaacgagagcagatcgtggttcgcgtgtttactgccgagtgggacgcggactggggccggaccttccacagatctgggctctcctgctctttgttttctaaactttcagcggactcgattgggcgaaagccttccggctccctttactaagtcgtttaggtggtggctggggggacaaaggagggtttttatctttaaaagataagtacggtttagaagacacgggagaaataatccattttgttatgttatgcagttgaactgtatagcttctctagttttgtgtttttaatgttctgaaattcaaaacagcagggatggccttcgccgacgcaggagtcgggcattttaaaataggctgtttttcttttggagcgttcttcttgaaggatattctttgtgcaagacggcgatttttgagaacacaggcaggagggagggggtgttttaatgtatgtttttactccatgataccaaagcttccccccaggatccctttacagtggttagttcctggaaacctgatgggtggtcagaaggcaccccaaatctcgattatggtttgctgaagtcttgactgactcagtacctgcccctccctccatctctgaaatgtggagaattaaaagctatgcctgtgaacgggcgttcagtttttagccgggaaggtgctagaccacttaactctgatagaaataagctgctgagccctatcagggagggcgttctttcagctgttgtctggtggagaaataaagacagggtgttggttcagttgcaggtattttgctggcgtattgagagattagagtttcctctttgagtgtgatggcagtagaaagagtgttgtttatcttagaaaacttagtttctgaagcagaggcagtcatatggatgtgtttgttttgtatcaccataatgtgaacagagcatctaaatgaaggcggttcggaggttctgagtgatagccagataatctgagggctattttgtttttaaaaagtcagcatgcactttaaatttattgtacccatctccttaaaaggattcagtcatctttctaccccaggcatcctgttgtcacagaaatgtaggtatgtgaaatgttggtgtttaaagaagttagtgttttattaccagaaggagaacccagaaaaagaacttctgaaagaacctaaacagcaaattatagtttagatcctctggagagacatagcaagcaaatggtgttttgtggaagggtggggtttgtgtcaggatttgaaatgtaaaaggtcataatgtttgatttgtcgaaaaagattagaaaagttcaactctaagaaatatgctaaggttgaatagatgaagcttaaaaatatcacaaaaagtgaaagaagtcagtcacaaaagaccacatatcgtatgatccggtttatgtgaaatgtctagaataaacaaatccatagaggcagaaggtagatgagtggttgccaggggctgggggcggatggaatggggagtgactgctggtgggcacagggtttctttttggggtgatgaaaattgttctaaaattagtttgtggcgatggctgcatagctctaaatatacttaaaaccattggattatgtactttaaatcggggactttaatggtatgtgaattatatctcaataaacccttttttttttttttaaagaaatgtgatcaggttgaaaataacttgttatgctaccttaaattacgttaaaattattacatacatttgacaggctgatgtctctctctcttttcatttatgagtttttcagatccgtgagttgcagcaatacaacaaactgataattgaagcttagcaacagggattcaatcccgcagtagaaatgggcaagcaggagaaaaagaatcttggttctatgtagcttcagttagggattgaggagctggatttaaaaaacacaaatgctggtggagggcagatttttgacaatagaaacctcagctgaatctgaaatgatggtttttttcaggatagagtttaggagctgagtctgaagggctgtttgtatttccagttttattatgttttccaacaaagaaagacattgctgttttaagatgttttaaacactcattttttgatatgccacattgaccacaagtggtagtaaggactgaggatgaacagaacagttcattttaatgcagtattgttgtttcttttctttgcagttttattttatttcttacatagttccagggtctgagcaggagaaagaatctttaggatgcagtagttttaggatacactgtttcaagtatacagtgatttttataaaattaaaattccttacagaacgaaaggttttaaaatgtggcaaaggcatttttgttttgaaactgtgtgcatttatccagatttaccctggcctttcaataggaaaagacctagagaataattgttgtttacatttgcttttggtctttgtctaaggcttagtttactaataaaaatgtttcctgcccttcctattgttgcaagatcagggcagtaatgaaaatcaactgtatcattttcacttgttgccttagagtttttgccaagaggaaccctcaagggacggtggtttccttttaaatctggtttcatttgttttgtaagaatgtgctgtaagaagcaactgaatccagcctgcacttattgtgcacctactgtatgaaagctgaccttgtgctactcagtgcatgaacctgcagagtcttgcatgaaaccacctttcttgaaattcagattttttttcagactcagtatagggtgcagttttcaagtagacagtagttagcattttaaaggttcttttaaaaatatttctgtagacttaggactctagtgttgttcatcagaagcctttaccctataccttttttgcctcattggtgctttccgttatattgggatgtcactgtagactgtgacatacaggtgatgttaacccatcttgactggcggcactgtcttctttataacattggatatggcaattgtgatttacaaactgcagtgttgtagttgcctttttccaaaaattaggagtcacaggtgtgtacatgaacgttgcatagcatgttttgagttgtaagaaagatggaacttatttcagaagttttctggattacatattgcttagttagctttctagaaatcaggaagcattcataatttcagggcattttataatttgtaaataacttggtgtttttaaaagcgtgagggagtaagagtgaggagacaaatcctgaaagtttttgttttttaattgtaaagcatacaagatacatttctttataggttgtgattttccccaatttgttttcaaaactcatttaaaaatcagacctagttcatggaagaggtatttgcgcctgtgggcgaacttgatttgaactgcttttcttagccagcttaggacaggtgctgagtccaggggatgagctcttctcaattgtactaaatatataatagttgcacacatgttacggatatagtttcttgatttccagtctgagatgttctgaaggaaaattctgaacactttagagacaacaaagtgcctaatgagtgatgcactctgatccctcctggaaaatggtgtttggcatcagcttagcaagaggaggttttccagttatttgtaaagatgtgatgtggctttaagtggggatgggggagggtagcagccccagtgtttgtggacattgagacctgttgacatttgggaagcataactgagttccactatttgaaaagattaaaactttgatatatgtacacatcccctcatgcctgcacccccatccccgagggtctggaaaagaattgatttgttctgaggaaggaacatatatttggaatataaaatggttagtaaacaaaggatctttaaaacaagttagattgttatctcaagagaagcatacttcctcggcatgatgttttcttttgttaaattgctttggttttatttgactcaaagtattaacaatacctttgattttgagacttttggacttttgaagactaagtttttaaatggtcaattttactcgtttgaaagtcccagataccatttttgaagatttctctccctttttttccactgatgccggctttacttatgttttattttcaaatcttaaggaaaaactgatatttccttacttgaactgagaaatagtcgttttccctccctcttttcttccacagtaaatacatgttgagtacttactggatgcagttctttaggtttagaaattatttgatactgtaaaatgtcttaccataagtttttaaagatacccgtcaaactatagatgttactgccatgtttattaaaaaaaaaaataaaacgaaacaaactagtaagcaagcttaaaatttttctttttcctgccctggactacagatttttttttcttttttttttttgagacagggtctctggtcacctaggctggaatgcagtggtgtgatcacggcttgattctgccttgacctcccaggctccagtgatcctcccaagtaggtgggactacaggcacacaccaccatgcctggctaattttttgtatttttagtacagacgaggttttgctatgttgctcaggttggactcaagcgatccactcacctcggcctcccggagggctgggatcacaggtgcgagccaccgcccccagcctacaagaatttgtaaactcatagattgctcttctgttttcactggaccacaacagaaagtagtttcttttatggtgagggatgaacacctacgattgcaatataagttgttgggccttgtgtccatggagctcacttggtggttggtggtcttgaagcattcacattctttggagtagtggggcggctggctagtcacatggggaagatgtgcacacctgtggatggggccatcacacactgcagcgatagctgggcctaccttactgctcacctggctgggcacagcggctcctgcctgtaaccccagcactttgggaggccaaggtgggcagatcacttgaggtcagaagttcaagaccagcctggccaacatggtgcaccccctttctactaaaaataccagaattaaccgggcgtggtggcccgtgcctataatcccagctacgtgagaggctgaggcaggagaattgctgaaacccaggaggcagaggttgcagtgagccaagatgatgccactgcactccagcctgggtgacagagcgagactccatcacacacacaaaatacatatataaaaataaattgctcacctggtaatagtctggaaaacattttttttttgtttttttgcatattttaaagactttagaaagtagtcttgctaatccagaaagttcttgcggggaggagtttgaaactttgttttatctcactcctcagtcttagcccccttaataccataggtctctacttcagtaagagttacataatacgaatgccgtttgttcagaattgtgtatctccatccatccgtccatcgtccaaattctgcgagtttgaaatacattgttgttgctgttttgtatacttttgttcaaccattttctttttaacatggcactagctttctcaaactggctttggaattatttgtcagtttaaaaataaataccactttaaaaattactcttgacatgggagaacaaatatattttgatagttgttagagcataaatattttatagagcataacttgaaatttttcctgatacattgtgattgctttcagcttgtcctctgctgtaaaaaatatagtcgtggttagtctctgtaaagttggttattgggaatatgtgcttgattacgtaaatgagacatcaccaatttaagtcagccaaagtttagtcaatagaactttaaagaacagaagtctaatggtaattagggagagatgaatttatttgtaggagttttccccaaattcaaagcgtcttagtgacctttgataacttcctggaaaaagtaggaagcatggagagaaattccaggtaggagcccatgatccaattgactgcatcagcttacaaagtgttttctaagtcattagctattaattctgtctagattgtaaaatccctctcagttgtgtccacatttatctgtgttgtcctgtatttattctctttacctaatttccctgagtctcattttagtgggataatacacaagcttacagactcaggactttaaagagaagcacagattgccacgaaaacaaatgaacacagagaccagtagcagcagagggagatctgctgtgaggcttcccttagttctgttgtctgatttctgtggataatgagttcactgcatatgttaggtcacaacatgatatcgtgtagtcgtaggtacagaacttttgttatggtagcctttcttcgtcaggtgatacaattgggattttctttctcacatgcacctcagtaaaattttcagcaacagagattggctcaggatggaatttgttcagtttcagttctgcagcctgtccttttctggggagactcattaattgaatgttgcctttcgatctcactgagtcacttgaaatcgctcagattgacccctattccgggatccagcctggtccagtgcagacctgcattgactctgactacatgctgagttggcctctgaaccagttcctgtaccattcccttagtctgatggacttgccagctccaaatactcagaacgtgcctcttgtggtcctaggatcaagtccagggtccttagaatcaagtaatgaaacaggtccttagtaatcctgtgctgtagggatccactgttagttcctggtactccccagcatctgtgcattagcttgatggaaaggaagctgtgttatgcctgtcttcaagtttttgcttctgctgtttccatagctgagaatgtttttcctcttcactactctgctacttctccttccatcctcaatactgaatagcagaaagtgccgcttaagaacacaggaaggtcaccatagctttagtttctccttagctgccaattagttctttggtcctaaagttattaacttttctgagtcttgatagaaatgcggagacttaaaaatatttgggggagacatttctccttttctcactaaacaacagaatgaaaaccttttctaacaggtttagaaaaccaaagtcagaaaaattgtgaggaaatagaataggttttttaaattgaaataatttccaagttccaggtggatctgtaaaatagggacaagatcataactttcaaaaggcagcacgctaagtcaggtgattcctttcccccatatgccttttctgtggtttgaataggtcagagatgccatctttacatttccaagtcaaattcctcttccttcttgaaggtttttgggatttccctaacttgtatagatctactttcccattactccttttgagttcataacccacggttttgctggttgacagtgatttgtcttgttccttgcttgtaattttattaggaccatggagccaaagtggctggtttgaatctcagctcttcagtagctaagctctcaggcaaataatttaatcttcttgtgcctcagtttcctcatctgtgaaattataattttaatagaatctactttaaacattcatagaaatcaaattcgtacacatgtcaagtgcctagaatagaacctggcacctggtattaagcccttggacttcaactgctactgttcttagggttgtgacatcctcgaacagagatgttctttggatagaaatataaggcttacttgatgtttgattgtccttgccatttaaatatgttatagaacctggcacataggtgctcaataaatgtataataaaactttattttgctaaggtgtttattaacaagatggcatgttgcttattaaacagttgtgattttttttttcagtaaacgatggtcatccccctgcagtttgccttccatttcagagatctgtttattacactttctcccttaatattgtcatttgtcaatttctgctcacacctgagaggtgtccagtgtgcactttgcccatctcgcctatgcataggctccatctagtggccagaagggaaattcagcatattaggtgactgaattaatagtgccccaaggaggaagatagcgatcccaacccactctctggcttgcttcctggggactgattgcaagaaaatgtggatactacagacttctgtagaaatcactgggctacagttttggattaaggttactctactgtgtcagtgcgagctgtcctgagagaattagggtcttcctaagtgatgcagacaggcgcactgcaactccatggcagagctgttaacacctagtgtgtcttttacagttagagttttaagataattttacaggactttaataaatttaaagctccaaaatatttgagattagagattaaaaaaacactactgatttcatttggaaaaatacagcaagatttaccttccattgctctatttaaacaggtagtaacactttcattctcttctctctcccctttggctattctatgtggttaagatgctcgccagccagaaatactcacagagaataagaataaatacatccagtgttgtgttaggtcccacaccgtctatatttcgctagctaattttatgtattttgtttcatgttttattgatattttcagaatctttcttgctgagattacacaaaatatatagctggttattcagttttacgtgtcaaaagccttaaacctgtttccccatgattgccttttattatttttaattcggaaatctttgtttggctgtctgagagagaacttcagcctcccttcctcccagacattttgaacagttcaggctgtactcattcgtgtctctttgtcttggcaggtggaagcccctctgcttggaatagcaaacaatactaccagcttgccctctggcaagctcctttaagagttagctgtaatttcaccctctctctggccttgattctgcatgcagaatgattgcactgacttgagctcctgtggtctcttgctatacctcctatttgggcatctcccccatattgctttcccccaccattggggaggggaatggtaccttggttatctttgaattcccaggaggtggcccagtgcctggtgcataggaggagctgaagaaacggaagacttcttaaagggatactcgccattcactttgaagcacttctttgtacaacaaatttattttcatctgatcattgcacctctgctagccaaaacattttatcacaccagttactgctgcatggaacttgaaagcaataaaattatctttaaaatcattgtttgattaggctttttgcacattgaggtgaataaaaaaaattagaactcctggaagggtaatttgtgagtctggccttgtgtcaagatcacctcatccctgtggatggagactttgttccataagttccctatagataagatgtaatgaataattcattggcaccgatttatgtctgtagtgtgcttttaaaccctcttggagctgggttcctgaggaggaagcatctgcaggctggactcggctgcctggtggtctccggagtggcctggtgcagagggccagggtggcatctcagaaagttgggtgggtagggtacttgcacacctgctgaccttgagttacagggtggacctaggtcatttcacaggcccttccagccttcagatctcaagatactaggcagagagagagatggagatttgagggagatgtggttggaacaagcagaatcaccacgtatggaagttggcttctattttttgcattgttttcttggtgaggccagtaagcttttgcctcactcctgggagggacagtagcaaggtcttacaggtctctctatcattgaagcaccctctccaaccctgccggttttggttgctggtgaaggcctttgacagtgtcctggtagggcgacggtgaggccagctcccgacctctggacagaagaaagcttacttgtctaggttggtgtcaaggggactcctgaacttaatgaacaccttagaaattatccttaaagtctcctcttccgaggagtggggtgggatatttcttgcagaaaatgtaaacataatcatttgaagctggaatgttaatattcaagagtagcttgtaaaaaagcatcttgtgaaattctcatgtgaatgctgaaccggctggatgtgaacttagctggacagcctggcctgtctttgctctgctcttctccgtgcggtttgcatatgtgcagggcttcctttgaagccttgtcccctcaaacaattcactgtctccctctctcccacgcatggaggcatgttggaaagggagctccaggcctcagtgtctctgcctgtgattggaataacactgctctagcagggatgccaatgagaattagcaatagataatgtatccaagctgcccagcaaacctggcaaatagaaagcatccaataaatggatgcttttctctttttttctcctcctcatggtgggtggccctggtgggctctctctggggcctccagtcctccttccccacaacactggggaattgctgccagttgaatagggcccttttttttttttttttttttttttttgagacagtcttgctctgttgcccaggctggagtgcagtggtgcaatctccgctcactgcaacctctgccttactgcaacctcttcctcccaggttcaaacaattcttgtggatcagcttcccaagaagctgggattacaggcgtgtgccaccacgcctggctaattttttttttttctagtagagacggggtttaggcatgttggtcaggctggtctcaaactcctggcctcaagcaatccaccgacctcggcctcccatagtgctgggattacagatgtgagccactgtggctggccaaggagggtctttttttgcacatctacagtgaaaggtttgaacccggacgtctgagtctcaggtcagttgttgaaaccactaagtaaccaccttgcttctctgtgcctgaagagaatgggtttttaggttaaccaggctgactggttcaaggtcatgtccctatctgtggaaggggagtgggagtggaaggtgagtggtgacagagtatggaaccctgtttctgatatctagattatttgagggcctccagtggtctctgctccatggaaagcatatgaaagaatatgattttttttttttactcgagcttgttgtctagttgggaaaactcaactactggtggagagtaacagatgctatgagtttagtgctaagttatgggatgctgaccggagagaagtatgtgggctgcaggcagtggggtcacggaactgcagaatggcttgagaagctttaaggaggatgtctgactttagtgtgccctaaatatttgactctcaagatccaaggaggcagctccccaggagaggaagggaccatgtgtggtgtgggtggcagtgtgcactgatggagtggagagggtgtcagaatccggtgtttgtgtggtgggaaggaattgactgctggctagagaatgaggagcgctgaaacctttgcaccattgcagtggacccgctgagaagggtgttctggggaggctgctctggtctctcgatggagtcaggattgggggacagatagacaccccggtgtgagccagtgatggtatagatgagggaggcagtgaggacaggctcagggagggaagtcttgtctctagacctgagaccaggaagcaggaatggactggacaggttggcccagctgagggaggtgactggtgagatgggtcctcggtgtgaggggctgggttgccagaggagctgtgggctggggtggtttgtcgagagagcagtcccagttgatggagaggcaggacccgcaaaacaggttggctgcaggactgggggcggtagcacagggcagctcccgaggagacacctggcacttttaaggcatggaatggagagagctaggggagagcacacctgcagtgaggcaattcacatagcaaagttctccggaaactgcagtgttcaacttttttaaagaatagctggatgttagaaaagtggaggaactgtcacctttattaggggcatcatggatacctggtagcatcaagggctagggttaaaacccgtggagtaatacgccctcctattgtgttcctctcctctaaaaatgaaggtgaaactgtttcaggtgagcgctgttgttgttcgtttgctggggcactgctttctgatttttagaggagtccaggctggagactgacccctgcctttttctgagttgggccggctgggcccgaggctggttctgggctgggccaggctgatgcagtggccttgggcttcccgaggctgggagagggcggtggcccccgctaccctgaagagctggccaacgcggcagggctctttccagtccttaccatgcaagtgaagaggaacagtttgtttaaagaggggtgccagcttcacatccaggcctggactttgctactggtgcttttgaacttgtgttgatttatgtttgtaaattgactggacacattgtggttcttgatgagaagcaattgcccatccttagcccacgattagtgccactctctgggtgctgcctgttctgccactgtaactgttttcacttgacaaataacattaaaaaacacagttctgcaagagacttcctgggagggtggtatcatttggcctgtgggcttttgtaacactttcctgctattaggagagtgaattctgaattttcaatcacgttcacctgttggagcaagtagagtttcagacggtctccgcttttctcgactagaaagcaggccttctcccttttccccccagtcttgtttcatgacaccattcccctctgagatgagggttggagaattagaagtctactgatgcattgtaccggggcacgttattgaccctctctgctctcctttcctcatctgtaaaatggaagataatgccacccatcaggccgagtgcggtggctcatgcctgtaatcccagcactttgggaggccgaggtgagcggatcacctgaaatcaggagttcgagaccagcctggctaacatggtgaaaccctgtctctactaaaaatataaaaattagccaggcacagtggcatgcacctgtaatcccagctactcaggaggctgaggcaggagaatcacttgaacctgggaggtggaggttggaggttggaggttggaggttggaggttgcagtgagccaagatcgcgccactgcactccagcctgggcgagagtgagactccatgtcaaaaaaaaaaaaaaaaaagtgtcacccatcttggaggatcgttaccaatacttcatgagtgaatacatacacatttcttagaacctagggtttataaacactaggagttagctgatactattgttgctaaggatagaggaaatacgcattagaagttatttacttcctttaaaaaaaaaaataccctttgggtgtgtattgattctgatgttttgctcctagctacatttgccgtttttttttgactgcagaattaggaaccagcttcatttttttttttttttttggatggaatctcgctctgtcgtccaggctggagtgtggtggcgcaatcttggctcactgcaagctccacctcccgggttcacgccattctcctgcctcagcctccccagcagctgggactacaggcgtccgctgccacactaatttttgtatttttagtagagatggggtttcaccgtgttagccaggatggtcttgatctcctgaccttgtgatccgcccacctcggcctcccaaagtgctgggattaaaggcgtgagccaccgcgcccggcaggaacccagcttcatttcttgtaaagagagtttgacaagcgctccactggggatagcagcacagcttcctccttttctgtccctgtctccctcctgactctgcatctgcctccgtttgaagcatcctcctccagtaagtgggtcatttggattccaaggcccttttgaggccatggtgatggatcatttgcgttatcaatgtgaactgtggatgtcccttcgcccttcagtctcttccttcttcaaggagggggaggtaattgggggtcatgtggcctggggaagagcctggtcacgagcatgagggatgtgagtgggactatgtttccagccaaaatttagggcacaggatctgaaaaacacttagattaagtatctgcaacacaaattagggtattttaaattgaatgtggagaaccctgagaacctgtgccctttgtgcgtggatggctgcttgcaaggatgagcatccccagctggagcggcccatggctgccagaacaggagaaggcttcagtcaggtgggaagccagctgcagtgtgttgcctgatgcaggatggtgcgagaaggagctgctctcttgctctgctccctggatcgcacaaggtcttcctgagaccagaattcaaggttagtcctgtttaggcaacttggtagatggacttgaatggtcttgctaagcgaatattgcctatggtggtatttgcaaggaaaacaaaagtgttttgagcccagactaaccaatttaacaatgctagtaggtaaggatactactgtttgctttctgtgatgagaggtctcttaggaggaggggttaattcttttgatttaaaacttactacttgaggcaaataggcacatgaaaagatgttgaaagtcactagtcattggtgaaatgtaagtcagacccacaattggtacttcatactcattagtatggctattaccaaaaacaccagatgatagcaagcataggccaggatgtggagatgttggaacccttgtgccttactggtgagactgttaaaatggcacagccttttttttttttaacaggaagatgatatggtgcttcctcaataaattcatcatagaattgccatatgatccagcaattccactttggggtatatgcccaaaaagaagtgaaagcaggggctcgaacagatatttgtacacccatgttcatggcagcaaataattcaaaatagccaaaaagtgaaagcaactcaagggtccatccatagacgggtggataaacaaaatgtggtctatccatacaatggaatatcattgagccttaaaaaggaaggaaattctatgatgtgctacaatgtctgtgaaccttgaagacactctgcgaagtgaaagaagccagtcatgaaaggacaaacagtgcataattgttacccttacgtgagctatgtagagtagtcacattcatagagacggaaagtagaatggtgaggggcggtgaatagaggctggggggagggagcaatgaggaattggtgtttaatgggtacagagtttcagtttgggaacatgtaaaagttctagaggtggatggttacggtggttgagcaacattgtgaatcagtgtcagtgaactatacacttaacaagggttaaaatgttaaattctttgttgtgtatattttaccacaattttaaaaagcttatttctcaattgtttatgcgagtatatgtgtggaatagttggggagacaaattcaaggagaccagtccttgtccatggcggtcctaggtaccacgggatcactgcgggggaactgtgaggtcaggagaggccttgaaaaaaaacgcaggtttgagctgagtcagatggaatgggtctgttttctatatcaagagacagtattgcagataatttttttctttcaaggaaagcaagtcaggagtcaaactcatgccaccgtagtcacaaatgaaatttattgctaatcagccatgtgacgtgtaattgctttttcattttcttatttttccagaagagagatttgtttagatgtttgattccctcactgattatgattatactggaagtttttcatttgttttgacagctcaattttttttttattgtaaatggactgcctcattacagaggggggagcccttgaaagaaagggattgacctctgcaggcaagaatctgagcatcctaaaagtagaaaagggctagaggcttcgccttacaggccaggaagcttggagggacgcgctgctagagaccatggcacgcatgctgtgtgtcgaaggccaggtccgcctgtctgcctctccagcagatactctctggggctatttttttctgcttggttgtcatcctttggtttaaccaggcgccagggctcaggcctggacctgctggattccaaagaagacttcgaggtggccgagcttgtctggcttccagaggagctttctctgtcccgcccgggggagtggctcaccttggtctgagaccaatgggaggaagcctgctgcgggcaactggtctgtgcctggaagttggacttgcattttctctggacctccaaagcaaacccgaatgaccactctcatcctccccttttgcttgtttgtgtatgtgcttgttttgcctggtcgtcaggcaggaggtggtgtcagatgatgagaggtgttgctcgtccctgggttggttctcttacggggctgtatggatgtcttagctcagactgctgtgacaggttactatagactgagggctaaaaccacagacttatgtttctcacagttctggaggctggaagtctgagatcaaggtgccgaccaaatttggtttctgttaagggtccatttcttggcttgcagatgacaaatgtcatgtgtcctcacagggtggagagagcaaggggctctggtctcttcctctttatgtaagggcattgttgccattatgggggctctaccctcaggacctcatctaaacctgattacctccctaaggccccaccttcagataccactgaaggtatctgggggttggggcttcagtatatgaattggaggggacacagtcatgcagttcagaacagtggagcagtgtgccatagtgaagggatctccagaccaggattctctatggaagttcttggccaggtctgagagttggttacagatcattaaaatttacatggaatccagtacttgaaagtacatgtcttcaggatggcgctgagcacattcgcctctgtaaccaaatgcctgaaatgtgtagtgcaccttctgagcaccccagtgctttccttaaagtgaatgcagtttgagaggaactcaattattgagaaattttatatgaccccatttctctcattttaggacagataagttgcttattttaaactctgcaggagctacatagaggaagttatactccaggagagcttaaatttcactctctgaaaactctgttccatgtaagtacattcctcctctctcccctcctcagtgagcacgtacccatcagatgtgtggaattctattaaaagcagctcctcgtgaccctccagggtctgttttgtaaagctgacaccagcatcagtgagttggaaggggctgccacagaagacagacttactgctgcagcccgcttcagagccctcagtagtactttttcctctcccagcaaatccaggaggctgggaaggtgattgttaattgtttatgagcattaactgtttaccagtcatacttactattttaaatctgaccctgccattatgttgttttgtttctgttcacagctgagctttaagctgggtagaatttcgtgatgagtcactcctatgactgtaaaatcagtatcgatcaagccttcctgttcatcctgtgagcagtttagagacagatgagacaggcttatggtttccactggctcggctccgtgcgtgtgcggattgggcttcctgagagcctggttagccccttttatctgctctctgaaacctgcgcaagggtgtttagcatgcaccttgaaacctctgctgcctgaagacagtgtgcttaaatgaagggtatacaaacccatgtgaggttttctcttcccttttccatgaactccaccccaattacctgtttgaattttgcatgccagttattttcagggaactagtgacccttttcttgccaccctgggctttgaattgaaggccagtgtgccaccttttctttggctttgttagaacgttgccctcagggtcatatgtgctggctgctatgaattcttactgcttgatggacagagaaaggtgagggttagatatctggacagggcatgacagggcgggtcatcgagtaggaacattgggaccttttgcttccaggcttgagcagtgggtgagaaacactgtcttcccattagggcagtgggtgaaacactgacttccctccatcctctgggcagccttgtcaggtgggtgtggaagctgaggtgtgtctgccccaggctgtgcagtcagccccgtgttctagcttcccgtgccgaacctggccctggaggctgtctgcctggcaagggggctgcacaaagctcggaggggcatttctggtgcttggtagatggtaggcctgcccccagtgcactgataagagcatgggctgagagtgccacttggattcggctacagtgggcggcagagtgggggtgactggtgttgcttttactctagagcagaggaggcagatgaggtagatcggggccccagggatgctgagctgagctgggtagagagaatttggttttgtaggatttggagacagagacaaatttggagtgtttggatgttcggggacctgcaggaggtatgtgaggtgtgtaaaatgcagcccctgttttaaaaagagcttacattgtctcttgagaagataaggtgtgcccagctgtggaatggaaccagatgcttttatgagtgaggatggagtgagcacactgggaaagagccctggaattggaggaagagatcattttgcccagagggatcttggaggtctcctggaggagggtacttagatgatcagaaggattatactagacttgatggggtggtcttggcatcagaactttaaaaatgtattttggggctggaagcaaggctggagaggaaggtttgtttaagttgtagtgggggatgaggctgggggcaaatcagggatggttttccaggtctgtaaaggctggggtaagaggaatggttggttcttaagagcaaaaaaaatcccttacatattggttctcttatttgtgctaagttaaatacatgggaggctactggtgtttatgaaataaccctgagcctttttggggaggtagtagtggatgtctgatggaagagatagaagactggtcccaggggttcttagtggcaccttcctctcaggtcatcactgtgcttttgcacattgcagttatatttgactacatttgattatggcagatttacttagaagggcactggaaaaaagcctcccaaattacaactgacacaggaaatgactttattttcttctattttttttctttgcttttctcccccaatcaacatacatttttaaacctgtcatctcacatgacctgccggtagaattgatatgtttaatttctgtagaaaataactggaaatatttcacaagctccagtagcttcctgttgtagggacccttaggactttggaatgagaagttttctattgagttgtcatatttggaaggataaaggtgccctcttttccctcgatccacatagtagactcctgtgtgcgggcatttgtttggtgtctcacgttgatgcaaatgcagccattgcagagtgagccccgctctgttactggatctccatttgctcaaaagagagcagtgtccccctccaaatctgcatgtctgaaagcattcatgcaggttcattgcatgggtctttgcattttacttagacttagcaaaaatcaggtatagtctttcctgaaaacaaaagtgaccattgtttttaatcaactgcagggtgtttggagttgtgaaatatttagggtcccgagtccattccagattcaacattgggaaagaatgagaaagctgaagcctggggcaggctctgtctgcagaaaccatgggctatcaccccctctccttagcagcattgtaaacaaacgtcatttgtaaggagcatgtcccaactgagcttgtaattataggggcaagatttgtgtggtggtaggggcatggagctggagactgggggcttccttattggttcatttatcctggcccttctcttttctctcaagtctcagctcttttaagattcagaaaataatgcaaaatgcctaagatttctgaaattcctggcttcagagacttgactacataaaagagccaggattttcaggctggccatttcaggatcagccatttcccacttcctgattcatagcttccaggatttgtaatgcctgtagacttttttctcttttgcttaaaagtggccattgaaagaaaaaataaatagcaaaatccccatcccagaagttctacttcctgttgttgtactattgagctctgaaaaacagctttgtaagtttaggctcttgtttggactatttcagtggaattcttgagatctttttgtttggacaggcaagtatgaaggcgataagtcgaaagaactacagcttactcagcacagaaatgcagaggctcaaatttaagttcttccttagctttatggtgtgtatattaatataatccaagcaatagtgagttgcttagccagggtgcacagacattttccacaatgccagttgtttccctcataatgtttaatgtttatttttaaaggacatatttgggcacacgtttcatttttgcctgtaaaagaattgggaatatttatgattcttgcaacaaaggagaaggatccaaagtaaccaagaaaatgatggactggcagccttcacattttcccacaactcttttcatgaaataaaatgtagataaggctgggtgccatggctcacgcctgtaatcccagcactttgggaggccgaggcgggcggatcacctgtggtcgggagtttgagaccagcctggcgagcacggcgaaaccccgtctctacgaaaaatacaatacaaaaattagccgcgtgtggtggtgtgcgcctgtagtcccagctactcgggaggctgaggtgggagaatcacttgaacctgggaggcagaggttgcagcgagacaagatggcgccattgcactccagcctgagtgacagagcaagactccatctcaaaaaaaaaaaaaaaaaaaaagtgtaggttagcaaaagtgcctacagttcaaatgcttccatgctaaacgttgtatttcttccggtctcatttgtgatgagagtcataagattttgagaaatacaaaaacctttccagctttataggatgataatggcttggccactcaagtagttctgattgggttaactaattttggtccagtaatcatttcatttggggtgaatggatttttcccccctaaatacgggtacctggaaagttgaagcagtgaatctggtgaaacttaatcagtgatttcgtaagggttaacaaatgtttctgggtgggattcctaatgtccagcttcctctgtgtagctcagtaagtcttctttggagacactagcctgcattgtaagactgtcacatgggagcatctttttattttattttacttttttttaaaaaaatgaggtctttattatcctggctggagtgcagtggtgtgatcatggctcactgtaaccttgaactcctgggctcaagtgatcctcttgcctcaacctcccaagtagttgggctgatagacatgagctactgtgccacgtagcattcttggggattattgtagggtccttttggaccacacatggttttatactctgtagctgattgatgtactggcatgtcagtgacattgtgtgtatcattacactatttggttaattgatgtactggtggaatagccatcttctggaggctcttgtttgcatacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcatttgcttttaaggcagaaacacctttaactcttagtagccttacagatcatttttgaaaacacctgtgcttgccttgaatggggcggtgaccactggatccccccatgctgggtacatgttttgcagtcacagacactgctggcctcacctttggtggtgaaggaatgtttccaatttctgctgatggtgtagtgctcttgggagctgggtgctctgaatgagcagatgggcatctgcttttttaagcgtgctgttcattctgcaaaatagttattgtgcaaatacctgataagcaccaggtctgtgccaggcgctgtattttgtattttgcatgtctgaggccagcatctttttccctgttcctttttctcctcatccagtgaactttccactgtggttgtagtttgtctgaaaaagatttggaaaaaatgtacagccatgtttctcttgtctagagaagctgtcttaaggacttcgacaagtttcattggcagagtgaatgagtggtggcctctgaatagttgaaatgttaatgctatctataggttctagagaatctgtgtctttaaaagtcatagcgataaagtctcagctttttgagagagtgggtttcagacatattttaaaatactactatacaggaaatctgattgttgcattgaaacaggatttgttatcacatcacggttagacatacccaaaaggcaaaaactacagtggtcatgatggctttacataagattttggaggagaaactgttagctccatgaaagcaggaactgtgttcactcttgaatgcctgctacctgcacatggtgaatgttctataaatgtatattaaagaaatggaggtccttagagttccaagatcaccgtcaatatcatcaccctaggcttcctcgtccttccagttacttcttttccagaagagtccattgcctcctttatatgaggtctacagagcgcgttcagagggctcttatcattgattcagcaatcacgtgtacacatagcactagaatgacttcacatatttgacctgtttaaaaataacgtgcagctatgacgaacagcgaacctttgattagggacacatttgcctgccgccagacactacaagtattatgtgtattgcttttttcaaattataatagtaatagatgattatgagaagaaaattagaaaataagttttctgtctctctataaaaggaaaataaaaattatccttaatctcaaggtaaccattgttaatattttgttgtgttttcctgagattttccccctagacttatatgtgtatctatatatttaaaaaaatgaaattagtagtatactatgtacacacatattgtgaatttctgcccataacattatatctttatcacctggaatgaggtctttaatgaaattattaaaattaaaattattctataaatgctaaatttaggtattttacaattttttttttttttttttttttttgagacaaagtcttgctctgttgcccaggctggagtggactgcagtggtgcaatctcagctcacttcaacctctgcctcccaggttaaagcaattattctgcctcagcctcccgagtatttgggactacaagtgcatgccaccatgcctggcaaatttttgtatttttagtagaaacggggtttcaccatgttggccaggctggtctcaaactcctgacctcaaatgatctgcccaccttggtctcccagagtgctgggattacaggtgtgagccactgtgcctggcccattttataattttgatcattaaaaaatgatgtgataaaattattgtgtattgttgttgatacactactctgattaattctttgggctagattcctaaaagtggaaagtaaggaataagaattgtgtaagtgtgcatgatcctagataaatattgccaaaatattttgcagaaaattcttagtttcagcttccagaagcagtgtctgtcatccatactccaccagaattgaacactaaattgagctttgcaattttagcatttaaaaagttgtatcatttaatatagaatagcagtctcttcattatgatcttcccttgcctagtaagtttatactcaagtcaaaatcggttaatcatgcatattgattccttgtttatctttttcttttaattctttaatacttctagaatgtatttgtagttaagtgaagtaagatacctcctcctgttgacgatttagtttccccacattgtgctgttttttttcttcactggattatgtaacaatatcttttcttttttttctttctttctttctttttttttttttttttttgagagagtctcgctctgttgctcaggctggagtgcagaggtgtgatctctgttcaaagcagcctccccctccccagtccaagtgattctactgcctcagcctcttaagtagctgggattacaggcgtgcgccaccacgcctggctatttttttattgtatttttagtagagatggggtttccacatgttggcctggctggtgttgaactcccggcctcaggtgatccgcccacctcaccttcccaaagtgttgggattacagacgtgagccactgcgcccagcctagagactctattttattagtgttttttgtagacaaagtctcactctgttgcccaagctggagtgcagtggcgccatctcggctccctgcaacctccacctcccgggttcaagcaattctgcctcaacctctcgagtagctgggactacaggcatgtgccaccatgcccggctaatttttgtatttttagtagaaatggggtttcactatgttggccaggctggtcttgaaatcctgaccttgcgatccgcctgcctcgacctcccaaagtgctaggattacaggcgtgagccaccgctcctggccgagactctattttaaagctgtcttctcccactgatttgccttttgtttgtggtaaaatcattttgtcttaaacactgtagcttcattatacatgttaacatctgctaggaagaatctccactcaggttaaaaaaaaaaaaatttgaagcaccattatttcaggtgaactttgtgtgtgtgtatgttgttttgtttttgcaattcttctccgctactcttccaaaaaagaaaacacaaattcattaggttttgattgttaataaatcagtttgggagaaaacatttccagatatttgaattactcattcaaggacatttcgtgtttctccatttactcaactattatctatctatgaagaaatcacagaaggtcatagaggttgtatacttttccttttgggttatttctggttaatgaatgctttttgttgctaatgtagaaggaatctttattccccattgtttattttatatttttaaattttttttcaattaaaaaaaatttttttttcattcctgagacagggtctcgctccgttacccaggctggagtgcagtggtgcggtcatgactcactgcagccttcagctcctaggctcaagtaatcctccacctcagcctcctgagtagctgggactactggtatgcgccaccatgcctggctaagttttttctttttcttttaggggcaggatcttgctgtgttgcccaggctggtctcaaactcatgacctcaagtgatcctcccaccttcacctcccaaagtgctggcattgcaggcgtgagccaccatgcctgaccttccttgtttcttttaggtgattattggttgtgtgtgaggaaagctctggtattttctgtacttatcttgtacctacccaatttgttgattgctcttattcgttataatagtctttcagttgactcttcctaatttttttgtgccgagaatcattgatgacaaataaggataatttggtctccatttttctggtacataatacgtctttacttaccatcagttgtgtgtcacttaggaatataaatggctgaaaataactgaaagcctgcctaataagggagtaggccgacaggggctgacttttctcaagttcaggcagtctggagggaaggagtctgtggctgctgtgaggtgctcaaagagggtgtgaggactgggctcctggcttctgtttgttcatccttagcctgtggcttttgtcctcgtgaacacaagatgacctccaggaattatgtctgtttcaggcaggaagaagttgagaaggaatgaagacaaaaggcaaaaaaggcagaatgacaggtcagcaagcgctgctcagccagtaggccctgcttctccttggccagaactgagttgcatgcagctggctagaaggtgggagatgaatgtgggtatggctagtgggttgggcatgggggttgggccaaccaagcatggttggtcatagggtcttgctgcattagcctgcacatccagaattgttacatgttgattacaggcatatttgtccttttttgtctatattaatgataatgcctctgtttctcaatgtgtaaggcatcttttggtttaagaggttttcatcatgttgaagaattgcctgtcttgttttcttgggtgatttattaaggatgggtgttgaatgtcatcagatgtcattttggcattcatttggattcagaagtggttgttacacctattaattgaggtaggaatagattacctagtagtaatccctcctcaaattcccgtgttaaactatttttggttgcggtgggtggctgtttaaattcctaattaaatttggtttgctaacatattcagattttttaatctcttattttaaatgagatagctttacagttctctttagatgagttcttttccagattttgctgtcaggcctagactagttttgtaaaatgaattaatgacttttcctttttaccttctctgtaacagtttttatagtgtggcaataaactgtcctttgaaggtttggaacaactcacttgttaaatgcctggaggctgacacttaaaaaaaaaaaaaaagaatagtttttgttgtgtttctttttgttgttggtgttgtttttagtcttcagtgcagtggcataatcttggcccacttcagccttgacctcccaggctcaagcagtcctcccacctcagcctccctggtagccgggaccacaggtgttttgccgccacacccggctaattttttattttttttgtagtttttgtagagatggggttttgccacgttgcgcaggctggtctagcattactgggctcaagtggtccacctgccttcgcctcccaaggtggtgggattaacaggtgtgagccaccatgcctggcgtaaaaagatggttagtttttgttttgtgacagctttaaaaaaggtcttccatgggtgttggtctgttccagggttctggttctttcctctgatgctcttttttttttttttttttttgaaacaggatctcgctcttgtcccagatggtgtacagtggtgtggtcatggctcactgtagccccagcccactgggctccagcaagcctcccacctcagcctctggagtagctgggacccatacctggctaatttttaaatgttttttagagacagagtctcgctatgttcccatgctggttttgaactcctgggatcaagcgaccctcctcccttggcctcccaaagtgttgggattacaggcatgagccaccatgctggccttctggttctttttaaatcaattttagtaatttagtaatttccagcaagtcaattaaaaattatagctcagttgtatgtagtattttctgtgtggtgttatgccctctgtatctgttttctcagatgttttagttgcttttctctcttaatcttgattagatctgccagagctgtgcttattttgtgtccccatccaaatccagaattaattgccgtgctccacatgttttggtcaatggtggacctcgtctgtaacagtagtcccatgagattataatggggctgaaaacagtgctgtcccctagggatatcgtgtctgttgtagtgcaaggcactgctcacgtgtttgtgttgatgctggtgtaagcccactgtgcttccagtcagatgaaagtgcagcgcatacaattgtgtgcggtacctaatacttgataataaacaaccatgttactggtgtatgtatttactatgctgtacttttaattgttagagtgtactccttatacttattaaacacaaaattaattgtaaaatagcctcaggcaggtccttcaggaggtatccagaagaaggcattgtgatcataggagctgatggctccgcctgggttactgcccctgtagacttccagtgggacaggatatggaggtggaagacagtgacatggatgatccggaccctttgtaggtctaggctaacgtgtgtgtttgtgtcttagcttttaacaaaaaagtttaaaaagttaaaaaaaaaagttaaaaatagaaaaaagcttatagaataagaatataaagaaaatatatacaagaaccaaaatttaagaaaaataaagtttgtaaaagtaaaaaaagttgtgcttaagctaagtttaatttattattgaagaaagaaatttttaaataaatttagtgaggcctaggtatacagtatttataaagtctacagtagtgtacagtaatgtcctcagccttcacattcactcaccactcactgactcacccgagggagcaacttccagtcctgcaagctttattcgtggtggtactcccatatacgtatgtatacttttttttttttttgagacagagtctcgctctgtcgcccaggctggagtgcagtggtgcagtctcggctcactgcaacctccacctcccaagttcacgccattctcctgcctcagcctcccgagtagctgggactacaggcgcctgccaccacgcctggctaattttttgtatttttagtggagacagcgttgcaccgtgttagccaggatggtctcaatctcctgacctcgtgatccacccacctcggcctcccaaagtgctgggattacaggcgtgagccaccgcgcctggccttttgtttcgtttttaagagacagggtctagctctgtcacccaagctggagtgcagtggcgtgattatagctcattgcagccttgaactcctgggctcaactgattctgttgtgtcaccctccccaagtagctagaactacaggctcatgccaccacacttggctaatttttgttttttaattttttgtagaaatggaatctcactatgttgcctaggctggtcttgaactcttggtgtcaagcaagtgcttggcctctgaagtgctgagattataggtgtgagcctggccatatgtactttttttttttttttatccttcttactatatttttattgtaccttttctatgtttaggtatgtttaaatacacacatacttaccatggtgttacaactgcctgcagtattcagtgcagtaatgcactacaggtttgcaggttggtagcctaggagtaataggctatactgtatagcctaggtgtgtagtaggctataccattgaggtgtaagtatactctgatcacacaatgatgaaatcacctaactgtgcatttcttagaatgcatccctgtcattaagtgatacgtaactctgcttctttaagcctctgtagcactttggttatgttaggattctgtgtctttacaagtctgctttgctgatcgattgtgacatcttgagggcggctgcactactttctgcctgcaccttgtttcgcatgtctacctggcgcatgacatacacctcgttgttcagttcttgcttctctgcttgtgtctttgcattcaccaccagctattctgatagttatcaggaggttttcattgattgcagtctcgtgcaatgggtgcaggtaatgggtagccttatggaggagaaaatgcttacctatttgggttcattccaaggagtagttcaaggataaacctctaagtttggggagtgctgtaatttgctggatatgtgagccatagaagacagcttggatggcatctgatgcttcctggctgcagggatggaggcagcagaccctcctgcctggggtggttggttgccatccctgtcgggggctcatgctccaccctcaaggctattcttgggggagttgtgacatggctttcataaaaactcagtggaattttaccctgtgtattagttagtaaaggtgagtctggttcagttggtttgagtcaaaaaatctgttaatatctctgctttagacctgcatcaggctaatacttgaatttagggtctgtccctggtgtcatctgaatttttgtttgctatgtgtgaccaaggagatggtcactcttcaggatgggtgggtggaggggagaaatgctatgatttctgttgggtcatgtgaaatcaatttggaatgtggatggggcccttacactttttcttttgagcttagtgattttctgtgtagggtggagagcgattaggaaggaattcaccacccttaggtcctcaggcatagggtcttctaggggcaggactgatgagtgaacagcagggtggatggagcagaaccgttggaaccttcagggcaggacctgccaccattatttggtcacaggaagtgttcagtggtgaacttgttggaaatgattttgagtaacttccgtctcctaaatcatattaggactctttggtctcctatggttatctgagttgttttccaggaggagctgggaaggtaccaggagaaagatgactgtccctctcatgtttgctgagggtgttcctgtaaggtgagctagtgttccttttagggcccgtggagaccgaccttcacattgaagaagcatatctgtgctccgagatgttttcatggggagaagtgtcaggtgtaattataaaaggagtctttctctttaaatactgtaggcgatttagaaatagtggaggtttaattgaagagcttgtctacgtttttacattttccttaggcacagagaaactagtatctttctctgggttgcctttttttttggagacagaatcttactctgtcatccaggctggagtgcagtggcctgatctcggctcactgcagcctctgccttccgagttccagcaattctcctgcctcagccttccaggtagctgggattacaggcacgtgccaccatgcctggctaatttttatatttttagtagagatggggtttcaccatgttggccaggctggtctggaactcctgattaggtgatccacccgcctctgcctcccaaagtgctaggattacaggcatgagccaccacacctggcctgggttgctttttaaattcatacctactgtcttatttgggtctcaaatgtgatcagtggttatacttttcttgctatgcatttaagttggagcaggctccggggcaccacttccctccctagagttgatgaacccctcatatcagtgacctccccatgtcacagtgtatctcgtgtgcactgctagatattctgatcacacagtgctgagattactggtttctctccctttctctttctgtggttatagggattctttaagggcaggcaacatgttctttgtttccataggatctgacaaagtgcatggcataggtaggtgttcatcaaaaggggtggaatagggttgatctcaagggttttaagagagatctgacgagtttgggtgtgtgacttaaaaagcagatacagcgccttttcacggatacacctccgtgattcctcaagtggtctggctgtgtttattttaggattctaaaagtaaagtgttctgttctgagtctttcacgatctgatgttctccagttctgtgaggtctcctcctttagtcccatcattggggctgtttctgctcggaaggccaggaagttgctggaagtctgctgggctttgcaaagggacttttgcttgtgtgggcattgcccagttgtgttacaacttgtttacagccgttggtttttaagggatgaggtaatcttagctcagcttagtgtaatacacaacagttttgtttattgagaaaatcattgttgaagtttttcagatgttagagatgttatgaattgcaatcaagtcggtatcctcttatataagtgcatctgacaagcccatttcacaactacatctcatcagtcacagttggatggcaaggtttattgtttaaagtttttgttttttcttttttaagttgggaaaggaagacagatggtttcagaagccaagaaagggcacaaaggcgtggatatttggaaatcgggacataattcaccattcttcttaattttttctgatctctaagacactgagacagctgttaattgaattgcttgttcacagtatttgagacgtaatgaaatgtgagtgtcctaatcacctggcgggcgtagatctttgggatcctcctggaggcttagtagggctgccctgagcagtattgtcttctccagctgggcctctgagctgtaccatgtgcccgtgctcagcctcagtccctccctcagccagttgttaaatcactttggacgtgtgacagcctcaacatgtcacagctttaaaagttcagattttaaaaaggtaaggaaatgatctcctagtgagacaacttctgcctaaaaaataaaagcttctaagacataaattctgtgttatgaacaacttgcaattttcatagttttcagttttagctctggcagcctctgatagatcttaaatatgtttatcacagctggaaaaatgttttattgtcatctttgtttatcataatatgccacctactctggttgtgtcttacaactgtagctctgtggggttttttttgtttgttttatgcttgctaatgggggaggtggggggtgtgggcggatgaatataaatgatacctagaaattgaaattggaaaaaaaaatgtattcagccagtactctttccaggttatagctaaacgtcagttggcaacctctatgctgtggtttattgagtaacacttaatacttagcacagccctcagtgaagatcttttatggccttttctgaatgttatacaaacataactaaagcttatccagatgaggacagggacctttctttccttcctttttaaatggagcaaaatttggccactgggttgctgtggatgagagagtagaaggagaaaggcagtcatcgggagactgtgtgctgagagagcgcatgtgggatttggcttcaggaagtctgggcttgcattctatccagcgctaatatttagtgagtgtgatttggggcaaattatttcgtctccctgagcttcagaatgtttgaaactttgtgaggagtctgaccccacactgtaggctccctccatgtatatatttcttcttccttttccttttttttttttttttttttttaaatttttgagatagtgtctcgctctgtaaccccagttggaatgcagtggcatggtcatggcttactgcagcctcaacgtcccaggctcaagggatcctcctgcctcagcctcctgagtagctggggtcacagatgtgtgccatcacgcctggctaatttttaacattttttgtagagatgggagtctcactatgttgcccaggctgcactcaaactcctggactcaagcagtcctctccctccagcctcccaaagttctgggattacaggcatgagccaccatgcccggctggaactgttggctttgaagaagaatgatgctgtgcttgcctttgcagtcctgtcaccatacttcctggaaagtgggtggacacgctggatggtagatgttgagttctttagatgcctggatgcttacatgctttgtgtgggttcttactggggctgtaacttactagaggacagactccaacttctgcttacttagtctggggaggttaataataatctagggcacccgcttcccagtgggtttccatcagtctcctccagcccactctactctctgttagccagctgggcacctcttcctctgtgtcccttcggtatcttcccagtggctctttccacgactggctcagaccatgtgtatatctgctcattgtctgtccagggtccctccaaagatgcctctgtgggctgggcccctggtggtgcttcctccagataattgttgaagatggaacaggagtgtgcaagaacaccagcgtgcttccagtattcaggtctagcggcaggtcccaggcatcagcggctcaccactccaccgcaggtagcctgattgcccagccttggagccgcagcctccttgggtggtgtggcagctgtcagtgtctgaaaccattttgaactttaaagggtggtgtcagacagcagctattgaggctacttaaaagaatttttttaaatgtacgagttcagtggcattaagtacattcatattgttgtgcaaccatcaccactgtccatctccagaacttgttcatcttcccaaactgaaactccatgtccatcaaacaactccccattgcctttttccccaagtctttggcaaccgccattccactttctgtctgtaaatttgactgtctggatacctcatgtaagtggactcgtacactatttgtccttttgtgactggcccattttatgagcataatgtcctcaaggttcattcaggctgtagcatgtgtccagaatctccttcctttttaaggcccaataatatttaataatatatgtatgtgtgataacacatttatataatgtccattaccatgtggtatatatgcttatccatttgtctgtcgatggacacttgagttgctcccccgctttggctactgtgaataatatgactgtgatcatggatatgcaaatatttccttaagtctttcagttcttttgggtatatacccagaagtggaattgctggatcatatggcagttctatttttaattttttgaggaaccactgtactgttttccatgtagactgcataagaattccaatttttccacatcttgccaacgtttatttttatttatttttttaaattttttatagtagctatccattctaatggatgtgaggtggtatctcattatggttttgatgggacttttgagttttagcaaatatcaatgaagtatttaattttttttttttttcttagagacaggatctcacattgttgtccaggctagagtgcagtgatgtgagcatagttcactgcagcctcaacctcctaggctcatgtgatgctcccacctacgcttcctcaatagatgggactatgttcctgcgccatcactcctggtgaatttttaaatttttgtagagatgcggtcttggtacattttctaggctggtctggaagtcctggcctcaagcagttcttccacctgaacctcccaaagtgctgggattataggcgtgagccactgcacctggcttatttaaatttttatgggtatgaattcacttaaaagctgaaggttttgagaggagagggagcatgtgaaaaaacctaaaggttttgggaggaggaggagaaggaagagagggagcatgtgaacaagagcaactgattacttccttgtcattcatttgcccagtgtttactaagcacctgctgtgtctcagacctgtgctggtttggcccttgtgaaggacagtaaatacagtgcagttccagctgcgcatgggatcacagtccagtaggtaaacgagtgcctaaacttaagagaaatgagtgcagttggggtcctgtggcggtgaaggggcgagtctgcacccaggcgagtgttaaaggcctggcctagagaagatgggtgttttgatggaaggagctgctgggaagcatgtgtactcggtgtcttggagtttagaaacctcagttggctccatgtctcgtccttagtaaaggaatatcgggagctgagactggatgtattgacacaggtcaaatcacagagtcttaggccatttcaaggaggttggatttttctctggaaggcacagggaggttttgaaggacttaatgcagaagaatgggcactgtcaggtttgtggtttggaaagtccgccttggtagtagggtggagggtgcattatggagggctagaccagggtccagcccccagcgagatgctgtgtggtaaccaggggagagagaggtggtggtgttagaagccacgacttggcatagaagccaaagcatccccaggttgtcattgtgtaattaatggttaagttggggcaagaaataaagctcttaaaagtgtccagctgtagagctctctgcctgtttttatcttcagatttttgtctttgccatctctggcctccagtggaaggccgaagttacttaacttccttgctggaagcagggctcctcatgattgccagcccctgtttggtagtggtcctggagtgctgtggaaatgggatacttggtgccacttaccttggggctttgctcctgaactgcagcggtgtcttgtgctctgtggtttgtagcatggaacagaggctgatgggcggggagtttgagtcccagtgattgaggccccctgcctgcctgcaccttactgaaggaaggacatggtggcttctcagtgtgctctctggtgatctgaacctagattcttgtttcacgggtagggggcagggttttggattcagccctggccagccctggcccaagttcatagtgtcagtagtatagttctcccaccacccccttctctcctgctcctgttttctcccccgccccttctctcctactctccttcctctcccactctccctcctctctctgcctttcacttccccccacactctctctcccccgctcccaactttctttctctcttcgactcaccacacaacacacacctgtgtgtgtgtgtgtgtgtgtgtgtgtgtgtgtgtgtgatggcactgttatttcatgtgtatacctttgcgtagcgttggcacatgtgggaatgctattataatgctttcgttgggggtctgtgctaaccactgctgagtgtgcttcatgttttctagacagcatgagaccagagctctccaccttgccattagctggtgggagaattttgagaaagtcacccaattgctcttaagtcctcatttttttttttaaatctgtaaaatggtatcacagatgcttatagctcaagactagttgatgagggtctgtgactcaaaaggccccatagatggggttcagagggcctttggaaatggcgtgcaagctctttgtaagtgtattttttttggagaaagggcccagctttttatcagacatcctgagagattcaggacctaaaaaataaaccttgattaatcttggaagcctctttttacgcagtacgctttgattcatcagtatatgcatgtggatgggttctcagatggcctgatgtttctcctccttcctctgtgtggtgggcgacgactttggctgcccagatgttaacatcagtaagcagaagctcagtcagtgttagcaaaattaaatcactctgcaaaaatcaatgttagtgaaattaaatcacttgatcttaaaagcagcatgaaatagcagtttttcatcttcattgtgctgttttcccactctagatatcttgcagattttttttggttgcttggttggttggtttttggcgtccttttcaaggacaagcagctttggacagttgcactacttttttttttttttttttttttttgacagagtcttgctctgtcacccaggctggggtgcagtggcgtgatctcagctcactgcaacctctgcctcccaggttcaagcagttctcctgcctcagcctcccaagtagctgggattacaggtgtctgccaccacacttggctaatttttatatttttagtagggacaaagtttcatcatgttattcaaattctgacctcaagccatctgcctgccttggcctcccaaagtgctgggattacaggcgtgagtcactgtgctcagccagttgcactacattttttttttagatgccattgttgaggatccaggggtttgtcatagattgattaatcagaaagtattaatctaaagtattagaatatattgattgcaggcagggaccttgcatagtttaaagatgactcagaaggcacattaggttcttgccacactttgctgccatcacagatggatgtgagttgcccccttatataggtctctcgggatgccccagtggagaacagcattgatgttgaacagatcctgtccgatggagagataccagcgtttcagccagcggtgtgagtgagggcaggggccacctctgagggtgcttgctccctcacactgtcctcacgctgccctcaagctgtgggcaaaggagagggatcctgtgccatcacagccctagaagcagaattccaaaatgtgggctcctttgggtgtggtttgggggtcaaggagatagagcaagtaaggaatgaactttgagggtttatgatcattttcatgatgataatgacctaaaaacatgcttggctgggcatggtggctcatgcctataattccagcactttgggagactaagacaggaggatttcttgagtccaggagttcaagaccagcctggacaacatagggacaccccatctctacaaaaaaattaaaaaattagccaagcatggtggtgtgcacctgtagtcccagctactcaggaggctgaggcaggaggatcccttgagcctaagaggtcaaggctgcagtgagccatgtctgtgccactgtactccaacttgggtgacagagcaagactatcccaaaacaaaaacaaaaacacatgcttatggtaggcaattaaaacaggaggtaaggagtaaacatgccaggcccctcctcctctcctctgactcttccttcttcccccctgcttcccaagggtaagctttgcagatacttgctatgcaagcaaaaatgctattcttagccatcgtttaaacacagatttgcaatttgtggtttttcatttatataaattttggctctcttcctatagcagaatgatctttgtttttaaaatgattttaagtatacaattaatatgtgaatgtatgtttcttatggaaattagaacaatacacagttacagagtagaaggtgataggtgatatagctcaccctctcctcttcctgctactctccccagtctgcttcactccccggaaggaactactggcccatcagcatgtctccttccaggcattttttccatgtggttatgtccacctgcataagaaactgggggcggcagggtggggcggtgttggcgggtcaggcagaagcaagccacagagcagtaagggtactttttaaaaaaacatttaaatagatccctgttgtcctgcggcttacatgctcatgcatactcactgtttctttaaataaactttttcttttagaatagttttagatttacagaaaagttgccgcgatagtctagagagatcccatgtacctcttaacagcttcgcctctgttaacattctgtgtcaccatggtaatttgccacagctaaggaaccagcattagtccatgactgtcagtgaactaaactcaagactttttttggattttaccagttttgcccaatgttcctttcctggtctaggatcctgtgcagaatagcgcatcacagcacattacatttagctgtctccttcacctcttctggtctgtgacagggtctcagactttccttgtccttggtgactttgacagtttcgagggacactggccaggttttgtgcacactgccccttaatttggagttgtctcatggttttttttgtttttttttttttttgagacagagtctcactcgtctcccaagctggagtgcaatggtgcaacctcgactcactgcaacttctgcctcccaggttcaagcaattctcctgcttcagcctcccgagtagctgggattacaggtgcctgccaccacacccaactaatttttgtatttttagtaaagatggggtttcaccaggttgggcaggctggtctcgaactcctgacctcgggtgattgcccacctcggcctcccaaagtgctaagattacaggtgtgagccaccctgcccggcccatggttttcttatggttagtctgggaccatgggtttttgggagcaagaccacagagctgaaatgccctcccttcagtgatttgtcagcatgacctatcaccattgttgttaaccttcaccacctggatgaggcagtgtatgcgtggggacatacatctatttgccccactgacatgagggttggatctctagaagaggagtcactgttcagaggttataggcatttgtattttttggcagatgttgtccttcaaaatggctgtacacatatgctcctcccaaaagtaggagagtgcctgttgccccatgtcctcactcaagcttggtgttattagattggtaatttttttgtgtgtgaatctgttaagttaaaaatatttctttctttggccgggcacagagtggctcatgcctgtaatcccagcactttgggagtccgaggcgggcagatcacttgagctcaggagttcaagatcagcctgggcaacatggtgaaaccccatctctaccaaaaatacaaaaaaattagctgggcatggtggtgcttgcttttggtcccagctacttgggaggctgatgtgggagtatcacttgagcccaggaagttgaggctacagtgagccgagatcgtgccactgccctctagcctgggtgacagtgtgagaccctggctccaaagaaaaaaagaagattgattgagatagggtcttgctctgttcaggctggaatgcagtggtgtcatcatcatagtttactgtagccttgaactcttgggctcaagcagtcctgctcctttggcctcccaaagtgctggggttacaggcatgagccactatgctcagccaagctaaaaatatcttagtgtgcatttctctaattgtcagaagtgtatttatttaccataccctggaaaccttatgtaagatgatggtgagtttggactttccagtaacatttggaaactgtttagtaccaagctctcattaacaatataaacaaaataggggtctacccttaaggaatcaaagccattatctaaaagctctttcccgcaacaactacctgagataatgtccttggtcatatgccccagcatttaaaaatggagttagtgagagtctgttgtttaccacctgatacattggtaagagctgcttgatggtatggggacatcagtagggaggatatagacgtagccacccccgccctagatagtaggggcctcagggtggggtaagcctgggtgggggaggtatgagtggtggaacagtgggagaccctggatccttagtctccagcgtgattgcattttgccaaggctttgtcccatgtccctttgtcccgtgttccatttgcccgtggtgttgcctagagagcatggaggggctggtggagcatgctctgtggttccctaacccagggctgtgtggggagagcttgcagcacccccctgaccccatatgaacgtccttgctatttcctgctgtgccatccagcaactataggatgctgtgctgtggctgggagacctgtttggtcttggaagctgggtcctggatgagcagaatgaggcaggcatagaggtgatgttggctacgggcaggggagcgtttgctttgccttggagtagtgccatttccatgtagaggggcaagatttaccaccctgttgtggggatttgagactttgggttttgttttcctttacaccttgagctttgttctacagcaggtccctgggaagactggtccacaaagctgctgaatggggctgctgtccttcagccctgcctcctgctgcagaatgcagaggacgctgtagacttgcttggtgggtgcctggggttttctgcctccctggtgcactgggcacagcggcttgcctgccttttgggtcgtctccacctcccagggatgtttttgttccctgatcgaatgacctcctgttttgtttgttttttgagacggagttttgctttgtcacccaggctggagtgcaatggcatgatctcggctaactgcaacctctgcctcccgggttcaagtgattcttgtgcttcagccttctgagtagctgggacttcaggtgtatgccaccatgccacgctcatttttgtatttttagtagagatggggttttaccatgttggtcaggctggtctcgaactcctggcctcaagcagtgcgcctgcctcagcctcccaaagtgctgggattacaggcgtgagccaccgtgcctggcctgacctcctgtcttctgtttttgcccactgtcaagggtagacttcttcaaggctgtacttgtgctatcctaaagaggagtaatgggagacatttctgactttgtcagcatgctgcttggcagcacctgcctcgtttctggtgaccatttggaaatgtgtcctttatctggtagcaaggagcatttacattgatccctatgcacttaattggcatacttttattcctctggattttttttttaaagcataattgttcgtgtctacatgatgtaacatgctgctgacttttaagcaaattaacagagttcgtgctgaagcgcaagggtgcagggaaacaaaatgggagggttattaaaggggtgaggcggctcctcaaagatgtcactgcaccattcattcttgtgttcctggcccatggcaggctcattaatcctccacgacaatccattagcatgcctgtcaacccttcagagaagatgagccataggaaggcttagggatccccacttgaactgctgtgtggctctatgaacatccccaccttcctggagtgaggtggttgtggccacctgactttccccattttttttttttggacctcagcctccagcgctcctgggccagactcagggtgggggggatgcaggtgccagtgactgacacttggcccctcacacttcactgcctgatttgctttaaaggcaagggttgctcatgcttgtctgagctctccatctgtttgagaattatattgttctcaactggaacttgtaaaagagaaaaaaatgtacttctcaatttccatggaagaatatagattttctggtggggtggaaactttcttagcatgaagggatctttgtgtgatctgcgcatcagcactgaataaagaatgggtgcgccgaagtcggggaggccgactttcctgtggcttgctggggaaagtttgaactgtgtgtaagcagtgcgtggaaggaaagctaagtgtggagataacgaagggaatgggatttaatagaaacagggtgtgatgagtggcagttgcctgatgaagtggaaatcttgtgttccaaatttgtgagatccatttctgtcctctaaggaaaatgttgtatgtgcaggaggagttcatgtagttgggttagattgtgttttctgtctttattttttttcctgcctctatgggttgtgaacaaaaacaagaatttgatattctgcagtatagttaactcgtgcaaacagtgtatgcttttcagtgggatataaggtctgaaataataggattttccctagtaagtcagtttcattcctttacatgtgggttatgagatacaaagtgaagctctgtaaagctttttacgagctccctgtgttgccctcctttgacgggtcaaggcattggggttgacagaggtttctactctcagaggctttaaagaggtgcccactctggtgagatggctgtcagcatgcacgatgtgtgtgagagagcacctcttcaatcatatgcacctggctgtagcatccttgtcagccttaagagatacctccaaagcggaattttctacccctagaatcatgtgaggtcatctcaatttaagccccagctctgctccctaaattacctgagtgatcccaggtaggtcatttgctcattgttaaccatcagtttccttagctgcaaaacagagcagataacaccccaaaagagttctcatagtaaatcacatcaggcttacacaatctcagaaatgtgcagctccacaggaatcttcattacctctttaggcagtccagtcgggtttcaaatgaatcctactgtctgttcttatatggaaccacagtccctcaccctgtgttgatctaagttctctgtttctctcctccagcagggtcataaagagcctgaccagtccccctccctggagacctttgtgtgctgggtttctgcagccgttctccatgagaagggacttctggtccctgctctcacttggatgttcttccactgacttatctctcttaatgtgtggaggcagaaacccagttttcagggtctctcccctggccccttactaagtctcccttaggtacagtctaagactgcctgactttttcttcttttttttttttttttttggcagccacaacatcacatcgtcacatacagaaattatatccaattaaatctcctaagtctttttcacacctcctacatttgtgcatttctttttttgcacccaagtgtccaaatagcatttatttcctctctattgcaattccaatctgttgatctttttagctcttgactctgtcatccagtgtatttgccattgctcctggaaacttgtcatctttgaattagataaacattttatctgtgccatcgttcaagtaattgataaaaatgttgaaatctacagtactcagaaagagacctgtggcctcccactagagaccttccttggtctgttcattaatcagcactttgtagggtaaattgaacatttactaagctattcagatgtagttcatatttcttcaccttgtcaacaaagagatcttagcaaggcattgtagaccaagtatgtgttcctggaatatacatattaagaaaaaatccttatgccaagaaaatgggcacatccccaaaacccaggttattgtagtttacggcttctgacccagggcttcactttgtagcagtgtttttcttctgtttttgcctttggctgataccactgctagagtgcagataagagaatgttactaccagggggcttgagtgtcgggctatgattggctgtcatctggagcagagtgggactgagctgctcaggagaaaggtcttcaggtgattttttttgggaagctaagagcactggttttagacatcctctcctggctgatgatgggattggccttcatggggctgctgtctggctgggctggtgggcagaggttcctgtgggtgtggatggagaaatcctaaatgccgagggtacctggtcttagtagaaatcgtaggatgcctcagtgaagaagtcagggatgcggattgtcctccggatgcttggatgagcgtgcagtggaaaaagtactcctttgggggaagaggtgaatctggaggtgttagagcagaagagtaaatgcagaagttgtagcagatacaaaggctttggcaagagtgggagtgatcattgaagggaaggcaggggcttgctgggacaggctggagccgtgatggaccctcatagtaaccctgctgcattttacaaaggaagaactgtgttggggtacagatgtgccaaacactcaaagttagaaaatcaacgcagtcggttgtggcttctgcccttgaaacatcagatagtgagaacctgccactgttcagtttgcagagtggttggttgcatacagtgttttagctcttgcccactcaatacagaggttgcatgcgggcgtccacctgctccgccacctctgcctgcttgtggctgtgtgcccagagcccatttccctggggagtcagtgcagcactcctgggggacccttctgtttgtgtcctgacgaatctgactgtgctggatgcagtcccacagccacacctggtatgggtggcatctttaaaggcctggcctgtgtgtgctgtatctgcagcagagctgtggccaaacctgctttccttccatctgggttccccttggttctcggtggtggacgggctgtgtggtctcccctcagctgtccacttgcacttgtgttaaaatgcggcagaactttccctctatacttaaattgtggtgaaatacgtatgacataaaacttaccatcttaacttttttttattgagacaggatctcattctgtcacccaggctggagtgcggtggcgcgatctctgctcactgcaacctctgcctcctgggttcaggcgattctcatgcctcagccacccgagtagctggaattacacgcgcccgccaccatgcctggctaacttttgtattgttagagatggggtttcgccatgttggccaggccggtcttgaattcctggcctcaagtgatccccctgcttcggcctcccgaagtgctgagattacaggcgtgagccgccgcgcctggccttccttttttttttttttttaagagatggagtcttgctctgtcgcccaggctggagtgccgtggtgcgatcttggctcactgcaacctctgcctcccaggttgaagtgattcttctgcctcagcctcccgagtacctgggattacaggcgccaggcaccatgcctggctaatttttgtatttttagtggagatggggtttcaccatgttggccaggctggtcttgaactcctgacctcgtgatccgcctgcctcggcctcccaaagtgctgggatcacaggtgtgagccaccacgcccaccggcctcccatcttaacattttaaagtgttcagtttaagtacctttacactgctgtccaatcaatctctagaacacttttcatcttgaaaaacggaaactctgtacccattaataactcccattctctcctaccacagccacgggcagccactttctgctgtctccgtgagtctgactactttgagtacctatgagcagaatccgcaggatttctccttttgtgactgccttatttcacttagcataatgtcctcaagctccatccaggttgttgcatgtgagaggatttccttcctgtgcatgaactagagtgatgcagggactgacctctggccatgtgatgggtggttggtgatggatccaagaggtagctggtctctgaatactagcccagtccttttccttgctaggaaagtccccagatcagatagaaagcctcagtatttcaagaagcttctgttttgacaccacatccatgaagaatcacactgcagggtaggggaacagatgagtgggatttctacactgttatcagctagacttagataactggctaattgaaaagagtacaggtcacttaaggaaactggagcattgtagggcaaggtaaagtgcttttgaaatgaggatgtgaactgtaactggaatgatgtaatgtgttctacaaaatgaagccagtgagaggacaggggacacagggccgacttttatttaggacatttgcctggttctgagaagaaagttgaaagtcacgagagagagggaaaggaaggcagaaggaacttggtttttgcaggtgcctgctcagcatgggccttgccccagcttggctgtacctcacagcaccatccactggctctacagtctgtccttcggaggtttagggtgctgtctcatgcacagtgggtgctaggtggtagtgaggacagggtgtgggactaggcaggtgctgcccctcggaaggcctcatggtgaggcaaagatctctggctccgagggactctatctcctggtgtcctgcttcatcgagaagccagccacccatgggaactgtggataattagaaaggcttagaggctcttctaagggtgttttttgaaatatggagacctagaatattgggctttgggatattttaagatgagaaaggcatttggagtaactgtcagagcagataaagttgtttttatgaagatccgggaaaacggttgttacaaatacagctctgcaccaattctgcgccagtctgtttggctacagatgctttcagtggaggggacactggggcttgtgttccctttagtctttgaattcccgttaaagtttccatgtcttaagtggcgtggcaggatagaaacatctcacccatcttagtaagttctttgctgtatgtagcactctggttttaacgttctgagccttcaggactgcccttgatgtgtgcatttattttgttgatatgcatgatgtgtgggtggctctgcggcagtaaaacagttcacattcaaattacactcggtttctaatttctgttctcagagtttcctctgtaatggaaatctcttacattcttatcattgccttcagttattgaatgtgttaggtggccaggattgctgtctgtgtgaaatgggaatgtatatatacaacgtaaacatgttctgattgacacgtgaagataaagggcttaacatgaattgtgtcggtttacacttacacagaaaattctactgtaataaactgaagtgtcagtagtgtttgttatcataacattgtctttttccctcttttctgatctctgatttttcaattaggaatgaggcctaaagaaacccatgctctctcttctctgagcgcaaggagggtgtgctgagaccttgaagggcacagcatgggaggatcatatactagggagagtctgtctccaccccatttttcttctgctttgctttgtttcgtagtttcttcgggcttcttgggggttttctgagagagagaatgtcaatttgagaagtaacaggtgcacaggctttacctgcaccacactgcagataaggtgggtagggagggtagtgacaggtggtgtggtgggttattcagttctttcctagggcagtgggtctcacagggtggtgcttaggccagcagcatcagcatcacctgggtgcatattagaaacaaattttggggcctcacctcttgcgttttaacagttccttcaagtggtcctgatgcatgttgaggactttgaacactcctcctacaagcaaagtgaagttgacctcccacacacttgtctcagtctgctttctagcatctgtcccattgcctttgttgttctccccgccacacgggctgcacccctgggattcccccagctgccaccaggcatcagctccagctgcctcccagggtgtgctcctgcctctgcttggagtaccctgcctcccactcttcctggcaagaccctgctcatctttcagggtcgtctctgctgagaagtcttcctgacctcctcggagatagggagttgtggggccttgtctttatgttcccagggttctgtctattgcgctattaaaactttttttttcatttaatttgccacttgctagagagatggttgttctgccttcgttgtgcaaaattcagtgatacactaatcctctcctaacctcttaaatcattttgactttcacagagtgatagtgtctagagagggtttttgttgtactaagttattggttccaaagaattcattttaagaggagtaaagaactactatagtatgccgcttactgagacaaaaccgacttctcacataagcccaaaggttttgttatgttggattttaccattagagttaaagatgatgattggttcactaatgtgctttaccttcacagtgtgcctgtagacctgtagtaaaagaaggctaattatgtttcctgatgtcttttatttccaactataagctaagcctatctcattttttttttttttttttttttttttttttgagatggagtctcgttctgtcacccaggctggagtgcagtggcgtgatctcagctcactgcaagctccgcctcccgggttcatgccattctcctgcctcagcctcccaagtagctgggactacaggtgcccgccaccacacccggctaattttgtttttgtatttttagtagagatggggtttcaccgtgttagccaggatggtcttgatcttctgacccgtgatcctaccgcctcggcctcccacagtgctggtattacaggcatgagccgccgcacccggccaacctatcccatatttttaaagaagagttgatcaagtagttacccattttaactaaatggataactataacattctttaatggaattgttgacagagggataatcagtgtttttgctaattcatgccaccctcctttgttgtatgttagtaatatttacattggggcaacaaaatagatcagtatttccattaatgtttacttaataacagctgctaaaaggtattactgtttgcagtaacacaaaagcacttacctgattcttatgccagcttctatagggtaggtagtgacagcccattttgcaggtgaggaagatggggtttagaggtgaggtgtgtctgcctgagagcaggagctggtaaatggcactctgggctcatgggagtcacgctgtttttttttttttttttttttcctaggacctcaaggttgtgtctaagacataatttacagttctcgtgtaggtcttccaaatacttagctacacagctttggggcgttttctcagccaaatgcttttctttagcccttctcatattaacatttagttcttagggatttattttcaaaatatatatagcttgtatatgccattcacctaagttgttagagcagacattctgcctcttgatctttagaaaatacctaagagtattttgttaacagtactcatttcagctgaaagactttattttaaaatttaatttaattttattattgttttttgagacagaatcttgctctgtgtctcccaggctggagtgcagtggtgtgatcttgacttgttgcaacgtctgccttgtgggttcaagtgattcttgggcctcagccacccaagtagctgggattacaggcgtgcaccaccacgcctggctaatttttgtatttttagtagagatggggtttcaaactcttggcctcaagcgatctacctgccttgggctaccagagtgctgggactgcaggcatgaaccactgtgcctgacttttaaggctttctttaaaatggcatcttttggccaggtgtggtggtaatcccagcacttctggaggctgaggctggaggattgcttgagcccaggaattggagaccaacctgggcaacatagggaaaccctctctctgccaaaaaattaaaaaacaaaacaaaacctaggtgttatggtgtacccctgtggtcccagctgcttgggagctgaggtggaaggattgcttgagcccaggaggtcgaggctgcattgagccacgattgtgctgcagcactctagcctgggtgacagagtgagaccacgtctcaaaaaacaataaaaaataaataaaatgacatctttggagaagtgaattctacccaggtaccaagcccctgcctgcccctcccaactcccttccctgactcccagcacccccatctgttttggttctgctgttgccattctctggctttggggactttgctgaggccccactgtccccatcttccagctgtaccctttctctctgcttccctgcttgtcttattctttacagggctgcctgggatctcacattccaaaagtttttgggtttgtttttggatcatgccaatatcggttgctttgagaagggagaaagggtattttgcattttccttttaatcatcggtgagtagccacaaagggtgtgtctctccctcttgtgctgtgtttactgtttactccctcggtgcatgaattatttcatggcaccagtggagcatattttcttctctttcctgtttgtggcttgcgcctcctgaacgctgctatcattcatggtccagcttggttttctttttcactgtttctatcacaaaacctcctgaagaccagtggtgtcagtcataggctccaaaacagctggttcctaggccctgcctcgtgctctgtggtttgggcttgtcttttcttccagagtaagtgggtagcttcttcctactttttttctcttttcttctataaatgggaggaaaagtgtgaagtatggagactgctctttcatttgaaggaaattcacagttccagctctgtagtgtggcctctgttaactagtggtcaacactgactgtggaaggggggccagatggcaaagtgaagcagattctttcctcctgtctgcattttgattgcagtatgaagttcaacttgcttcagtctttgtcttcatgttgtttcactaggtactgaattttgtgatctgttggaaataacaagtaaatagatgcctaacgctttatacaggttgagcctgtctaatccaaaaatccaaaatccagaatgcttcaaaagtttcagcttttggagcactgacatgacaccacaagtggaaaattccacacctgacctcatgtgacgggtcacttttcgaaactcaggcacacgacacacagttaatttagtgtccccaggggaaaaaagaccctcccggcccccttcagctgtgatgtgtcttttccacacatgcccagattccctcagacacctccacaaagggtaataaaatggttcgttgtatacaaactttgtttcatgcacaagattattaaaaatatataaaatgactttttagagaagcgagaagagaaatgagaggtaggggagggagggaggagttgggggacagttgggggaatagttgaagctaaggtgtttaggcagagctctgaggaggtgacgtttgagtggagacccagatggctagagaatggggcagcctcctgaaggagcagaagcactgtgggcggcagggtatcacagaggaggagctcggtgtgttggaggttggtgagtcccgtggagtcttgtcagatggtgttgggacagggacggaccgtgaggaggctggatcatggggaatgtgttgctttaggccaagctggagttgatagtggctcagatcagagctaaagtagtggagacacacagacattgaaagaatgatgaaattcactcattctgcgtgtgtcccatgtcatgtgtccgctgcacaccaagtactgttttaggcactggtgatataattgtgaaccaactggagctgcggtgagagagaccatgaaaagaagggccagagcggtgtcctgcagagggtggtgtaccttgggagggaagtgtgtagggttgttgaggaacagcgtgctgcacagggaggaaagacgtggggcagcattgtgggaagagcaaccaagattctcataggcttgggagcggaagccctgaggtctgttgctggactagatatgtgaggtgtgagaggagagaagaatcaggaatgactctttgattcttaacgtgagcaactcagagaatgagagtgctgcagtttacaagcttggaaggtggattatgtggggggatgagtgagttgtttgacacctcaatggatatactcggatgtatacgttagagctcaaaagagtctgggccagtgacatgaatttgatcatatctagagtatgagtggcacaggaagccacttgtctggatgaggtgacagaggaaaaggttgaggatagcaaccaacatttagaggtaaggtagaaggcagagcagtgtggaatcagggaagccgagaggaggaggcaatgccaggtgactggaaggtcaagtgacacttcgacagtgtcactgagggctctgctaggagctattcggtgtcataatggggacagaagctcagtcggagtgggttaaaggtaaccaggaggtgagggtgctgagaggtgggactattgacaagccttgtgtcaagttttgctatgtaggggctgaaatctaatgtatgtgactgtgtataagtgacttgacttccccaaatctgtttcctcacctttaaaatgggtgtttgccaagtgctggtttctgctattcttttctctgtcttaggggtgtcattttctctttggtaaaacagaagaattagatgatatgaagtttcacattctaagttctcaagctttgcccactcctcagcccttgggtccctccacttcctcttctcttcgctatctctgctcagtttctgtctttgattgtaatgtaatgcccagtgggacttttcttctctccctcgtctgttcacttattccgtcctgcactgggccaccagattaatcctgcaaaaggcctcacatgggcttctctcccgctcaggagccttgtgggggctttattcctctgagatgaaagttcttatccccacatgtgatcctttatgacttgggtgctatcaaattcatttcctcaactgctcccctcttcaccctgaccatcagatctgctggcacatgggcataccttgttctgcattgtctctggcctgtgggatatttaccgagctttaaatcctaggcaccctttgggagccggcctgtgtgcagagctccccttagcacggtggcacaaagcttggacaccacctcttgtctgtcctgcttaattccattcacatctagagtggactcgctgtgtgcacaccactgaccacctgcctcatgtgacagttgttcctcatgggtcttagctctttgccttcaccatgagcctcctcagagggcagggcactgcctgttggcatttctcgtggtatcatacatgttgggtgcttcccaaattaattacatcagtcagaaaacttcactctatctgagaagctttaatagtgtacttgggattattaaatcctaaaaaaggttatcacaaagagttttcttggtgtgtgtctgtgcttagaatttagaaaataagtcatccagtattgaggccattttatgaaaagcctttaaaatctgcaaatgcgttggcccagcacttccacttctagggatttatcctaagaaaatagtcttgggtatctgccaataatgttcactggagtgttgtttataatgtgcaaaacaggagctaacctaaatgtccaacaataagggattggttaaaaaaaaaaaacaaccctcatggtgtgtattaatactctggaactactgtccccttaaaatggtgatgtagaaggacatgtattgacctagtaaaatattaagtgaaggaagtgtgtttacaaatgtcatttttgtctgatttcacttaccttcatttatagagagtggataattggcatagatagtgttaacattgtttatcgtggaatgttgagatcgttgatgatttttactggttttttttttttggttattacctctaaactctgtaggaagcatgctttcttgatcaataaaacttaaagttggagtttatgctgcttttattcataaaaaaatcacgtttttaatcttgttaggttatcctttatgtctacattaatgcacgtgtggagagaacacagtctactcggcttatgtcaaatggtagtgggaagcatggaagcatgcgttttttagtccccactttacaagtcacagtgacggttctccagtgtagagtagattgattgccctgtgtccttcaggcagggtgcagtagtaagttattgatacttggctgctgagctgtcgttcaggccttggcaactgacgctctgcagaacggaccaggagtgtgcggtggtggagtccggctggcctgggttgcagatttaactttcgcctctgcctctgtgtgcctctgggctgtaagctttagtttgcacggttaacggggatggcctctcccatggtcggttggagtgtgttgcacagcgtctggtccagtgttggcactgtataaatgccagctaactggttagccacctaaactgtcagtctgcaacccacagctctgcagtgaacaattgaacctcatttctttaataataatacaggattcctgaaaaccaactgtattattgtttggaaaatagtttaaaaattatttccttctaactgagacgtttaccctcttgtctcccttcagtctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaagtaagaatgatgctgactgctgctttctctctgcctctctctctcctctcctcctccttgacctcccttctcttctgagtgcacgagttccgctgggcagggtgcagtcgtgttgcatttaggacgtggcatgcctgctgtgcggaagtggttcccagtgggggtcttggttggctttcctttgcatctgggactcttggattgcgggactgtggcgtggctggaggccatcatggctgctgtcaagactgttcaaatcacatgttagaaataatccagcacactcctgggctagacacttgctgaccttcagctttgaattcctgatgagaaaggtgacctggtgtgcttggaagtccctgagccttggcagctgggggctgcttatgtgtcagctctttcatcctttgtgcgaagtgatattttttgttctgcaggacttccttagtttgaatggacttggaatatggttaaataaagggaaggtaaagcactaactcatatcctgtgaaagtggtccttaggtcctagtgatgatgttatgatactcaggtgtcctggttatgacagagcacctggcccaggtgggagacctctggacccatttctgcaagtcccaggttcaggctgtacttgcaggtagctgtgtagcagggtgcatttttaaacctctgggattctgttttcgttcttttatacctgtttactgaacagttgtgaaaatcttaagatttcacgagtgaaggaactttggaaagtatttactgttctgggggtcagatggtggtattttgaagcttcttgtatatttatctgcaatatgcttattttcccttgagaataactgagctcttgccttcatgtgatcagttccttaagaaccaggctgtttggtattaaaatgtgactctgagccttcaccttattgcattcagcaatagttatgtatattggctaggaagcttttcctcactggtttgaagtcagtgtgttagctataaatagctattatttaagtgttggcccagttaaagatgtaaggaacccatgttctctagttatgaagaaccaagaaaccccaaattgttagacttgcctaaaataaataaaaggcgagaccccacaggggtgaagtgtgtaaagtaaataaaggacagacctcccaggtagcccttcagttcccgttcaaccagtcctgaggcaggaaaaggatctgtgtaccctgatctgccacgcacttttctattctgcagaattggatcagtgcgtatgtgaacattgattagtgagggcaggggtcccactggctgcagccagtaccttgtagagctctgagaatgcagtcaggccactttaaggttggctggagttggagggagatcttatgctaaagtcacttgtgtggttgattaaaactgccctatcattaagttacccactggtttgagaaaacaacaaaatatattttttaaataaccttgacatttaaaaattttatctgaaaagtaaaaggtgttatcaagggaggcagcatggagtagaaaagagatgttgaatgtggtgatgagggccaggaatgaccttggatgggccagcccttctgggctgtagttgggcttttttaggatatttctagggcagtccagtacatcccttagtggtgatcatatatgggcatgaggatgttttgaaaactcataagctctttagagaagggaggtgccatatgaaacgtcattaagtggagagttgttcacgaactaggtaggtagttactttggtcttgccataggtttttggctgtttctgatgagctactgattgaagacccctggggtaggggtgaggcctgcattctgggtccaagtctaagagtggcgactagaaatgagcaagttatttaaattgcctgggccttggtttcttcatatgtggaatggggtaaagcctgccttcctcatagggctgttggaagatgaaaaggaggaaggaaaagcaccgtgaaaatgttaacgatggttagaaggtgggctctgctggtgacagacagagccttgatatcacctgttggttggtcacctgcttccccaaggccacgccctgcagccttctccttgaccatcccagccctgctgatgttccttgtgatttcacaatggagtacttatataaaattggtaactgctttccgggaaattgacttcccttccccttgtcctgaaaactcaggcatgggcatatttcttggagattttctagttgaatcagaacttcctcttggtttgcgtagattccatttagacctgcattgtccagtgtggtagccgcttattgagtaagccacgtggcttattgagtacttgaactgtggcttgtccgaattgggactgctttaggtgtaaaatatacactagatttccaagacatagtatagcaaaaactctgtacaccatttcattaataattactatgttgataacatgttgaaatataacattttggatatattagattaagtaaaatgtgttcttaaatttcacctgcctgtttcctttttattctttttttttttttttgaggcggagtttcgctctcatcacccaggctggagtgcagcggcgcgatctcggctcactgcaacctccgtctcctgggttcaagcgattctcttgcctcagcctcccaagtagctggaattacaagcatgtgccaccatgcccgtctaatttttgtattttaactggagacggggtttcaccaccatgttggccaggctggtctcaaactcctgacctcagatgatccgcccgcctcagcctcccaaagtgttaggattacaggtgtgagccaccatgcccgactctttttaattcttaatgtggctacttgaaaatttaaaattacagatgtggcttgcattctgtgttggtaagctgctttagagcatttcttttaacaccaggagttcttcccctcatcatctttttggctgagtcgtcactgcagcgctcatagccccgcatgtacctctccagccagaacccttaggaatcatttggggagctccatgaagggcattgagtccaggcagaatggctaccttgagttcaacataagcattaagatggccattcgaaaacattaagcacagaagaatcccattcaggtaatcttctgttggctggctgtagaactacggagaacatctggagaaacacgtcaagggtgtgtgtgaaatcgttgagcctactcgattttgtcgtgctgttgcgcggttttcacttggcactgtcctttaaactccttctgtgccgtgactctgcagtgtctggcagcgtagtagactctactccctctatggacgtgatccctctgtgggttctctgcacacttctgtatttctcggttctttttggatttaggagtggattttatacatttttgagtcattcctaaagagcgattgacccttaaagaactgtgtacagtggtttcctttcagtaagaacatagttgtgtggcaccccctgacatgtggtgtggttgattcttcttccttgtcttccaacgccaccctcttatgagtctcttcctacccccacaggtgccgcttctctgtctcccttccctcagtctggcttttaacggtggtctcctgacatagtccattcaggctgctgtaacaaaatcccataccctgagtggcttacacacaacagaaatactgctcacagttctggaggctggaagtccaagttcaaggtgcttaccagattaactgtctggggagggcccacactctggttcacagaagcaccttttcactgtcttcacatgttggaaggggcgagggattttttttctggcgtcttttttataagggcactaatcccatttgtgagggctccaccctcatggcctaatcacctcccagagccatcatactggggattaggtttcaacataagaattttgaggggacataaacattcagatcatagcatggctggagttctgtcctgggctctcttttcactttccttgttctcatctcatccactggtaactgcattgcctcctgtctccacctaaacttccaagtatctccagcccagaacccttttgagtccaggacctgtcattcatatccatcccagaacccttttgaacccaggacttgtcattcatatcagaccaccacgagcatttcactacagcctctgatggtcttccctgtttcctcacttttgcctattttttttcttttctattccctcttaagtgggccacacttttgttcccctggttcttatgtcaggaatgtgggtgtcctttggacacttccttctccagttggataccaggccctttccctcccgaatggaatggaaatgctgcttcagctgtgttcctctgctcctcccccttacagcagtgacatagcctctctcctgctattgtgtcctgtggctccaccgagcactggggagcttttcagtatgcactttttttttttttggagaaagagtcttactctgtcacccaggctggagtgcagtggtgcgatcttggctcattgcaacctccgggctcccaggttcaagtgattctactgcctcagcctcctgagtagctgggattacaggcccgcaccaccacacccagctaatttttgtatttttagtagagacggggtttcaccatgttaaccaggctggtctcgaactcccgacctcaggcgatccaccggtcttggcctcccaatgtgctgggattacaggcatgagccactgcgcccggccatctagtgtgcactttggactgatgagctcccctacctgaaatcctgtagcaagtccctataggataggcatgtggtacagtgtgaagctcctgagtggtcaacagctaccccgtgacaacatgccacactccatgtgccactccctcccgcctgcctgctgtgtccttggccccagtggtgctctcccgtgctgaccagccggcacggctcacctggccgaactctagccttgccttttcctctcaaggatgtaaaggctctgcagatttcgggaggcctgtctcccagcacctgatgggacactttttgccccactgtaaattctgggtgtatcctccactgtatgctgtcaccccaagggcaagcactgcatctgcttagtgaaggatttattgttcggaagatacattttccccttgagcagagagtagcgtatcctggcagtcttcggtgagccagttgtaccaggattatgaaatgcagatgtttactgtgtcattgttgctgtcattgctactgaggagtactgaccagaatcatctgcaactcttagttggcagagaggaccactatggcgggtagctcttttctttcctgccattgtggggatgattccaggccaaagatgatggagaagtatggaaatcatctgaaaggttgaagcttggcacgtgaagccattcatgactttgtaaggcagttttgctgaaggccagttctgccctgggagggacggaggtgaatcctcctgagtacctgtggttttcttacttcctgctgaatttacctaagtgcctgttgtttgcttgctgtggaggctttctggtatttcatttcaggtgcagatgccttcactttcccacaaaaaaaaccccaacaaaacctaagaccttactgcaactaagtctccaagtactttttaacccattgggatgaacagcctgtggtctgctcagatcaccctgagtgcgtgtgagaaggcctgggctttgccaggaaatccaggaaggcagggccgggctgtgttggaagctggcttagctggtggggcagccttatttcaattaaaagggcattgactgggagcagcagtcctggagtttgttgcatttcctattgccctcaaaatgagaaaccaggaaaatagcagattggagccttcgagaaggcagtaaatggctgtttttattgacaaaaggaaaacattttactgccatctcactgatggcatctcactgacttaaaatgaaggcaggttgtagtaaaaaaaaaaaagtctacatttttccaccgccacgttcttatatccttgtttgtcagccactgctcacaagggcagtgttgtcttgcggagtagaggcgctctccttccctcgttttcctctataggttggtgtggctgacctgctagatcaaagtggaggacctgtttaagaatgtgtaaattgaaggctgggcgcagtggctaacacctgtaatcctagcatttggggaggctgaggcaggaggatcgcttgagtccaggagctcaagactggcctgggcaacatggtgagaccttgttcatataaaaaaatttaaataattagctggttgtggaggcacgtgcctatagtcccagcactttgggaggctgagatgggaggatccgcctgagcctggggagatggaggttacagtgagccgtggttgtgccactgcacttcagcctgggcgacataatgaaatcctgtctgagaaaaaaaaaaaaagattttgtaactaagttttatggctagctttgagaaaggaaaataataataaaaaaagaatgtgtaaatcacctgctggatggggggaagaggggcacattgtctttgtagtgagacttcactcatgtgatgtgcagtatttcatcttaacattttttttttaaacttaagctacttgtgaagagctgagatgtttctgttaagcactgtgtggtctgctgctggtcttctgcaggccactgttccccagactgctaagacgatcatgacacaggcttgcattttcaggtggactcttgggaggggcttgtggaccctggaggagaaggcagccaggagaggggcatctggctttgtgttgttggtaggaacttgtctcggttgccctggaaggcctctgctctggtcagctgctcccagtgtgggggtgatctttatttagaagggggtcacatgcccccaggcctcattgctatgccttttatagtcaggcgtggagctcacattctcttctgcctgattgccgacgcttgttgccgagatggtgaagcagtttgtgtgcaggttccctgggacctggcttagcccacctcatttcttggggcgtgtgccttgtgcctcaaagactttgcttttggctaattgtcattagtgatggtgtcaccatcctgggcctccttcagaagtttttaatagggatctcgtctaagagaccaaaaagctttcagaaccactgacttgtggtgatttttgcatgccaagtatttggaaaatatctggagccccttcagctctcaccagttaaacctatttgtacaattgttctggtttcttcctgtgcttgaaaagcctctttctttgttgcgttaatacctctgtcttgctttcctcatgtgtatgccagtgtgacattctcggcagagtggggatgacgtggagcgtgtgggcccgtggttaatcttgtcctgaattgccttgctcaacttgcgtgtatagggtggttcaaaagttaagtttggctggtggtgaagttggaagcatcacttagaaacacgcctcctttgggcatatggtgtgaatcagggactctggctataaaaggtggggtctctgagcaccatcctggttggaatgttcccctgacttggaggtagcgagagacagccaaggtgtttgttccagggaggctggtgggtgggagatgggatttttctgtctgtggcacaggcagtattaagtagagcaggctgtttaaatcacattttaagtaaaaaccaaagtgcacagatgatctgcagaacttctgggggataagaagctgctttcctcgaagaagttcatctccaaaccagcgcccatggctcagcagccagcatggcagccccaggggtacatgggacttgggcatgtgaggctggtgagggacagggacagctgggtccagcagtgcctttcctagggacggttgccacgtcacctgtctgccctgtacttccatttcctttctttgaactcggggggcttgcatcggactacctgtgccgtttcctcaaactctaaaattgagtaagttactgagggtttccgtggtctgctctgagaagatttcttgcttcctgatctgcctgtgtgttcgtgttgcttggtctctctctctgtctctctctctctcctctttgatcctagtacatacaggcaaggtatgcagcatttaaaatgttcataactcatcaaatggcacactgatcatcatgtataatttgggaatcagggtttaagaaatttagagatcatttatatggaagaaggaaccccaagtagaaacccaaaatctagaccattctgggttctaatctgtacctgccactggctaacatatggctttaagctggatgttacaatgagagctggagtttcgtctgattgcacatagccttgcttttctgtctttggaaaagtagctcactgtagagccctggtaaacgtttgaactgcattgcgggagtaggcagaagaacagaacagtccttggagcttggtaggaggtgtgagggcttatgggggacagttgtcttttcaagtcaaggaggaataagggcttctggggccggtggaaagggtgagtcttaggcagggaaggtgaccatccaggttagatcacttcttctgcggggtcagcttggccgctgttaggttttcaggatgtcatggggctggccaggcctcacccctgatatccctgagcatctgttccttacaatattgtggagtccgtgggggcagaagctaccatcctgtgcctgccctcactctcagtgtgactggtcttcaggatgtttaggtggctccacatgcggatgtacagctttcccctgcttgttttccccatggcatattaacagcgagatctgcaagaatacatcattttgtacagaacaggatgtatttcttttaaactacgttcctgtgtggacaagtggtatcatatgcaaaggtttaaggaccgttgatgccttgagatagtgccatctgtttgcctcaggtatgtggtgctaggacaaagctgccagacctcaccttccttcagtgagacaggaataggacagtatttgaaaagcatctaacatgtttccaagcacataggtttttggtaaatggtggcagctgctgctattttttttttaaattaaactatctaagagttgcattctaagaccatctaaaattctgagtcttaagctgtgttgactatatatgttcactaccataactaaatggtccttctgtattgcttttctaaattgtagaatttcaattattgtaaatagcgggccatactgtaggtgtggttcttgctaatttgattcgtactgttcaaattcttgtgtctgtccagataaactgtatctttacagaacattcagcgaggtacatatgtctatatcggggtgccagtggagtcaccctagtcatatgtaaactctatttatttggttccgaaactgaatttattttgtttgcaagtttggtatttgggagcatttaagaaatatccatagattcttgtatgatactgacattaaatcattaaataccatattttttaaatgcctctgtctgtttgcatggataacattaaagtggttagagtgggcacagttattggtaaagattacaaagatgtgcatttttatgacaactttaggtctcacataggtagccaaccatctgctccaggatgaagcatgtgcctgtttatcctcttctttggtaacgctaggtatatgtgtgcacacgtgcacgtgtgcgtgtgtgtttgtgtatgtgcgtaccactttattctcccacccagcctcttctcctgttttgtttagtttcattttcctcctctcacccccattgcaggaaacaaacactggctctctgtcctcccttaggtcttccttccgttcaaggggatcaggtgggtgggaaaatgttgtgcaggaatgccaggcctctgcccgaagccgggcttctgtttcatctcattattgaacagaagtcgctttttgtttctttgccttggtcacaaacaagcgcccagtcctctcttctttcttcctgccatttttcccagaatccatgtgggatgggaacagaggcagcgtatttagggactgtcggttgcttgatacccatggccttgtttagagaagctgcacccactgccccaacgtgtagctgcatctgatttgtttttgcaagtcctaatgaagggacctggatgaagttagtgaggttgccgttcctggggttaatgcagagtggcccatggagcttagccacccttcatgcagaaggtggggctgagggcagccagtgtgactgaggctcgctggcccaccctgagctgcttgtgcccatggggcccctggggaggagggcccagctgcagtgcgcatacatctgcccttggcagcagatctgtgaacccaggctgccattctggatttccggatagatgcaaagtgcttggacgtgttttagcagctgctgagaccaggagttgggcttagtagtaaaaagggggaacaaaataaaagaagatcaggagacaaagagcctacagtacaaaaaaggaaagacgaaggttgatattattagaaatacttcctgggcagccttactgtttgaattaggatcacccccacccccacctcccagaggtattagttgtaatgcagagacaaatggaaactagtcagatccttgggtcctagaaaagaccagctttgttcctggggtggtaacctagtacaacgtttccgttcctatttcttgacctctgaatggccccttctgctttgctaagtagatgatattattaggtgcttagactattcttcagataggatgtaaggatatatttttgttctcttcctcagtgaacttgaaatgattggattattttgtaatacgtcgatactacttttagaagcttttgaataactgtgtcaaagaagctttagaagaggttttaagcaggattgcagagaatgtactgagtgtgtttttccactcacaaggaaagacagcagctgaatgcagaagtgtgtgtctggttctaactctttatcacttcagggactgtccaggcagcaccatccgttgggtctcctgcccttcctcctcccacccctgccttacccctggccattcttttgtgaccagtagtcctttatgaatggaattctgagaatgtataattttctcagaagaatgcttctttagctcaccaaatatttcttgtttgctgaggggggaaaaagatcctccttggaaaagtcactgggtgccaaaggtgggtgatgaggagagatgaacttctgggtgtgcctagcaaagctgtttctgttgataggcgattaacaaaacagccaaacttgacctaacagactgccattttgagaggaatttgttttgcaggattaattggcttcgaggtgtactggtggctgtgcagtgatgacggctgtcgtgcctcctgtgtcttctgctcattgtgatgcagggcaagtgcttaggcctcagacacaggctccctgaacttcgtgttcagtgctttagggtggggggacttgagacccttgacttgactcggtcccactggaaagcttctgttgcttatttgggtaaccccaactctatcttattgggcggtagtgttatcctaattcttggaaatactcagtgtagaataaagagctgatgaaaatgtgtaagaagggagtaagtggtcattagagagaaatggtaattgggatgatgctctgaccccttcagcaaaaaataaaaggtgaatggtttattatgagctagttcagattctgtttttggaaatgagcttggttatacatagtgcatttgaaaagcgtgaagcatggactttcagatgccagctcctcagcctcctgtaactccagtcgcaaaatccctccagtgtatctaaataaatgcaaactcatcagtgccttaccattataaagctgggctggagaggcaggtggcctggagaatcaaatgacaagaagtatagggagcagcccagcttcatgatcgggggaatttgcatgaaaattgtgtacacttaagcaccattgtctattgcagaaagcacgatctggcctcttctactgactttccttccagctctgagattcagttttgaagacaaggttgttggggacctcggatagatctgttggccgtggctttcagtaaacactactagagactgaggacatgttctagacttggaatggtatgaagcagtcgaactttttaggatgggccctacccttagggactgcctacgaaactagatctagaagaggaggctgtggacattaggaggtggctgcaattggaaagttccagagagcttactgagggataacggatgtaggacaggaggctggcaaagcacctcagtgatagggcagaaggaaataaagtggttagggaaggagttgagagcaggaaattcaggtaggattgatgttaagtcttagatctttgaagtgactttctctggtctggcttttgctgttaccaaagtgaattattcataagtgcatatgagaaatgctgatgtaactcgattatgtggaatgaatttaaattcatttaagtcattcttttccactaaagtaagctttccctcatccagaatctgagcagcccgatagccaagcaggagtttccttgtgccatggccagtgattgatgtcttcttctatgatgctgctgaaatgctggggactctgaagcgcagctggagtgatcaaagcaaaattaaaatactttctcagtggtttgggagttgggtgcgttctgctgtattttttggttttcggcatctgggtttggtgtgcatgcatggtgagctctagctggagcagacgttacctactgaggctacgctcttcgtggtttctccttaaccatcacccacttgatcttccatgaagccccccaaatcttccttactgaggactcttgcttccaggttgcttttgtgctcatccattgctgggttatttggtcagtgatgatggtttctctgtactttttatcagtaggttcagaggaccttgtttactcctcattcatctctctccccaaacagttgagaaaccacttgtgggttaggactcatgctttgtttataatgtttgattctccaacctcacagctaatgggaagcccgtggaggagatactctgtaaaaatccatctcccatgtgggcttgaccccacttagtgtctgagtggtttggtcctcatagttctcttgggggaggaggaagggaaggaggaggaggtggcgatggcagtggcagcagtggtggcatcttggaccagagtgagaaatcttggaccagagacaaaagaggtcttctctcagggtagtgcaccatgagagggagcacctgtttacattttgtatcctggacaccaatcttgccttgctctggtgctggccctgagaggtgcaggaattttataaagagatttacaaaacatttttggatgaccaaattggtccctggttctagctggaatgaataaacaaactaaataacagtagagtgtgagagtaagtgtgtgtgctagagaatgtgtgcacatgtatggcctaggtgagttcttcactttgctgacttgtgaattatttggggtcctatggtcctccccatcattcttattcatgtcagtccaccatcattaaggaagtggaagcgaacacattgtgtacatatcactcccatagagagggagactggggaagaggtttgagttataagtcgcacctaggttaggtctggatgtgtctttgcaggtttccttgctagttccttggccagagtttccatcgtgtccctcagctgcacaattaaggtgcccccgttttgtgcaagtctcatgctaggcagtatgagatgacacaaactaggattctgttgtgagataagataaaaacacttgacatttaaaagagagagacaacttatgcggtgtgacgagacactctacgacttttgccagaagagaaatagaggcaacaagtgctaggagctcagaggagggtaagttccacatttggaactttggattaaaagaatatttgggtctggttgaaatcgaggcctttcatgagaaatgtccacacttgctcagtactgtttgccgaacactgtatacaaggccctcgactcgtgaatgagttgtaatgcaaaactttgccaggcatttggaatgtggagtatactattttgtaaagatgaggtctgaatggtggtttaggtcccaggccagtgtccctctgccccccacctccatatgtgccctcaagccggtttggcttagacattatttatctctgactactgtgtacagcttagttccatggggaggaaaaggcttgatgaaccctaccctggaaggctggtggctctgttttctgatggatgaggtaggagtggtggaaagctggtagtttctactttgtgcctgtttaaaaagccccctctgaggccttagcacttaacagatgttcaggattgggggaataaaggagctgcctttgcagaggtctgtgggcatgcagtgggtgagagagcaggcactgagtgccccgagtttcctgcctgtgtgggcaggaggattctcagtggaatcaggagcatctccgcctggtgctggaggaggtgtggagttgaaggtgggattcttcctcttgaaggacttgaatgagtttctgtgtggctgaacagaaactggttcaacacccatgtcatgatttttgtgaagcgaggacttggggtcccaagtctaggttttaggttccctgctgtaacccgtggccaccgagagagagttttatgataaaatgtcagcaaagtacctgacaacgtctcacgctagaatgagtttcgtacatgtttagttccctctctttttattccacgctcccccaccccaactttaaatcagaaacgtgagggtgctgattgaagctttttataacttttcttattgagaattgttctctggagttgtctccaagaacaaaggaattccagacgttcttcttctctccttgtctcttctgtcctccagtcaaagaaaaactctgcatatgatctttggcctggagaaatattaaatctatgttaagtatgcagacatgaatgggcaaatgaaggatttgtggcaaagaagatctgccgaaacaaataagtcatgtaaatgggcagagggaaatattaaattgattgcatctttcagctcctggtacttaatgcaaagataaagtagtgggaaaaggttgtcatttgaaataatggaaagatgagggagttttgaagctagctgggatttttctgcctgttaatagagtgacttggattacagactataaagataaagagtagggccgttgcatttagtatggatcatgatgctgattgctgtctgagcaacctctgtactaagggaggagaagctaacatccccgggcctggaagatactggatactagctcattaaactcttgtgagaagccttcattagcattatgggaagacttgctgtatctatattatgaaggcatttagatttttttttaaatgcatgttcttaacattttttgtttattaagtggggcagtagattaggactgaatggatttgattctctcatcctacatagtgtgcccagaagccagaaggtttcccagaatttgtattatggcagcgagggcaaatttaattagcagataggaaaagctttggagcagtttaggccaatccatttaattgtatcagcaattaatattttgagaaaatggaaataattaaatttacatttcttctaggactttattttgttatcctttaaggttattgtaaatgaggagacttttgaactcacagactaaagcaaactacaccagataatcattaactttttctattgtgtgccacccttcccaaccagattgttccatagtatcacttatgaaccaagaacctgtgagcttgcaaaacgcatttttaaggagtctcaacttttctgatttgtgttaaagtttaggtgtgggtcccagaaatgagtttcatggaggggagaggttgtctctctgggtgggtaatacaggggccactgggggctcactgtggctttctggcacagacatttatgaagcaggggtgactaaagtgggagagagcagccagttctccagcagccccagtgagagctctcatggatctgcctattgcactggggtaggagccatcaccgtcagcttttctctggcccacagtgccattttctgattaagctgagacctctgtaatagacacgttgtcattttttcttgtgtctaaaagtttgcttgactgcagtgggtctccagctcagagcaggtctggctagagaaaacaggaggtgatgactggagcactttgcccttatggaacgtgctctgatgtagaaagcaagaggattttccttgcagtcactgaaggtaccttgtgtacacagaaagaagacagagggagccccggatgcctcggtatccctcagagccggatccttcagacctgtgcagtacctgtggatttggttagtcgatgatgcgctgccattaaaacaaaggcatcggccctggaatagagaagttcagtgagaacctctgtactccatgggcattttctaggaaataatttcacctgccctgtgtaattctctggaagaatcacagtgagttggaaggaaacttaagacttggaaaaggattgagaggttagcccagaccacaccagggctctgaaggcccagctggggttagaacctgggacaccctccagcccactgtctcctgttccctggccatttactgccccactcccctttctactctcaggggccctggatctaatgaggggattcgtgcagtttgctgcactaatacattgcaagtggtgccaacctaaaggtattctgatggtggaatcagagcagtagcatcttattaggtcagaatctgtatctcctcttccaagatttttacatgatttagtgttttctgaattggaaaaaaacaaaaacaaaaacacacaaaaaaaccatgtctaaatcctagcatttcatcccatgttgatgaaagggcatcttttttttcccctaatctgtggttagaactctcagaaacttttagaagatccctcctatgttttggaggtttgcagatttgaaccccagttcctcccacagtgcttctccaactcctggaatgaggtaaacctccaggcagcctgttgacccaacccatgcatgccggtctttgggactcctagatgtggaccctggagtgaatagggatcaggtgggaaatgagttcctttgatcaagatccttgtaccagtgaactgaccccactccccgtctggattcctgtggtgattaccctctgtattagtctgttttcatgctgctgataaagacgtacccaagactgtgaagaaaaagaggttttaattggacttacaattccacatggctggggaggcctcagaatcatggcaggaggcaaaaggtacttcttacatggtggcagcaagagaaaatgtggaagaagcaaaagtggaaaccctgataaacccatcagatctcgtcagacttattcactatcatgagaatagcacgggaaagaccagccctcatgattcaattacctcacctgggtccttcccataacacatgaaaattctgggagacacaattcaagttgagatttgggcggggacacagccaaatcatatcaccctcttagcaaggactgtgttcgtgatcatgactggcattcactgaacaatgactaggtgccaggcacctcgccagtattctttaatctttgcacagtctgtagggtggatatggatattactgttccattttttgtggaagaggaaatggaggcaagagacctgattataacttgtgcaaggtgccatgcagctaagcagccagcccaaatccagacctgctttcctatgattttcctgcccattactctcccatcgtagctcacctaatacttcctagtgggctgctgctgaacacacacccagggatgacttagtggcttgtcttgctctgaagaaggctaggcaccatgttggatgagttcttgaagatgtcttgctctagtcaagaaacttttaaatctttggagtttttgtccacatctgcctagttcttagtaaacatgatgtgggttctattagcatggcgccctccctcccttcctaccacctttatatgagcggagaacatctatgactcttatgagaaaggaaagatgaaaatcagagtgacatagtatagttaaattgcagatgcttaattataaaacagcttgtttctgaattttaattccttgcttttctctgactttttaaattcccctccttaggcagaattcatttttacattgatgattttttttttttttttttttttttgagatagagtcttgctcttgtcaccccggctggagtgcaatggtgtgatcttggctcactgcaacttccgcctcccgggttcaggcaattctcctgcctcagcctcctgagtagctgggattacaggcatctgtcaccatgcccggctaattttttgtatttttagtagagatggggtttcaccatgttggccaggcaggtctcgaactcctgacctcaggtgatccacccaccttggcctcccaaagtgctgggattctaggtgtgagccgccacacctggcctgatgaattattttcatgtgtggaacaaaactttgatgctgatcagtgattaggtacctttgtttggttcatttttaactaaggagatttctttctttttaaaaccattctttaatcttgtaaaaatatcatttaatgggtggatgttttagctgtgatgaatgacaggttgtcgtaaaggaagaaaggtatgtggtttccagtaaacttttaattcttttgcaaaataaaaataacagtcgtacagagagtaaaatatatgaagagtcaggaagtgatttatcaaaatcagatcttggactgctggttttaccatgaattaggctcttggaaagtgattgggccagtgtaggtttacattttttttttcttgttttatttgtcaaagcaaacttgtggttgcctgcccgtagtttaattctgcctcctttgggcaaacaaccgacttttactgggagtctttctcagggagataaaggtgcaccctgaaactctgctctctgattcctcagcaaagtcagtcctgagtatggggcttgggtgtctctgcaaggccttgcaagtgagatgggctgtcacctgagctcaggtggggctgctcctgccttggacagcctccccagcttctcctgcattatacccaggggctggagggcagagagcaggtcttcttctgctggtcggggcagtcacaggctttcctctcggcctgcttgtcctccgggtgggtccagcacccgctgggattcctgtgggcttagtcactgtgtggcggcggcagaaggactggggaaaccgccggccggccctggtgcgctgtcaccccgaaggaatgcgggccaggccggggctgctgggcctggaaagttctccagtccctgttgcagatctggcctgccgactcaaagtaaatctctcttcccctttatttcccatcaaataaaaaaggaacacgaggtagccactgtactcactgaagatgcattgttttttttttttttttttttttaagcgagcagcagcaagatttattgtgaagagtgaaagaacaaagcttccacagcatggaaagggacccaagcgggttgccctgaagatgcattttttaacttgctttttaactaagtatttttgctctgagctttcctggatctgtaaacacacccccagctattcaagatgggcttcttggtgaaaagtgatgtgtcctaggagaaatcacgcctgttgttgccgctggccatcacagatcccggtgcctgtctgtgaaaggctggccgggctgggtggggatgagaatggtcgggttgtctagactcagcctggactgtctttgactggaggggcctgagctcctcctccactgctcaagaccccggttaaggggacagcagagcagggatgagaagtggccctcttcacatcacctcccagcaagagggcctgacttagtgctcccaccattgccagccccagtttcagggtcccactcagttgtatttgaataggtctcatgacatgtgctttgcttgaagagcggctattagcagcagacgttcaagaggctgagctcaagcaggtgagcatgttctgagccattgtgaacccagtgaggtgcctatgctgatgcccagggccgcctgggcggggtcaggcccccatcgcttcttcatcctagctctgggagtgcattctgcactctcccgaggccagctggtggcctttggtgatcaccctctctgtaagtttttaagtggcttcctttcctctggtggagaagccagcacctttatcctatgacaagaaagctctttgtagtaggtggtagtagaatcagacagatctggcttaaaatcttggctgtgctacctcttggctctgcacattggtgaagagaatttaccttcctaaggcctctcagctacacgactgtggacactcagcttccttctaaggtcgttgtgagaggtaaagaaaaggggttagtccagggccagacatggcacaatgcctcaatgaaatattagctgatactatcataatttttaaattcccataggactcactgttaaaggattacaaggctgacacaaaaaatactgcattttgaatttgtgtctgatttatacatttccaaagagtggaattctcactacaacagctgttctttgaaaggttagatctttgttctgagataaattaagtggaaaaaggtgtagagcattatatgtactctgattcttcagggcttaatttaaaaagagcatgtttgctggtgaatgctggttcaatcattaagaagtttttgagaaggaatcccagaaagtaataagcacttatttttcatggaaaggaaccggaagtgcttggtgacctccacaggtaatcttgtattatttttgcactgtttggaattttttaaccatgtgcttttatttcttctattcttttcaaaggtcagtaggtgttatctggacaatagggttctggtctgttttctgttttcttcattgtactgtgcattaagaaaaaccctaatgtgcttttttttttttttaagtgaacctttccacatctcattgtccttcagtgagagcaggctgtgtgtgtggtcttggtgaactgtcccgttccctggagacagtatctgggggcctccctgcccttcccagtaagagctgggccttcacaggaatagaggcctaggattcgccttcatcctcttgaagagccctaacagtaggtcctggctggggtctggcatagaatgcccttggcacgatgtgtgtgagtgtgtctttccttagtaaatggccttgaaaatgccatgtgcttctggcaggcctggataaggtttgccctgcataacccttggaaagcacagttctcacttgtaacaccctgtctgcaggtccatgatattgtaattaaaaagttatgggatcacaagggcctatttaaagggcatctggtctaaaggcacagttaaaagcagaatttgtgtcagtggctcccttaatttctcaaatatggttctgtttctaaattcatcccactggatgtctgtgttgagttttctgttgatgaaagaatgtttaaaaatgaggcagatccaaattctaatgtctgagtgtaccactgcttaattactttgggcaggtcacctcacctctcttggaaagaaaggtgatatactacatctgtgattttcaatttttttttttttaactagacccacagtaaaacatagatatacaccatgatcccaggacagaataagtatataactaaaataagtgttttgaaatcacttcttgtctgacacagcactcacgctttctattcatgtagtaccacgatactttcttctattctaatgctggtaagagatgccttaaactgattttgagaactaccaatgggtagcagctagcggcttaaaaaggatgttattaaggtccttttcaccctgattttgactctgttggctctcagctgagtgccccatacttagtgcacatagagttggcctctgaggtcagcctcctgttttcctgtgaaaatgaggatggaagagagtcacttgtttccctccttcatggctaccccctgaggactgggaagaatttaagaatttgagtatatgttcccaatagcatgatgtgtttcattgttcatctgtaagcatttttaaatattcgagatctgtatcttgggtaatttttatcaactttttatttgtaaaataatttcaagtcagttattaaagtaacaaaaataatggcaaacttgataccttcccgtatttttttttcatatttttccttgaatgcttacagaaatattaaagaatattatcacatcattgtagtcaccgatgaattattttctggtggcttatgattagaagagcttgactcggagtggaaacagataacatttgagtgctctttctgttaattcatccttgtcaataaccccattagctaacttccagcaaggctgtgttaggaatgtggaatcaattagatgaattttgaaaataacttggtctgttctaaaaggccctatgagatccaaactgttgtggcctggtgcctggtaactttgatggccattttgaaatgttaccgtagtgataattcttctggaatctcaagtcattaaaagtgatatggctaactctgggccctgtgctataaaaatagatgtcatgggatgtgtgaatcctttcttcagtgttatagttaatagcaactgaaggaacgttttggtcaaatcccgaatacttattaggggctcactgcttggctgcatttttctcctctgcgtaaatcatctatccatgtaattattaacccctaagaatgaatagcatttttaaaagggttccattttcccctcatatgactttggttcattctcctccttgtttctgtctctcagtgaactttccaaaagatgggttatgatgaaaggtgaatcgtcgttgataactgctcttacttatctgtgtatcgaaactgcaggtagtgctcttcagctctgtggctggatttagtgcctcttctagggaggggtgggtgttggcacaaagcgtatcccatttccctgaatgtcgtgtggacacgtgagaggacagtgcaccctttgggcttggtgctgcccccttcacgctactgaaccccagggtcataattaaaagctgtgttagctcttctctggttagaggcatacaggttggaggcttgtacatagccgtgagccggttggtctaggccaggaagcaaaccattggaaaatgtggttagcagtgacagttgacagcatgtttgcctgcagtagtggtggttggtgctgcgtgttgactggagttgcttgcattgggagagcctgacttggccaagtgtgtagcttgagaccagttggattcctctcagagagacagtcttcacccccaagctctgggtgttgggcgtgcagcattcgtattcagcaaacatttgctgatttccgcctctgcaactactgagctcagctttggggatctgaagatgaatagacacagccacacttctggggaaatctccctgtggggaggctgacatggaaaccaaccaaatgggagtgtggtgcatatcttattagagctttgtgcaaagtgccacaggaagcaggagaaggggtagattggtgtggagggggcaggggaagacttgcctaggagcagggcctcgcaggatgcagaggagtttgccaagtaccagagattgtggggtaggtgaataaaggctgagtataaggataagtcaattcaggcagatgtcctctaagaatgaaggtgagaatgctggcggaaaccagttgtggccctgtctgccttccctaggagactggacctgactttacaggcagtgacggtgaagcagggcagtgccacgagcagatctgtgtttcctgaagggtctctggcagctgtctggggaaggagggaagctggcagagccgtgggtggaggcagatgccattgctatggagtgagcatggggaagggggtcggaggccttttggagatagatacagcaagacttggtgaaggatgaagttggggcaggtagaggaaaagcaatgagcttacggatgactggagactgactggagaagatgaccacccttgccattaactaggataggaaacaacaaagggtaggagtttgacaggggagaatgtttgtgctgttgagttgttgagtttaggtgcttgtggcacgagcaaggggagtgagctggtctaggaggtttttggaaacactgacctggctgcagagagggagatcctgggacacctgttttgggagttatcccagtggggaaggatcactgggaagggggccacccctttgggaggggtcagtgggacgactcccaagggaagaggttggttatagggagttaaaagaaaggagcacccctcacgcgagcccatttttcaaggatacatgtttgtcttttagattctataaggagtagctgctacacagaaagatgtctacgtgtgggtgaacacctggcgtatcccatgcagggaggcttcagcagaccttggtggcgatggaaccaccacagtgatccgaggattgggtctgaaggctcctccgagtctccaataaaaggggttgttttgaagggctcaggttcttcctgggcttttttgggacagtcttgctctgttgcccaggctggagtgcagtagaggcaatcatggcttattgcagcctcagcctcctgcctctgggctcaagtgatccttctgcctcagcctcctgcgtggttgggactataggtgcatacccccatgcctggctaatttttaatagagatggggtcttgggctcaagttatcctcccacctcagtctcccaaagcgctaggattacagacatgagccactgtacctggctgagaaggttttttttttttcccccttccaaacccccatgtggtccagacgaggccagaggatctcaggggaattccctctccgaggagcctccactgctattgcatggcccccagcatagtcatttgagtgaagagccctccaaaatcattaagctgatttgtagaatcagtttgctgtctgactacctgatgaagatgagaagtggtagacctccccccactgtaaggtcttaacaagatctaggtggaacatgggactgtttgcaagctacttctgtttctgaaatcacatgcttgggatcccaaataatctactgaaagctgtcttcgggaggcaaagcccagggatttgttttgtttgcccctaatcatctcttccatcccctttctcaaaagtcttatatctagataatttagtacatttgatctactaacagccagggccataacaggagctgatattacataccccggaagtcctttgcaaacacactgtagtggcgattgattagtgttccgagccataggtaacattagcctgcctcgtaggaccctcagatgctgaccgtatctgctgcaattcttagatgtaaaagagcgcgcatcgtataaatcaaaactagatgattattttcatttgaaattgttgttgcactgtaatttctcagggttttgtattttccaacagtggtgtcacttaatgggaagatcgctcaggctttgtaactgggcataataccaggtattctcgtttaggcattctgctcagtagtattaacctgaagccataggacatgccaatgtttttttccgtgttttttaaaaaaattaaaatggttggctacaaatgcatccttttttacttcagagtaagtcggccttggttaagtcttaatatttctcatgcctatttttttttcttcaaatgaaaacatacggagagaaaatagcatgtttatgccttttggttgtacccagcactgcccagaatggcttacagagtttatacccatggaggtttcgtaaaggtgacattaacttcgcagtaaagtcactgaccccgaacctgtgtcacttcaggcttagccaaatgctaacagagcagctcaaagcttaagcagaggtatgtgcttgctaagtaagtgtgtgttttggactaattggtgactaccattctgaacattaactgccctttgtgttttaatgttgccaggaggccgattgtgtaacctttggaggcttccctgagtttggagaactgaattcatgtggtgacttcctatttataatgtctttgggggagctatgaaataacttttcttctaagtgtgatttttgcttttttaaaagtttttatgttgttgtcaattgggtatttcccttctatgccaagacgaattgtaggttcaggtttctatgcagcctgtatgtaaacactggccctaaagaaggactctatcactctactttcagtttcttgcattaaaacaagtatgggtagcggtatccttcttatttctgcttcctggtcctgtgtgagaccctgaaaggtcctaatggcagtgctgattagattgtggccagggttcacccacaagttccgaagctggggaaggtggaagtgctgttaactgacttgtcccatgtctggggttttgcagcctggggagaggtgaccacccctcgtttcagtccaggtagggttttatgtccctgtcaaaaatgtgttgtgtgaagtaccttgactttcatttcccagggaagaaagcccgtttcaattggctcaagcggaaaagagcactgtgggtccacttaatggaagagtctaagagtggcttcaggaagtccactgggggctccccgtgactctgcccacctgcatattgtcttcattctaaggatccaggtggtagcaaaagggttgttacaactttaaccctgcatccccaccttcaggttcagtacccaagggtgagcaatctgttccagtggcacagacctgtttcaagaggtctctagccgtgatagtgctaggccactgccctccaccagtgtgttccagagaaagatgctctgatgtgccagcccaggccatgaggttcccggcctcagtaaggaagaaggaggacaaggtggtcccttaggagaaaatgtggatattcaagaaagagggtcgcaaaatagcaaacacccactatggctgggcagtacagggttgcagaaatatattttgatgtgtgatcgcattggagctacttcaaagagcaaacacaccactttgatttatttctcttagtgatacagtatttagagagggagatactttttatcttcgtgggatacttacagtggtgctctagaagccatgtactgcttctggcttctccttcctttcctccaaggctcctcctgcctcctcccaaagctctgtgccctgaaagagccttgagccattgctcagatgtcaaaattgtattaagcagacacatcaaattaaaacttttgggatcactcaccaatatggtttcctgtacagtactgccctgaggggggattacaagtagttatgcatccatttcattgatgtatcatttttattaaaaagaaaaacaatccaaccaagagaggaagtgtagccagctgcctaaagagtggcgatgatgggagatgatattttgattacattaatccatatcctgttagttcactttgcttctgtcgctgctgctggtgaagttactaatgtgaactaattacatttgctctgaaaagccagaatttttaatgcatctcagcaagaaaggttaatattatcaatttaacagcatgaatgaaacattgtgtgtattgaacttgaactgtcctaaaagcttggataataaaaacccagtggcttcttttataactcactggataaacagttattggtgagacatggataaggctttcttctctttcagttttatggggggtggtaggcagtcagcattagatgctgtctgtttacagggtgatatcgtaacttcgtgaaattggaggccacatttaaaaaggcactccttccttttaaaagctttgcaagggggctgcatatattttcctaattagtgggaatattttcttttttcttttttcttttttttttttgagacagagtttcactttattgtccaggctggagtggagtggcatgatctcggcttactgcaacctctgcctcccgggttcaagcaattctcatgcctcggcctcctgattagctgggattacaggcatctgccacctcacctggctgattttttgtattttagtagagacgacgtttcaccatgttgcccaggctggtcttgaactcttaagctcaggcaatccgcctatctcgggctcccaaagtgctaggattacaggcgtgagccaccgagcctggctggtgggagtattttcaaagagaacaacaattcaccacaccccaacatggtaacagtctttttgttttagaagcatctgtgaattgccaagactcgtagaactaagatgtattcaaagtcagtcgattttctggaaacgacccagtccctgaagatagtcttttggggagttgagtgttttgagagggacaccccctctacagggacttaaaatggaatggctttttgtgtgtgcacatggtacctgcagtgatttcttgtgtttaattacttcctgcactcatctgacttacacagtggtaaacaatgaggatgggaacaggcggcagctgctctgtgccatccaccgtcttgggaaccccagcgtggcattctctctggggcagcatgttgaagtgtttggctggtgacattttggtgaccagttggctcctcattgtctttcaatgtggagattaggaaccgagcgaggatttggaacccttgcgtttgttctgccaagaacatgacttgcctctggcctgagagcagtggagtaagctgataggagctagaaatactgttttgggtaggacttacccaaaagagtgggctgagtcacagaactcccaagtttgagccctgtcaaataaattctgaattgttctcaggtatgtttctcaattggaatttttttaaaaatttaatttaaaaaagacttcgaaaagttaccttgttctcatttttcttctccctctttgccccgtccccacaatatcttagggcgaagaaaagcaggtttgagaaaagctttttttcatcatgtatttgtaatagctggagcctgctgagatgatgaggtagagtggagggagaaagagaccttgaggaggtgtggagggggaaggggtggaaagttctgtcgtcttctgtgcctctctctctctcttgctcagggtctccagtcagccctctgggtttgtgcccttcgtgctgcactgacaggtcaaagccgactcaggcctttgatgtctgctctaggagcaaaagtgattcctggtcccgcagccgttcccactgccttgtgtatgaaggtctgctgctctgaggtggatggtggctctaggcaggctgtttccgctgggtgcggttgttgctgcaggtttttctatatagcttggtcatgctcctgtatctagattaaaatcctatgacagatgggcctgcttatatctaaacttattcagagagtcttatgataggcaacaggttaccctttaccggggtaaaacatggtttattctacagtttggtcccgttgtaaggccaggagatagagtctcactagtttgccccggctgaactcaaactgctggactcaagggatccttccgactcagcctcccaattagctgggactgttggtgtcaggcacacaccaccttgcctagcttgaagatctttcttctaaatgagcgggctttaaagtgatcagtgggacctgggcaggttggctcttgcctataatccaagtgctttgagagaccgagacaggaacatcacttgagcccaggagttcgaggctaaagtgagctgtgagcacaccagtgcaccccagcctgggcaacagagtgagactctgccccaaagcaagataaaattatcccacaggattttagtcctgacttgtgtattactatgcagttgtgtctgtctgaggctcagattcccccccatttaggatttgtgtggctaaatctcagatctcattttcaggtgaatttctctattaaggttataaaagaccaaaataactggaaattcaactctgtacttgaatacttggtaatgcccagcattctcttgactatcccatttcacagtttgccggtcatttccccagtgtactcactggattcttcccgcagccatgaaaggtaggtataattaactccagtttacattcaggacaatagaatgttcgtcaaaatgcttttgcacatgttttctcaccctgagtggctacacttgtacagtcataccctccaaactctaagatgtatactcttacataccaaaacacaaagaaacaacaggaagaacaaaactcaagaggtctgagtgacatcttgccttgcttcacaacttcagagtttgcattgctttaaaaacattggttataagtgagtgtggaaacagtgtgttcactatttttatgctgtggctgtgctgtgcaggagctgggcttttcgtgcattttagacagaattgaccttggttaatgcttgacttgggaactatgcagaaacatccaggaagtggtggtggctgatcctgaccgtcctcagttttgtgaagcaacagcctctgtgcctctttctctgcatgctctgttgacggtctagtcttgagagagaacctgctgctgtcccgtctgtcatagccttcctagcaactcttaggcctgcgtgctgtgttttcatgatctcccccaaagcggcactttgatgttttttcagagtcaaagtatcactgtggatatttatcccaaacaaaattgcaaactgatcaaatgttatgtcttttgataccaaatcaaaaacgattcttggtggctgatcaggttgtctcctaaaaatttgccttttgaacctatactgcctttatgagatgattatgaaagtagaaaatagcctgtgaaaaatggtacctttgctaaaaagaaaaaaaaatttttttgaaactaagagtctctgttgtccaggctggagtgcagtggcactatcttggctcactgcaacctctgcctcccaggttcaagtctcccgagtagctggaactgcaggtgcacgccaccacatgtggctaattttcatatttttagtagagatggggtttcaccatgttgcccaggctgttctcgaattcctgagctcaagcagtctgcccaccttggcttccgaaggggctgggattacaggcctgagccaccgcgcctggcctgctgtaagaaaatattaaacttaggatgggaaatgtgatctgaacaggattcctgtgaaggtacccagtgtaggtcttagtctcctctccagtgtacatttatggaggggcaagatttcaccattctgtgaagaactctgcgtgttgacgactgctcacgcctagggaataaatttcagagcatgcgtagatagtgccattttctacttaaaatactataatccattatttacttcggaaaataaaagcattaaggctgaaagttttgggttagtaatcttgatgttttaaaatgccttagcattccttcatttgttttgcttgccacgtggttttgctctgatttacacacctctgtgcatggctaatccactgtgccactcttggggctttattaactcttctctgccagtttttcccttagagaatatcatggccattctctaagatgataaatgggactaagagtaaatgcaggctgaaaaagcatttaacaggtcaaggatctgaagcttttaagaaggcaaaacaataaataagaaacccaaacagagtcttgaagcacacccatcgaaacccaagtttcagaatttgctgcagccttgctgccaaatcacagtaaaagctgaaaaggcttttgtggttagttacgtgtgatacaagaaatcgatgtgtctgagagaagtaggatttctctttttgagggggaaaaatacagcaaggggaaatgttttattaacaataaatatgcggcttaccatatctgtagggcacagatttggttagtagtattttggaggcaggataaaggaagatcctaaaatctctgtgctgtgtagcttccattcgagctgcacatgttaaaaacattctaggatccacacagtttaaacaaggtggctggcttaggaaatgcttctccccattccttggcatccccacaaccctattcccctactttctcttatgtatctggactggcttttaaaagatatttagtgaaatttaattttctagggaaactccactttgtcaaaagtgtagtattcctcaaggatagctttgctggtcggcaaatctcagttgagtgtatttgtggtttaaaaaaaattctttctgaatagaaatacaaagagtgataatgtttaacattttatttttttaaaaagctttacgctgtgtaaattgtgggttgacttcatgtttctaaactttgtcttttagaatgactctcttgggtaaattattagcagacactctcgtgttgacatgtccattttcctttccattaagctgtctccattgcagttctgttgatatggctttatatagttttcctgagcttttttttttttttttttttttttttggtaacaagatacctatgcaagctgaaaaactcttggctttttagtttgtatcacttccagaaacttttagatgctacgtatagaagtggctttcttttagggttaggtaagatacttccttttttggaaatagttttgccatttggtctcgctgcctgatttgtgctttttcttcttcagcaggtagtgggaggctgtgtattgtattgccttttaccagacacccagaggggtcatgttggaaaatagcatcctcttagcaaaaacacaatcccttctctgagaataaattgccaagtctttccaggtcattgatggactctcaggtgctgcatttctgcacgtcggggaacaagggtgaagaacagagctagtccagcactgctccgtcctcccgcatttcttcttctgtagagtcttttgcaaactagagagtcttgcagagagttgttgggttttcccaggagatactgtatgcaaagaattgtcatgaagacataaaatcaagtcttggtgtaaaacttttaataaatttaaaggcatgtctctgtttttctcctcctccatggggattttcatgtggttagtaataaaactgtaggcagttgtatgtctagatttctatgtaatttgtttgtgttcgtatatgcacacctgtatacatgtgcacatgtattcaagaaagacctgcagtatgcttgaaaggattgaggtgcctagtttgtggtagtagctgaacagagtgggaggtcaaagttaagtcattgtgaggcaagggaacttgacttagccctttaagaattggtctgtccctgctaagccaaggctattagtgttttcttccctagctgtgttctgaaatggttcacctgacattcagctgggttgggggagaacctctttaaacatcagatcttattccggaggagtgtatccagccttctcacagcatatcctgttaaatatctgttcaaggttagcctaggcctggagtatggacagcatgaagccagatctaaaacagatcagttcatggataaatgatgaatttaataaaatttgaaaataaaccccacataactagtgctgctattgatcattcatatagccagcaggagtggtgagaggcttggtctgcctgaggtgtggagatgcttgtggtggggggcaaggtggacgagggctggggctgctcctggagcatctttacgcgggtggaggagctctgacacagtggcagtgtttgtaacactttccaaagggattaaaataattctgtagagttaaccctaggctagtgtggcttgatctgaaacagtcccagccagaaggtaagaactcctgtgttatgttgttagcatacaatttgctgaagttcacattttaaattttatatttaaaaaccaaaaagtagtactgatcattttggactgtttcaaagtgatattgtttttacttgttacaaacattggcttgcctgcatctaattgcactcacaatgggccggatgtggtggcttacacctgtaatcctagcactttgggaggctgaggcgggtggatcacctgaggtcagaagtttgacaccaacatggtgaaaccccgtctctactaaaaatacaagaattagccaggcttggtggtgggtgcctgtaatcccagcttctcgggaggctgagacaggagaatcacttgaacctgggaggaggaggttgcagtgagccaagattgtgtcattgcactccagcgagtgcagtgtaaatcccttaaggaaacagtgtgttgtggtaatcatgatatcatagtaaataggttttgttcgttatttttttcttttacttccttttctaccagtgactagtcctaatgtgttctaacttttgaaaataaagtacaaattagatggatttaaacatacgggaagtaagacggaaattcattacttttaaaaaacaatttgttgtggataagatttagaaatggaaacacaataaactgtgtttccatgacacaggtatactaccaagttcttacaatgtacctttgaggtaacgaattttcatgtcatttggagtagggctgggccagtgagtcactcatctccttgttcattcattacgtgaatacctagtaaatgcccactaggcaccctggagtcatttgtgtagagtggcatctctatacaactgttcgactaactgtcggagacaccctaatcaccccagccacaaacaaatagaacattgtatgtgtgctgaatcccacaaaggccagacatgatgccatgagaccaagaaggaaaagaaataatgtggaaagggtttggggtggaaaggtggggaacctggaggcgggccacatggggccccagaagccatgttgagggttttgtcttcaccaaaggatcagtgggagattagtgtagaacattaaacagaggtggggtatgtgtcatatttccattaaaaaattcatcctggccacagtgtaaagaatagattagggaggaagccaatcaggaagcaattggagtaggcaatgcaaaaggcaaagtgaacttggactagtggtggagataagttgactgcagagagagtaggaagtaaaattggccaggcctgtgttgggggtgggcttgtgagcaggatatcaaagataatgtccaggattctggcttggatgacaactatggcaatgcccattactgagctaggagatgctggaggaagatcaggtggggactgtgagcatgagtttgatttttgcagatactgggtttgagacacttctgagtcaagcaggcatttggaaatgtggactggtgccgagaaggaattcccagcagtgacttggtttaggtggtcctggaaagtagaaacacacatgagataattctggggatggagcttaaagggacgtcagcgttcaagggccaggtagaggatcatgagctgtaaagggacccaggtggctccagcacagcgaggaaagcatgcgagtgtgatggccaggcttccagggagagaggagggttttaaggagaacaacgtgctaaaagccactaagaagccaagcagagtgagaaatgaagacctccactgggtcttgcaagaggggaggcctttgaggacctcacctgagagctgatgaatgaagtgatggctggaagcagctctggagagggaggaatactgtggggaggggaggaactgaagaagtagagaagcatggctgtgcacaggggaggtgggatggcagccagggaggagcagaggtggaatgtggatcttgttttccccaacagagatagaggggggctaaaagtccatggaagggactctgctgagagggaagggtggatccatgagacagaaggggagagctccagtaaggacccagaggtctgaggacaggccaaagcacagatggagggattagctttggatggtaagaggaaggacagatggccccttaaacatgacggtaatgcaaactgctctgttttttttttttcttttggcgtttgtgatgaactttgtatatgctttccttgtttgatccttatcaaaccttatgagaagaaactaccattctcctcatttgatggatgaggaccctaagccctggagaggccaggaaacattcccagagtccctcaggaggaggactagtgctgggctcctttcctcctgttctgctgcctctgagaggagccaggattgaatcgtagccttgtcctctgacctggaggtctgggagtaactctcttatgacttttttagcctagtagaattgaacatgaacttcatgttttaagggatggttgcatttgtttgaatggtcacttctttttctatcagtattagctaatatagggagaaggaagtcatgcttctcaagtaaagcaacagtatctgtgtatccatttacttgattgagctttctactgaattacaggagttaaattatactttgttacactcttgatattacaaaatgatggccatgcctttattataaaatgacaccagttattctttcctggaggatgtgccttgtgtcactagccgcactaagcacttccccactagtggccccatgtggttgtgtgtcatcgctgactacctgttacaggtgaggaagctgggtggtgcagagacagaaagccggtggcccagtcaggagctcctaagtggcagagccctgtctcctgggttccttctcctgtctttcttgcctctcacttgaaataagagaggacatcagaactggcctgaatggggccctggtagggcaggaacaggacacctctgtggttttgttatgatgtcctgaggataaaggagtgaaaaaaaaatctttgaggaattgaagatttctttatgaaagatggctgaaactcctgacagcttttcaaattcatctttggagaaacttccgttttctctttcctgttccgaggcttaaagctgccctgaaatctacacatttatcaacagtctcttgtcaagactccagggagacaagaactcttatacattgctgttgagagtgtaaaacggtacaacctttatggaaggcaaattggcgttataaatgcgtgttacctttgacccagaaattctacttctaggaatttatcttaccaatacacctgcccacatacaaattgcagcattgtttttgatagtaatacgttagaaataacccacgtgttcttcagtgggagactggttaatacactaagatatatgcacaaaatggaatgctctgctgctgagagaaaccacaagtatgccctgcacccctgtgaatagatctccagtatattaggtggagaaggcaaggcaggcttcttttttgtaaagttaaggagggtaaataagactgcatgtttgcatctgcttgtatttgtgcagactgacactagaagggaaaccaagtaactgaaaaacacgatgattcaccggggtaggtggggaaacatctaggtcgggacaggtatgggagtgacacacctcagtgtacatctttgtatcatttttaaaagtctgtgcttgcattatgtatcaaaacttagtgctatctcctcaggtgcagggttctctggaactctgtctaggttggtctcttggatggcattcttgcagacttgccggaaaaccaaacaaaaggtgtgagtgcatgcctcctggatagatgtctttttagtgtaacttagcacaccttgtacactgtcagggcgcctctcagatgagtcatcccggcagcccctgctccatgagtgtcttccccacagtcctgagtgcttctaaaatcatctacaccagtggaggcaaaactagatattttcttagtttgcagaaaggaatatttccagacaacatgaacttgttctcctttggtctccttttccttgtcattgttcaagtcacaaggtctgctgattaaatttccccttgggtttcaaaagaacttgcttgtttggttgttgtgttttgccttttaatttgagagttgaggcccccaggtgcatgtggtaaagaattcaaagggctaaatgggtgtgtgttgttcgttatttctttgaacctcttggcacttgaatggtgtcagtaatttcactaattatggttggcaaagaaactctgacacatggctttggagctgtgttgttcttacatcatatctcttgagttgaacctatgctctcttgatggatgaactcgtaattcaccaggtgcgtggatcgctgtgattaattgtttcaagctatcagttatttaactctctagtgccaaatgttcaggagaaaatgtaagtgcagtgtaatgtaaaatcaagccggcaactccagcaatttgctcttcaaactatagctctatcagttcccattcatttatacacttacactattcaatttgtcgttgttgttgttgttgttgtgtttttgagacagagtttcactcttgtcacccaggctggagtgcaatggcatggtctcggctcactgcaacctccacctcccgggttcaagtgattctcctgcctcagcctcctgagtacctggaattacaggcacccaccgccacacccagctaattttctgtatttttagtagagacagggtttcactatgttggcctggctggtctcgaactcctgacctggtgatccgcccgcctcggcctcccaaagtgctgggattacagccactgtgccctggcactactcaatttgtaataaatcagggtaagttatttttggtgccaagtcgattaattgaatataggttattttgcatcttagattccctctgacgactaaatcttataagcagaggtatgtgagcatgagaactgtgtcgggtggtcctgaagagattagtggattagaaggagatttggagatttttaaaaaagcctctggacagtgagttaaatggtgggttgacactctgtggtcgggactttttggagagtctataaagttctgctgtatttctcaagagctagagagagatgatactatgaccaaatttggtttgaatgtattataatgtactgagtatcactaatttgttgggaaatgactgttaaaaatacttactgacgcttaaaaatatcacctatagcattagtataagtagccaactgatttacatatatttcatgtgtgtgttgggagaggggtgtggattcgttaggccaaagatttcggtaatatatttggaagagataaatgaagataaagagataaattaccttttgaataattccaaaactaaaaatgcttcccttaatttttatttctgattttcttatttctatcagagaaatgtttctcatgtgacaaatataatgctttcatatttacttctgcatgcacaacttttaattaagtattaattgattaattttttagagacaggatcttgctgtgtcatccactttggagtgcagtggtgtagtcatagctcactgggacctcaaacacctgggttcaagggatcctcctttttcagcctcctgagtagctggaactacaggcataagccaccttgcccagcaaatttattattattattatttttgtagagatggaggtcttgctgtgttgcccaggctggtctcaaactcctggcctcaagtgatcctccttccccagcctcccaaagtgctgggattacaggcgtgagccaccacatgcagtccgtgtacactttcacaccttttaatttctttactcattaggtgcattctttagcaattatgtgtaaagtggaaatgagcgtgcaaatcgtcattttctattgacttgcactccagaattggaaaattggaaaactgtaggaaactggaaaattagaaaactgtaggatctaaaacaaatcgcttctatgacttataatattcacttgtagaactcactggcctttgtcagctttcagagtatgtgaacactttttgccatgtaagtagttagtccattggcaatggatatatgtaagttggtatcttcactgcaaacatttagttaattgcgtttattcttgagccattcttgctctacccttaggacttgattttcagtagctacagtggttattccagaagttgttagaattaagagccaggaggaggtactatgtaagctacatttagactccactggacactcacatattgcacgtggaatatcttaaaggggttgtgtgctgtggtcagggtgggaattatctcttttctttccatgagacctccactgtgcattatttaagggcctgtcaattgcccgttattcaagttttgttgttcttggaggacactattgcctatttctttccttgtttaaaaaatttcatttaggtaggcttagcatagttgcagtagaatttaataaatccttttttttttttttacagaataaatctttttattacgtaaataccctttaatttgcctatttttaaaattcttgtttctgtgcttaccttgttgttagacagccaaggggatatgctgctctttttagtgccaaggtaaaaggtaaagctgtatcttaaatatttgtatttctctttggtcttggtgacccaaagtgatttgggtcattctgacatttaatcaagtttaaacaacatggctcttagaagtatgtttaccaggtaatctgagggctggttacctggtaacgcaattgagaaatttcatcaagactaattgattaatttattaagcacttattgtccagtttgcctttaattttcatttttctaagtttccattagctatcatggcctcacttgttatttaataatgaatggttacaaattgtttgtgtgtttttgtaattagaatgtaatagcaatcgtctaccagatgagctgacattgtaatgacatgaagtcagtaacaattatgccttacaggaaaattaattctgtaatcctatcatcccatattttgcctaagagattcgatttggctgctgctaggctgcttaggcaggtgacagcatggtgggacacttctcatttttctggttagactacttaaccataacgttcatggtgccacctgaaaaaataattttatcgttttagacttttaaaatatttttaggctttttttttttttttggcttaaaaaaagaatctgttctacttgggtattttgttctccttatttcttagtgaacaaagatatttgctcgacttctatcccagaaggaccatcctttcttcttccttttccttacctctaagggatatgaagctgtgagagggaattgcatatagcaataccattttgattccagtgaaagttcttacctttctcttttgtcattctcaacctcttacctgaagagtccattccctcagtatatagagcatctggaagtctaaggtgcaggcaggactgaaagagctgagaaaggcctcacatcaggtgacactggggcacctggctgtgctcccttgttggggggtcccttggcctgggcagttttgcgcttctccctgtttccctgtgccctgagactttgtgggtcacaggcaagggggctggcctccctgatcaagggcccttggcctaggagggcccctggatttatctagtccagcttctcgtcgtccaggtgcaaaactgatgctctgagatgtttagggatttgtccaagagcagagttggagccacagtccaaatcttctgagcctagtatggtattctgtcatccttggtttcattttgttctgttcataaaaattgcccaaaactgctgggcaaagtggctcatgcctgtaatcccagctcctcaggaggctgtggagggtggattgcttgaggccaggagttcaagcctagcctgggcaacattgggagaccctgtctcttaaagaaaataattgcctaaaactattcagggttaaaaatttgtctctaagcttaagaatttggaaaaactcagaaaagtagccacctataactccagcattctgagaacagttaagtgtattttcttctagttttttgtttgtttttgagacgggatcttactgtcacccaggttggagtgcaatggcgtgatcactactcactgcagcctctacctactcaggctcaggtgatcctcttcacctcagcctcccgagtagctgggactacaggtgtacaccaccatggccagctaatttttgtgttttttttgtagagacagggtttcatcatgttgcccaggctcatctcaaactcctggcctcaagtgatccacccacctcggcctcccaaagtcctgggattacaggcgtgagccatcatgcccggccttcttctagatgtttaaaacaaacacattttagtgtagttgagcctctgatcgttacatgtttatttcctagcatttaaaagcctttcagcgacatacactccttattagcttaattttttcttttaagagctgtgttcttgctctgtcacccaggctggggtgcagtggtaccatcgtaactcactgaagccttgagctcctggcttaagtgctcttcccaccttaaccttctgattaactaggattacaggtgtgcatcaccacgcccaggtaatttctaaaaaaaaaagttttttgtagaagtgatgcctcgccatgttgcccaggtgtctgtcttgaatgcctggcttcaagcgatcctctcccctcaactctcaaaaggctgtaaccctgattttaatggtagtgtaaagtgacatgggatgaaggaaccgtaacattcttaaagtttccccattgttgggcatttgcattggtcccagttttttataagtaaagaaggctgcagcaaactctgttgtactacttaatctttgtcctttatttcaaattatctccctacaatacgtcccttgaaataggatttctgtggaaaggtatcagtttaaagctcttgacccatatggccaagttgctttccaaacagcttacctgttgagactcggacctatgcttctaaagcctatgtgtgaaatgttcacattgtctttgggagaagcttcccacgaataagaaaaataagggaagaacaaataacataattgtttggatatatgctgtggtttgtgtggacgtctcccaccctttcccttccccagcccaagtcagtcttctgtataaacaacttacataatacagactcttcactgtttgtattatacatgtattttgtgagtctgtgtcagtatttgtttacacgggaattagggcatcaggctgtcttcctagggttcctctgtgcagacttgtagacagtatgggttctttgcgtgctgagttgaggtggccccaaacctttcagacagttgctcagatacctggcagttgctcatttacccttccagaccttcctgcctctatattagccaatgacaagcagatgctttccacaaaacattcgtgtgtgaactgttgacatttatgactgttttctgagcccacaccaggtcatttttctataaaatcagaactgtgagagctcagggcatgtggccatcctggataatgggtcctgctgtctggggagtcgttttcatcaaaattcacttttaaagaatagagtgtttattaacgaaaatatgtgagccttggctgggcactgtggctcccgcctgtaatcccagcactttgggaggccgaggcgggtggatcacaaggccaggagatcgagaccatcctaacgcggtgaaaccccgtctctactaaaaatacaaaaaaaaagttagctgggcgtggtggcgggcacctgtaatcccagctactctggacgctgaggcaggagaatggcatgaacccgggaggcggagcttgcagtgagcggagattgtgccacttgcactccagcctgggcgacagagcgagactccgtctcaaagaaaaaaaaaaagaaagtatgtgagccttatcccccaaatgtacctgacatgtgaataatatggctcaaactaatgatgtgtataatattaaattgactttgttattataagtgatacataattcaattttagttaaaatgcattatttcaatcaatatcaaatattgcagaaggaaaacctaaaatagtagccaaagttactcagatgagataaagaatatgtttagggctggaaaatcatactatttttttttttttttttttttgagatggagtcttgctgtgttgcccaggctggagtgcagtgacatgatcttggctcactgcaacctccgcctccagggttcaagcgattctcctgcctcagcctcccaagtagctaggactacaggcacgtgccaccacacctaatttgtttgtgtatttagtagagacagggtttcaccatgttagccaggatggtcttgatctcctgacctcgtgatcacctgcctcggcctcccaaagtgctgggattacaggtgtgagccattacgtccagcctttttttttttttaaataaagagggtctcaggctggcgtgcagtggcacgatctcggctcactgcagccttgacctcctctgctcaagcaatcctcccgcctgagccccccaaatagctgggaccacaagtatgcaccaccatacctggcttttttttttttttttttttttttgtattttttgtagagacggggtcattctatgttgcccaggcttgtctcgaactcctggcctcaagcgatccacctgccttggcttctcaaagtgctaggattacagatgtgagccactatgcctggccaataattatataaattttgatataaattcctgctcttcaaggagatgtgggttttttttcctcctgagagtatatttataaagttaattggattttatacaaaagaagcttttgactcatttcatttagcttttaatgttatcatctgggaggagatggtgaagaattctgttagccaaaccatggcgaattaatgtttcttacagatggttttattactttttatgatattatttggatcatgaaacaagtatcttggaaaatgtgagatacaaagatgtgagttgggaggtctctcttgtatgtgagttccttctataacagagaaaggatactttcagtttaagctgagatgctttttccttttcactcttgaaaagtctttgttgcaggaattttctgtgccctccctcctctgggacagatctgcttcttgatactgcagggctccagccttccttccagccagctcatttctcagggaagccttgttttcctttttcagaaaatttaaatgtatatttaacgcacaatttaactccctttcctgttgataatttttttcttcttcatattttgttattaataatagcttacagaatgggatcagtatcaggatcgggaggtaaccaggtctccaagttttccctttcgtttttcttttctgcttttaatgagccttaattaatccagggagctaggctgcagtatctgtggctctccctgatgttttctttctgcctttctgtcttggaggggaacctgaggatttggaagtagagggctctactagtgcttcctttttgtccttttctcattgtccaaaagagtcttaagcgatctccaggaaatcccctgctcctgccaggaatctgcctgtgagtatttgagtgagttgctgctttttaagtaccagttgagaagctgaaggttggtgttgtggttgtgataaactcccaacatgaaaactgaggaccaccagcgttttcagctcacctttgactcacgctggcagctccaggaacactgaacaggagtccccactgaacctttgctgcgttccgaagcagcacagccatggttaggcactgccaggcagctcttggaaaccacagggagggaagttttggttccttctttctgtctttgtttttgagaggaatgagcttggaataaaagaacgctagtaatgactgatttgcaggttaggtgtaaacattaaatcctcataacaggctaatgagaggtgggagaaattatccccattttacagatgaaggaacagaggctcctagagactaaagaacttgctactcaatgaggtcaggattcacacctaggttgacctgaggatagctgctgcagtgctcacccttcctaccttcccaagaaacaatacgcagagaatttcttttctaaatattgtgtgcctagaaggtgctttgtgttatcgaaacagatatatatgtgtatatctggtctctttaaaattctctttaataaaaacaaaaagtgatgctagtgtaaaataaaagatatatatagaaaattgtgtgtcctcgttaatcttctttaggaaagatatatgcatatatgcagtatagttttgggtttttataaaaatgagatcatgctattagtatagtgaatagcctctatatagtctttcgtaacatttttactttttctcggtgtatggatatcaatttaggtcagttgctgcggagtttgaaacgagttaaaatttcagcagttcacaaaatggatgattcatagtttagtcgagccatcatctgttgatggacagtcatgtggtttcttgttttttctttctctgtgtttcactaatgaaacaggattacagtaaattgactcgtgtatgtgtatacatccatctttgctggtactatagaaaagtgtattgctggctgggcatggtggctcatgcctgtaatcccggcaatttgggaggctgaagtgggtggatcacctgaggtgaggagtttgagaccagcctgaccaacatggcaaaaccctgtctctactaaaaatacaaaaattagctgggcgtggtggcagtggaggctgaggcaggagaattgcttgaacccaggaggcggaggttgcagtgagcctacatcgtgccactgcactccagcctgaatgacagagcaaaactccattgcaaaaaaaaaaaaaaaaaaaaaaaaaaaaaaaaaaaggcattactgccttgttcctgatttaaataaaaaaatgtgttttaacaaggaatatgttaagttttggtaaatatagtttatcatatttaagttgtgtatactcattcatgttttaatttttatcggaagaggctgatgaattttatgaaatgcctttttggcatgatataattgtgagcttttgcttttatttggtggtgtaataaattacgttgattagatttcccaatattgaatcatctttgcattcctggaataagccctaatttgttatggtgtgataatctttggatatgttgctatttgatttgctaatatttttttaaaaattgtgactgtagcctacaaagccctacagataggggtctttagtttttttccttgtttgcattctatcaggtattgatattaggattatgttttttaaataatttaagaagaatttcaccctttcccagcatctagaagcatttacataatataggaaataacctgttttttttttttttttaagttagagtaaaattaactggaaaacttcataggcatcccctgtagtcccatcccagaacattttaaaacaaattttttagtttttcagaatatattatagttgttctgttcagcttttaagccttttctctggattttgatattttctacttgctgggaaagaatttatctacaatttgagtttatcgcacagttatttgtaatattgttatcatttctctggtaatcataaccctttctcattactaacacatatttttgctctttttttgcttttttcccccttaatcaagtttgttagaagtttatatattttattgtcttcaaaaaactaggtatattaattttatatttatcctgcttttaatttcatctcagtatttaatttttattcactttttccattcctttaagtttattaagttgaatgcctgtctcatttgctttttagtcttcttaaaataatggcatttaaggctatacattttctttgaaaattgcttttgttacgtatttttggttttagacagttgatctcctttttgttgttttctagatggtttgtaattaaaatatttatttgatctttgattctgacattacttagaagtatgtctgtccttgaatttttcttttgcttaccttttgatattgtttatatgatttatgaatgcagctctgaggtatctgagaggatttattaacgtttacttgcatccaagtacatgattaagttttaattgctttgtggacattaaaaaattatgcccttggtaaaatgcaaaggttttattttctgtatttagtaaatcaaacttactgattgcattatagtcagatcttccaaattcatgtatgttttcagttgtcaaattgacagttaatgatgcaccttttataatttttttttttgagacagagtttcactctgtcgcccaggctgtgtagtgcagtggcgtgatcttggctcactgcagcctctgtctcctggattcaagtggttctcctgcctcagcctcctgagtagctgggattataggcacatgccactgcacctggctaattttcatatttttagtagagatgaggtctcactatattggccaggctggtctcaaactcctgacctcaaatgatctgcctgccttggcctcccaaagtgctgggattacaggtgtgagccaccacaccgggccccttttataatttttaaacttttcatatttccaagagaaatgcttagtgtatttatctgccgttttgcttgatgcatcaatatgtgtaatttttttatttttcagggattacatatttatcacatgtaatatccctctctgtccagtttaatgcttaatggccttgagttcttggtttgattttactattgccagctttgctttctttttacttgactttgcttggtatactcttgttcaattgtttgtttttaaatagagctggacttttaaaacccattgagacatttttgttctctaatagggacgttctgccttgtctttctttactgtgataatgcatacattttgctttattgctttcatcttattcaatggttgccatttattttactttctgttattctcaattcccatgttaattgaacaagtcctttgctaatttgaaaagtgtgttattttcaaagctaccggtgcctaacaatttgaaaatctgtatttttctcctgaaataggtaccagcattaaattactaattcttccaccagggtttgcatttccgcaatttctgccgttcccatgactttctctgtctcctggatgtgttctctgtcttttcactcatggattctagtagattcttattccttgctcttgggcgctcgcatttcttcttcttaatcctccagaatctgatactctagagcaacagatcttttctgttcaatttaaaattttaaagtgtttttttttttttaattcctgaaagtttttatactccaattgtgtctccacatatgctcttagactcctcttcccgtctagttctcctttcttggttcgattagttctgtttcagctggtgccacctgttgcagctgagcttggtcaccctccctcaggctcctgcgtcgtcctcagtgggtcatggtttttctttgcttgccgatggctgccctcagccgtcacacaagtcatgggttagtgtcactcaaggaatggcagaccagcagatggtaggtgataagccaggaaacagatactgtgccgctgagttgctctgttcccagtctcttccgacaacataaggcttgggaacagttccaccttccatggaagccccccttccctctggtttcacctgggacagcaggatgagcagggtgcagggccttcttccctgtggatggactctcagttacaatgaccatggagaactgtacccgctctctgttttggagatttgggagatcctgagggcctcagaaggccctcactctcatcccatgcactacctgtaagctcattagattactgtccttgttactttagagaggggactgtgagggaggcaggaccaagtatgtttattcaggccactgtcttccccataaagactatatttgtgtacatttttctttgctgtattgtgagaaggaggtagaaaaaagatgtgcatgtctgcatttggaaacagttctgagagtggtgctgcatcagcggggctggattgccctcaactataagaaagtgggatacttatataaaggaagcataatacagcatgtttctcttacaggaaggactgtttcttagagtcctcatcctctgtctccatcactcagtatagcaaatcatacattccatcaatgttaatgacatcaattgtatgcctgtaagtatgtacacacgcacaggggcagggggcacttcttcactccacagctggaaaacttgggacaaaatgcctagccagcttggcccaaatttgagggtattgccatctgtatctcagtgcaggtgtttctgtctgatgttcacagtctgtttatccagagtgccccagaaaggacagtagtgttaggttaaacctgtgtatgtctgttcttggttttaataacagtcctgtctttggaattatttagtgtgttctctcatttctcaggaagtcaggatgttagtgccgaagcacttctctgacttggtccgacattgaagtaccttcccctgcattacagaagaacggccccccagggggtctgtttgatgaacacatgtattattgcagtgagatactctagaaatagcttcatgtccttgcaaaattgccagcacaagtaaggacctggaaattgttgctatgcatgtatgtcagaagatttcttaaccaattctgtactgaataaaataaaatttattttcaagttttgtagggacctggggcaatatgtcagatagagttgaatattttcaaggcatttttagttcatggggcacatagttggcttaagatatctatgtgtatcaggactgaaaggtaaagtgcccgaacctgctaatgaaagaggtgtctgtgtggccatctgaggttcagccacaatgtgtcttgcagaattattttattttgctagtttttaatttctcaaacagttcagctgcctgtcccgtggtaccgtgagacttctaattcaagatgaccagtatttgcagacagagccactgcctttgctgccacattttgcttggttattgtgtgagaacaccatttttctctttttaaatgaattgtgtttctctttttaaattgagcatctgactgggcgcggtggctcacgcctgtaatcccagcactttgggaggccacggtgagtggatcacctgaggtcaggaatttgagaccatcctggccaacatggtgaaactcctgtctctacttaaaaaaaaaaaaaatgcaaaaactagctgggcatggtggtgcacatctgtaatcccagccacttgggaggctgagggcaggagaatggcttgaacctgggatgcggaggtcatagtgagccaagactgtgtcattgcactccagcctgagcaacagagagagactgcctcaaaaaaaaaaaaatccgtttacatagtgataaataaagtaattactatagtggtggcattctgcctaagtcatcttgaaaactgaatgcaaaatctttttaatagctccataatggtctcttgaagtgttacagatttttataacgatagctgtaatacaagtgcctttatttactgtgagacttgaacattttgaccatttacatgggtacttgtgtgtctccagctgagctgagtgcatgtcgctgcggcattgcaggcgtgtgtgcatgttggctcttgcaacggggcgtctgccaggggttgtctcgggcaggagaaggaggccagactggcaccacttgtagtgattggaatgtgtctagtccagctcttcagttccatgtaggaggttttaggatggagattgtgttttgggaactccaagtcactgtccaatttggagagtattatgtaagaaggcttatgttttctgattacccatccttcgatacagaccaaataataccacagtgataaaaatgggaaaggagctgtcgctcagctcttcttggccgtgttgtttgcttttcgatgtctaatttatgaaagcatttcaaagtgacatatatactgaacagcttcgtcttgccaaatgtaaaataaactggagatgagtttagcacagagctttgtagattgttgtcctcttggtagagtcggggcctaaacaccacctggcctctgtgccagtggacaggtgacctgcctgtcctactgctggtctctgcagctctctgtcttgggcaaccctggctctgagttccagagtgttctccagtaggagagtctgcaggggcactgtggagcacctgggtatgtgcacatctgttgttggctggcgttgtctctgatggcttggggtgtcacagagacatgacagtactgtcactgcatacctctcaagcttttgctgagtcctacatgagttgcaggggcagagagggagggagaaaacaatgcctagccacactgagaaaggggaaagtgctacagagtcctggaaggaagcgaggatggacatggacggggaagcattcataccaggcaggaaaagtgacttcatggaccagtcacagaggacagggccagggatcaaaccttccgtaatttgcctccacagtttgtctgagactggctacctggttgagtctgccagagccctgtgtgcaggtactaccactcactgtcacctccaggcaggaaaggccatgtgaatgcatgcatctttgcaggaacttgcccctttccactgaggtttgaggcagactccaaccacatttccatccagtggcttagtggtcttacccgtgagcttgaactgttgtccctgccaggacagtctttgcctctgtaagtatctccatattcctccatcctttcaggtcccattcagtccctaggtcctccatgatggaatattggttgatgcacttattccacaaacatttgttggccacctttcaagtgccagacaacccttctaggtatggaggggtacagtgatgagcaagccactgtttctggctgcagagggctcactgtttagtgggagaaacagacaaatcatacatcttaactacactgcccttgattgctctttacctgttatatcagtcgatcttgcctgcctagcatttgttccctgtttgggggcctgtatgatgttcgtttggatacctcagggtacattttcccatctttgtgatgatgtagctcacttggtctgaatgatatgtaatcctgcacatgtagagtgaccattatatttgcataaatagcattggaggaatatataagaaatgaataaaagttgttatatcatttgatttttcttttcttttcttttctttttttttttttttttgagatggagtctggctctgctgcccaggctggagtgcactggcacgcgcatagcccatcgcagcctcaaactcctgggctcaagtgatcgcctgcctcagacttcattttgatttgtgaacctcgtgattctattacttgttccacaaaaaattttaaatgaaaaaatatttcaaaaatacatatattccggccaggcatagtagctcatgcctctaatcccatcactttgggaggccaaggcagacagatcacctgaggtcaggagtttcagaccagcctggccaacatggtgaaaccccgtctctactgaaaatacaaaagttagctgggcgtggtggcacgtgcctgtaatcccagttactcgggaggctgaggcaggagaattgcttgaacccgggaggtggaggttgcagtgaaccgagattgcatcattatgctccagcctgggcagtgagtgaaactctgtctccaaacaaaacaaaactaaaacaaaaacaaaaacaaaacaggctgggcacggtggctcatgtctgtaatcccagcactttaggaggccgaggcgggccgatcacaaggtcaagagatcaagaccatcctggccaacatggtgaaaccccatctctactaaaaatacaaaaattagctgggtgtggtggcaggtgcctgtagtcccagctactcaggaggctgacgcaggagaattgcttgaacctgggaggcggaagttgcagtgagctgaggtcgcaccactgcactccagcctggcgacagagctaggttccatctcaaaaaaaaaaaaaaaaaaattcctccacaacatatattccaatgtttagtttttctgttacagagatcacatgtactctaacttgtcaactaaatttaaaaggaaaagacaactttgagagaaaattaaaaccaatgcagtgtgtgtaaatgccattttgataagctcttatttcatgttgacatattctatggtgctcgtcttacataacctagttagggaaatgttttgttccagtctggctttgtttttcttcatgtgtttaggtccttccactttccttttgttaatttttggtgttgtacttcaggaaatgaattgagggttgcaaatgacctggagggccttagtttgtttgcttgtttgattttagcaacagtcaccgtggtacacctgacgtggctgggactcctgattttttttttttttctttttgagaacaaagaatgtgtccttgtcttggcatggactgggtagccttgttcacctccccacccatctctccttattggtgaggcattgtaaaccgtgttaacaggtagcatccacagaaccctggaaaggttgtgaagtccctttggaagcctaagggttttgatctcatccaggttgtaatcttaaattctggtacaaattcccttgttacaactgggttaagtggttttaacctcttttgtgccttcattttgaatgcttagactggaaagtcgttcagagactcctgaccgaataaagcctacttccaaatgagtgggttgtccaggtgtgcttgtagatgtcacatacttctaacaaggctctgcagctgcgatgtcaccttgcccagcgtgacctcattagcatgtatgtggctttcagtggccatgtactttgcttctagagctttctttcccattctgggttcttaggagggggctgtgctttgtgtgtggccaggcagaagtccatgttttagcttttcaattctcttgaagaaaacaaatgttgttgataagaacacttgtcatggcatccgatttgttcttgtgagggctgtattagcaataaatagacatttagtttgcatatttaacacctcatcttctttcagcccacacgtcttcactacaggattagcttttcattacttagtagagcttttaattacctgaagctttcgtgtctttactgggatataacttttctccttattaaccagaaaaagtcacagaaaatcttgtaatttataatggaatggagtaatattcacaaacaggctttggcaggattttttttgttattgtgttttttgtttttgtttttttgttacactagttttatcacaagacaagaaagaggggaacttttagaaataaaaattatgtgctaaaataattaaccttcctgagtaacacacacagaatgttggtatagtgtttgcaccagaggaattacatatggaagaatgctgggatcttttaccaaataagggaaagtagagttcattacaaatagaggcttctagcacagaaaagaggacattttataagtactgtgaagcattttcagagataattaaataatagaaaatattaaaccaatttaaacaatttgtagtttttttctaataaccagtaagttcttcgtcttcgaataattcttttatactgttctatttccagctccactgagtgcccctgtgttttcagagaaaacaggagtctgttttggacttcctctttggtatatatggtgggagatttgtttaaaaaatttttttatagaggtaaaattcatatgacataaaattgtccatttaaaggtgaacaactcagtgacatctagtatattcatactgttgtgcaattgccatctctatctagttccaaaatacatttgtcatgccgcaaggaaagcctgtaccccttaagcagttaatccccattcccctttccgctcagctcctggcaaccaccagtctgcattctgtttctatggattcacctattttgcatagtgcatataaatgcagttatataatatgtgaccttttgtgtctggcttctttcacttagcataatatttttaaggttcatccatgttgtaatgtatcagtacttcatccctttttatgggtgaataatagtccattgtatccagttgtatccagaagatttgcttttcattgcctaacttcagggcttcagacacctcaatctttgttctgagatggatgtaaacttaatgtatatctctctctctcacccaatgatcatgccaacaccttttttttttttttttttttttttttttgagacagtctcgctgtgttgcccaggctggggtgcagtcttggttcactgcaacctctgcctcccaggttcaagtgattcttgtgcctcagcctcccaagtagctggggccacaggtgtgagccaccacacctggctaatttttttttcttttctcttttttgtttttgtagagatggagtgttgccatgttggccaggctcgtctcgaactcctggcatcaagtgatctgcccgcttcagcctcccaaagtgctgggattacagacataagccaccttgcctggccatgccaacaataattatttagaagtatgttgagaatacatcccaataatagaagtgaaagctctttaaaaagaaaaatattcaaaacttaccagctgatcttatgtttcatttagaatggctgcattctttgcagtaccctagggttgtagaaattctcccccatgattgcacaacccactccttctcagccagtgtgcacctggagtcagctgtgtttggccttaaggtgtccatggtccagcagggagagggcagatgggtcagtgttgtcctgctagtgatgagtatcccatggtgggcatgctgatgccacgcaagggagagggtgtctggttctgtgcagtggcagtggtgcaaccccttaccaaggtaccgtggggacctgggttagggcaggaggaggaaggtgttctctacagactgcagggcttggaggcagcctgtcatggggaagggtgtggatgaagggtgagccgggaccccaggcaggtacggagcagttcaaggccgtcaagtgtgcttcattcttcagtcattagggtgtctctgaaaggtttttcattgaatcagaattcccctaattcacgaattctaaagcttaagtaaattcagtaataataaactgtcaattatccaagcgatgaatataaatccataaggtttttcaaatccccagaaatccctttcgtctcccacctggttttgctgagcgcctgtctcttctgtctcttttctgattcccacctttcacttttcctccatttttcgcttaatggatttatactttaaagtaggtattctgaaaattccaattttatgaatggtgtgacggtgagaactttgattcattgaaagataaaaataatcattacattttatactgcaagggtcatccttaatattcttcgtatttttaatatagctgcatgatttgagtagttgagttggggattggataatgtatttattgattgattaactctctgggggtccatacatacccctctttatatccctgtggtccctttttagtccttttgtaaaaacttgataatgttaacctctgccaaagttgatgcggtagttgtgagtggtgggacgcaagcgtgttgatttattcttggagacagcagaaacagcaccaccttcaactgttttgtcatgatcatcttgtaaccataattctgtgctaagtcagaattaatgttattttgttaattcaggttattgtgaaaatctccacaggaggttatttaagcaagtcacaaattgatgtttctgtttgtagaaaaactccagctcatccagccagccacattattccagggctgcatggtgtcagcgtagggaccaggctcggtgtagagaccaagggtgcctttccccttcctttccgcccgttaattgcctactcgcccagtggtaccttctgaacttttagaaatccagataggatttccacatggttcattagaattcatttatttttttccatctgtatttctttttgttgtactccctagatcattatttttagttactttttacatgcattggttaggtttttcatgtaatctctcagtaagcgtactgggggatgagtgacctcagtatttaaatttttcataggtgggatgaaatgtcttttctgagtgtgagtatttctgttccattcttcttttccaggcaggctctcattctgtgctgcagtttggattcagggagcactgacccttctgtcaggttgctcctgctatgaaggatggaagggcattttgatacatgaggcataactgtaattatccggtggggcttggtttgtgctgttttccacctcttcgtcatattttggaaaactgaggccaaaagcaaagttcattttcccctttaaaagcttctttaaaaaaatgatgaaagagctttatcaatgttttgaataacccagaaaatatttcttattgttgataatctgcagtttgcaagtgcagcgaatcttgtaggtagatttaccttgagttttttgaaacggtagaattaatgtattaaaacatatggtttttagttaaaataggatgttaaaggaatagagcgcacgaacaaaaaactttccacttgaacccatgttgtttcatctgacagtgggtatggtgtccctggcaggatagggcttccacctcctgctggtgccggtaggacagggaagaggtggggaacactgtgtctccatctcccaagcatcttacctcccaagtcagatccctggcattgtttgaatacttgcgtgtttgtgtgtggggtgatgttttcctgagaatgtggcaaaataatagaaggtcccagggttcctcagtctgcagaccatagctgagtggtgtgtgcctctagccatgaggtgaagcataggtgaaattcagatccataggaagacagacagactttgcaagttagtaagctaacttgctagaggaaacggtagactcctgtgctggctgccaactaaaaagcctttctccacagttctgttctcatgtacaccctcaggaccttggatgagcttgtgtgttcaggaaattgggcaccgagattttttttgtatctttgattttagttgatatgtagtccttccaaggaaagtattcgttggatgccctttctacactttggcattgtgcaagaggtatcaaattttaaagtaaaagtgcacaacctggccaggcgcggtggcttacgcctataatcccagtactttgggaggctgaggcgggtggatcatgctgtcaggagatcgagaccatcctggccaacgtggtgaaaccccatctttactaaaaatacaaaaactagctgggcgtggtggtgcgtgcctataatttcagctacttgggaggctgaggcaggagaatcactttaaccagagagttggaggttgcagggagccgagatcgcaccactgcactccagcctgggtgacaaagcgagactccatctcaaaaaaaaaaaaaaaatgcccacaactgggcatggtggctcatgcctgtaatcccagcactttgggaggctgaggcgggcagatcacgaggtcaggagttcgagaccatcctggctaacacggtgaaaccccgtctctactaaaaatacaaaaaaaaaaaaaaaaaagccgggcgcggtgccgggcgcctgtagtcccagctactcgggaggctgaggcaggagaatggcgtgagcccaggaggcggaggttgcagtgagcggagatcacaccactgcactccaacctgggtgacagagtgagattccgtctcaaaaacaacaacaacaacaacaacaacaacaacacctcacaaccctggtctcccagagcttccatattaataaatctagacaatgtgaaatgcaaatccacttaatatttgatgcaaaaaaattttatttgacctgttattttaactctttgacataaaatctctaaatcaaaataatcagcaacagttttaagtgtataaatatgtatttctttcagtgcttgaacatttttagacaggaagattcttgatcttctttgtaagcaaatagcatcaaagagtaacatttctgtacctttgtggtatgtaccttgtggctaatttgtccatgaagggataggcattgtgttttgttgcttaagtcgcttaaggcctttaaagcatttccaaactcacctatttttgctctaaggggtataaggtgttaaaaaatgaatggaagttaactcattctcaccttgtctgctaacttccttttgttctttttctgtaagaactcataaagctgtatgcatcagctgctcccaggggccttctaaggcctcagtccaacaacagtgctacaggtgaggaaaggaaagaagacactatgtcatcatgtcattcttttagacttggtaagaagtatattcaagcagatcagatgctctcagaatcacagcgtgttgtactgctagtaattaaaactgaagtccacattgaataagaaataattttttattgattgctggcatttgtgagaaagggtttaattagaccaggatatggaggggacttatcgacagttccgttgtacattgttgacatggttattttctgtatctcattttgcctgggaatttgtcattctcttctattttcttatcagtagcactgcttttacacttattagccctagctgtttgtcttgcttatttaaacttgtacatggcacatgctcaaagatttttccaggcaaaatttctttaaagcaggatttgagattttctatccccttccgtctgctggattattccggtgagtgttaatctcccgcctttgtcttagcctctctgtggtcttcggttgcttccttgttctctgtagatctcctgagttggccattagctgtcaacagtcagcacttgctgcctctcaagtctcttcccctcctggctctgccctggttttgctctctgacggggatctaaattgggattctttccagtgtggaatcctgggtgtccaccatgtcactctgacttccagatgataatgagtgtgaccatgggctgaatgaatgtctctctgctgggattaaaagttagaggaaggcaaaaacagatattgcgtgttctcacgtatacgtgggagcaaaaaaagttgatctcttggaggtagagagtagagtgatggttaccagagactgggaaagggggcgatgaagaggggtagagaatgagtacaaacattcagttagatagagggaatacattctaatagggtgactatcgttaacagtaatttactgtatatttccaaatagctagaaggttagaaatgttcccaacacatagaaaggatacatgtttgaaatgatggatatcctaattattctgatcattatacattgcatacatgtttcaaaatatcatattaaccccataaatatgtacaaatatcacacatcaataaaaaataaaggggaagacataggtgtaggcatagatttttaagctgagaaccttttgacagggaagaccagggatggttttagggtgtggggaatctgtgtaagttggccgttagctgtcaacaggcaacaatcactgtctctcaggtccctcccgctccctgccgtgtcctggttctacttgccggcagggatctaagttggaattcctttccaacatggaatcctgagtgtccaccatgtcaaaattgtgtcaaaattcgtctgtatgcatttttcttggtagaagggtccccaaaagtcaccacattctcagagacttctgatccctaaaactttagatcaacagtcaataaaaaggtcccagttgtgtcttagtccccatggcagtacttttgaacatttaaaggtggagaattgctactgaggactttgttctgtggatgaaacttcgaatgaggattgttggtgagagttggattgttgttgtatgaggaagtgcaccttggaatctaatggggtcttcacggagggggagtcagttgtggcactgtttgtgtattccattcatcattcatccctccatccaagcacccacgtggagctcagaaagatgactaacacataccccctgctgctcctgtttttctaaggtgtgctgggaccatttacatttagttctttggagaacacaactacttaggatttttgttgttgttgttgttttcctgtacattgtcttcctctctcccttctggtacccattccaccctctctccccttcctcactgccgtttcataggggttctcagattcctgtgaataaagcaaaccgatgtgcagatatgtgtgcttacacatgtggacgtatttgaggaggtaagagggacctgcacaaggctttagtgagtaagcagagaagttatttatatatagtgagacccagtaaacggtgatgtcgcaggtgaggcagttgatctggtcagaatatgcctccagagacatcactggtgaggcctgcatgcatgttgaaaagagtgtatcttacatctaggcttgggtttccccctgcagctcacttatgaataacaacgtatgcaagagatttgaacattttcatgttcaaatgaaacatgaaaagggaaaaaatttaaggttacggttaagtttggattgtttgcttattggtttggttattggcaattgctacaaagtccagggtgttctttatcagcagcatgcttatcaagttactgacattcaagctgagtttccttccctccctccttccttcttctccactgacattttttttttttaaataggtagggaggcatttaatcttgtagcagcatgagagtagcttaaatgtccctcctctagcagtatgtttatagcagcgtaggtaaggaaagcccagcttgcacagctgagctctaaagtgcatacatcccttaagttctcatacacacactggccagtgagacccccaaactgcgaacagagaattctaattgaagtaaaagcatgaagtttttctttattgaccatgtagcaactgtggaatcatttgaaaatttctgaaaacatgaaacaggtgtttataaggagttttctgacttaacaaaattggtgaaataccaactttactaaaaactactaattcataattttttgattaataatttctagtctggaaaagaggaattttttgaaaatcactgatatttttgatatactgttgttttcaaattgagttctcatagtgtggtcggctctgttctatggaattaatattgaacaagctgttctgaacctaagaaaggtttgtaaaaaataaacatgaaggaagacttcattcaagaggtcacttaaaaattattattattattattattattattattattattattttaagaattaggtctctgttggccaggctggagcacagtggcacaatcatagctcactgaagcctcgaactcctgggctcaaacagtcctcctccctcagcctctctagcagctagaactgtatatgtacaccaccacgcccagctaatttttttttttaacttttttttacttttgaagaggtgagattataggcactagccactgtgcccagccaaaaggtcactttttttttttccttgttggggaggaatcaataacaggaacaccagtcatgatttggtgttttttccagggcagacaaataaagatgatattacgatgtttgttatcacagaatatgtttgcttttgataggggttgggtgctgaagggtaagtggttagaatcattctttttctaagggtacagccattaatactccttgattcaaatcactatttaagttataaatacatggatttattttctaacctcaaaattatagcatcttaccacatatttgcatgcctctcttgagttaactactggtgatgattcttagctcatctgtggccaagtatagataagagaattagaaagttgtttccagcgtgtgaacttttatgattttcttccttggttactgtactcagttcttttttgttttgtttctatacaagatgagtagctggtggctcagatgacccccgtgctgcatgtacagtcccatccagagagtgttgggggctgtgtaaacctcgaggctcagagtggctgccattttcctaaaagagaagtatggctgctgttggcctcaatgttcagctttacaaaaactcccgtaattaatgaaggtcaaggcatctgcaaacattaatggggtcacaagggacaaatcagttccttgaggggaagttaaaatgctagattgcttaccgctccagacaaggcgttctcaagaagtatgtgcagtttcagcacaaggattaacacggagcattacttgagccatggggtgccttgggggacatggatcagcaaccatttccttttgctcacagcgcccagattttgttctggggaccactcttatctgcactgcatagcagccacacattttgagtgaaattaaccccaactagcattcgagcgtcctcccctcccccaaaagatggactgtaccccacactgtaatcagcagggaggcatttcctggccacagttcaggttggtcccttagaacgctgctcagaactgtggtttggtggctctgggaagcagtgctctctctgagtgtgaataaggatccacatagctccagtaggtgtctgacgacatcttgtgatccggggggaagccagcctaaggacaaagccattgtggggtgagagacaggattggcacaatcactgacaaccgcagtagtagcccagaataaactgtgcctgaaacctaccctatttttgtattttttccagttttaaggaaataaatcccctttattgtatactcagtttgaatcaattatttttatctctttgggattggtttttggttaatctcagcaattcagaaatagctgaagaactatgctgtgggtttagacatcatgccgtgacaaaaagaagaggatcttagaagcgggggacattcactgaagctttatgagcctttcctgaatcccttcaaatcagatcaagttctctctctcctgtgcttagaaatgctgcctgttaagtcacgttggctacagcacccatctcagatcccttgtgattcagttgtaaagtagattcttctggtctgaattagaggccaaaacacaagacagatcaaaaatggggaacatattgcaaatttccccacaaaagactgaaggatgtgtttaccattgattgcacagggactgcagtgtctatgcttttaggcatggaaaatgcagggtttgactatcgagtttagattttaaagttgaggattgtttctttaagaagaaatatagaatattattcagtcctaaaaaggaaggacattctgacacatgcaacagcgtgaatgaaccttgaggacattatgccaggtgaaatcagccagtcacaaaaggacaaatactctatgtgatttcatttagatgaggttccctggagtagtcgcattcagagacagaaaacagaatgatggctgcggtggtgggggggtggggggtggtttggggaagggagtggagtgatggtttcacttttgcaagatggaaaaagttctggaggtggctggcggtgatgttgtacaacagtgtgaacttacttaacattgctgcactctacttaaaaatggttaaaacggtacattttgttatggatattttcccacaattaaatttaaaaggaagatgagtagtactcgactcattattggatattacatcagggaactggaggtagggtctcacttactagttacgtagctcaggaacctggaaccagactccttctccagctgggcagtcccaggtttgagtcctggctccactggaggttgtctgacttggaggttaataataacctgccttagtcccagagtccttagagggaaaataggttataatacctgagtccatgtgtatcaagccattgctggttccaggcccctggagcactcagaaatggatgacccccagctgggtcaggccaagtcctccctgctgtagcaagcgggaccattgcctcgttccccccacctccacatggaaggtgccttttgtgtcctgccccatctctgttttaacagtcacaagactgtaggcagatctaaacttgtttgcacattattatcacctggggagctttgacgattccaaagccaggctgccacccccacctctagaccaactgaatcaccatttccaggggtgggactgggcatccgtgttttcgaggcttctgggtgagtaccttgtgcaaacaagttcagggaccgttgccctagacactgttcttcccctcatgtctcaacctgggcctcctaccactgccaccaccacagctatgccacctgggatgtgtcccaagcccccacttgtcggggaagcagctggggaggggtctttggccacctctgcagctataaggatcagagcaacacctggcttctgtgcctgtggcccctgctggtgctgggtccctggtccgcactgaaggatccaggcagagtacagtgggtctcccaggtcagaatcccctgggttgcttgttaaagctcacagggctgggccccaccccagggtttccgattcagcaggtctcgggctggttggatgatgagaatttgcatttctgtcaagttcccatgtgatcctttttggggtctgggaccacactttgagaaccactggtctattaaacaaatctttgcaaattagggaggtgtgttgtgggaggaagagactgatagttgaaagaatatttgcctaaatacagtgcctagtatttgccaagtacgcagccttctttctggctttaatcatacagactttctcaatcacatgtaattgcacatcctttaagcagcttttgactgactttggttttctcttttgtggtgattttccttaaactcccgaagggagggtggaaggggcaagagaaatttttatttatttattttaatttaattattttttattatttatttttttattttttttttgagatggagtcttactctgtcgcccaggctggagtgcagtggtgtgatctcaggtcactgcaacctccgcctcccgggttccagcaattctcctgcctcggccttctgagtaacagggtctatgggcatgtgccaccatgccgggctaattttttgtattggtagtggagatggggttttgccatgttggccagactggtcttgaactcctgacctcagatgatccacgcgccttggcctcccaaagtgctgggattacaggtgtgagccactgcgcccagccagattttatttctttaaaaaagaaacttactagttatcaggacacttgtgttcttggtacttgattttgtcagcattatttttaagagcctcttccctccttccccctacctccctgttgagcccaggctctgaaataacataggtgcatgtgaagttcccctacctgccattaccagacattggtgctgggcggccctcacctccacctcctctcacctgaggccacagcggtgtgcaaggatgtggtctgtcttgagtgtgttttcaaagcagctgtttggtctgtgccttggatgtttttccacagataagcccaaaagagaaccacatcttaaaacgcccgtgaccttgaatggtctttccggaggggcggctggatttgtgctctcatcgtctcaggtatgtgtcaagccactgttgtttcagagctggacacaggtgcttaggaaaattcctcactgaagggttttcaggatttacaagttcttgctgtttttgtgaccttgtgtggtttctggtttcacagaaggctttgtttcttggttcttgttgctgctttcagccttggcctgtaatcactgggcgccagggagggctgcggtctgtttcccggggtgtgctcagataccgtgtcagttcacatgtgttgctgcagcggcagggggccaggcaggaggggcgggtgtcctgaagcacgctcaatttgctgatcagggccttcacttggattttgcacttgccgcagtggagacattcctcgtagctactcagtgtggtttgttttaagtgggccatccgttaattcatgtgacctggaacttggttaatgtacttgccaaggttaaagttgagacgctgtttgttaaacctttcaaagagggaagaaggttgccttgaattcagttccagggtttgggagtctgagagggaggtggtgaggggcccggggaggccctgagaaacaaaatgctggttaaggacacagtctgctcaccgacctcggaagtctctagacgtctaaagaagtccaagcaaggaatgatgaccgaagaggaacctcaagggtgcaggcggctctgggatctcagcacatctcagtgatggaatgagctgccggggaatgacccctgtgggggctgtccaaagtcagagcagacacaaacgtagctctccaggccccataccttggtgggcaagagggcagcaagtgcatcctcacagttgatggggagagcagcatttcagcctgcagaaaagagaaccacacagatgtaagatgaggtctgcactcacttgcctggtcatgcagagacggagctgggagcagctgcatgacttttcagagaagtggcacacgtttactgtaagggtcccaaatgtagaccactgcagatcgtaaggtctagatggagggaccaatagtagggaagtaggggagaagaaagtaaaaccttacagtataaagacccatagatgctcttttgtttttgatgtgtgtacgggggttagatatttattgagcacctactgcatgacagagtgttcagcaatgacaatgcagagcttaataagaacaggttctagactaatcttttagggggtgaggatagaacagaaataggtaattatgtcctgagaacatgagagagtgttggtggacagaacggcgatgtatccccaagggcaactgaagccttcacagaagatgcaaagcctgtacgtggtcctcggagtcatgccacatggtgactggttatcttagtcgtaggaaaactgagaagctttgaggcatgttctatctgtctttgtgggcatcatcttcattatttgaacaattcagagtgcttgatgccttttgcttcgttctcacaatccttgacactaagctgtgggcttgggttatagtcactcattctgttattcatgtcattttgcctatccttccacttcacagatgagaagactgagacccagagagggtcatggttttcattagccaaatggtgcagaaacccagtggtcacagtggctctctagctctttgtcacccacagggcccttgataagagtacggtctttctccaggggagcagggttgaggagtgggggcagccctggcctgggtggccatatcctgatttcccctcccttggcccatagctctctatcttgggtgaggtgagaaagtaaggctgctccttgactgtggtcccttttgtgtctgtcctgcactgggccaccttcccaggggccttgtgtcagcctggtagtggtgctagtggccttgaagtgagagtgggtggatcacacatggcagatctctggcagtgaccttttctgtggatttccggtgactgatgatagcctctttggaagtcagcatatgcatagctctctgtcttttgaaaacaatggaaaaacccaccaccagccccaaaaccagctgtctttcttcttatgaatagatatccatgaaaagcagaagagtagtttcttgtaagtactctgggagtgcataatacattttaaataagattaaaaattatgttttattcttactagcatcactgtcagataattgagcgtgagagcattcagtgctgtgtgcttggtacgaagtagtaacatcaattcagtgttcagtacatccactttgttccagaacaatgtattcaaggtcggtgtattttggctgtgccacagagttctggaaattcccaagagaataagttttcacctgttatataatccagcacaagtgactgtgtagcagcaacctcatgtttcatgatgactttaaaatgcaattgattctaaaatttagcttttaaaaatttcgacttcagattttctctgaaggtttaaggtaggcttctcctttattaattttttcaagaaatatttaagaacactgctctgtgctatgtaccattctaagcactttacagatactaattcatttaatcctcagcctggttaggtaagtactgctattcccaccgtacagatgaggaaacagcctcagaggagttaaaacaagttgctcaggttacaccgtcagcggtttggactacttcagtttcagataatcactgtgaaattttactgttttgagctacacgtttcaaaatcttttctgatgcggaactatcattaaatcatataatccgcttctctggagtcagaggttgacaacacattagcacttgactcgagcctctccctggaggaggacattccgtctgcggggagccgagtccgaggctggagcaactctggaaccacagccctccagtagagggcacacgagagcaggctatctgtggagatagcctgttggcacaggggtgaagatgacagaggcgaacccaagcaaagagagttaattagcagagtttgccctccaggctcggagggcaagtcagcctggggacctggagttagttcccttttcagctgtgaccattgaagacattcatcaagttctctggctccgggatgtcagctgtggtagtgacttgcatgggaggttatccgacatacctcacacactttaactccacctcttcagagtttgtggccaagaatggagccaggtggctattttttttttttaaatttatgtaataacaaacattcgcatttattgaaaacttaaagtataataaaaaaataaataaaataaaaaaagaaaaaagaaaacttattcctgtgtcaggcacttttctaagtgctttgcagtgtattgtctcatttaatagttgtttaaattaacagagtaggccgggtgtggtggctcacatctgtaatcccagtactttgggaggctgaggcgggtggatcacctgaggttgagagttcaagaccagcctgacaaacatggagaaacctcatctctactaaaaatacaaaattagccacagtggtggcgcatgcctgtaatcccagctactcaggaggctgaggcaggagaatcgcttgaacccgggaggtggaggttgtggagagccaagattgcatcattgcactccagcttgggcaaaaagaatgaaactctgtctcaaaaaaaaaaaaaaaaaaaaaaaaaagagagagagagtaaataaaattgtaaggtgaatatgttatctacttgatggaattttttaaactaccttgaaaagttttatagtttcctatttacagatgaaattaacatactaattataaatcatgcctcactattcactttaggcagtctatctccttaaggatctccttacggtttagatagataagtgaattgcttaatgtttttggaagtaataaaactgcatttctttttaattaaacaatccagataacaagaagtaattctaataggaaacttgtaggatgtatttacagaaaatctacacaatcttactgaacaatgtagaaaagaagatttaccagcctgggcaacatggcaagctttgtctcttaaaaaacaaaacaaaacaaaatttagccgggagtcgtggcatacaattgtcatgtccacttctcaggaggctgaggtgggaggactacttgagcccaggaggtcaagactacagtgagccacatttgtgccgctgtactccagcctggatgacagagcgagaccctgtttcaaaataaagaaaaagagatttaaatgaagcgaaatgccattttctctaggtgagaaactggaatattatcaatgtcacttcttcccaaattgatttataatttaaaaacaattttagtacttctgcagcttgtttggagcttgataaaatgattgtagagtttgtcttgaagctttaatagtgaggcaggtttaaaattgggggcaaaaaagaaatgggttttagggtgtagaagggacttgcctgatcacttttgctagaaataaatgtccctccaaattaaattactaatgtcgcacatcagatcgtatttaaatccattagaagattttactgttccattagagctacccatagctggtgaagactctgcttatagtggaacctagtttctcagttttccatttatatttatttacctgagctttttgtaaagtagtaagtacttgactgaatttctgctatttatcaaatgctttttgaatagaaataatgagttaataacatttagccttttttggtaaatagtataaacaagatagggcaaatatgtaaactacttagaactttatctaccttgcatattttgtacctcttatttgcatatgcatgtcacatgctccttatgtaccatgtgctattactgtgccggggtactggggctatattgagtctatttcctgtctttgtagacttgatggataatttggacagcattgtgatattccaggtttaagagtcttaaggttcaagactacattaaatgttaatgtagtccaacatttcttgaactctgaaatcctctgagcatcttttcatgcactggcctaaaatgttttcatagcccagcaaaaggctgattacttatttccctcctattgattttttttgagatggggtcttgctgtgttgccctgtctgcttgtgaactcctgactccggtgatcctcctgccttggtctcctgtttatgttttaaatagcatttctcaaacctatttgagcaaataactttcctgttaatatgtagtattccttgaaagaattgaatttgtgagtccctaatctagacacttttaaagaagaaacaaaactcagtaacacatttggataaaaacctgaatatgtccattttgggatgaaaggaagcagctttgtttaccatgttgaattaagtggaaaacatcttattttaatcatgattgatagaaatctaaatttgtaaattctgatttttatgttttttttacaatgaaaatacattttaaatgtcaccatccccttccccatgaagtcttcattacaactaattttgaaaatactctctcatttatttatattatatatgcatatgttctactgtataattttaaatacttaaatggggttatctttttgcattgttctgtatcttttttcagcttaataatttaccttgcttataattattgtcagtgcttgcggacctgctctttatgcatttttaaccattgcataaagctggaatgatggacatgatttctttaatcactccaaattagtcatttagttgtttccagttttttagtattacaaataactctgcaataaacgtgtcttgggtatgcattcttttagtttaaaatagtcttgttccttcagaaagttgctcaataatagacttagaaattcttttgtgctaattactgtaattgctcattttaagatctccttttattgttttcatagtatataatcctaaactgttacaactgaaatagtccttgagctaagaaagcaatgtggcttaaagataggatttctaaatagagacttaaaaattaacctttttggagctgtgacttcctgatgaagtggcagcacacaggctgaatatgttctacatctggatggcccaacatcatgatgctgtgatttgcgagaagctctctgcctgcctaggctgctggaggatggcaagttaatttatttgttgttgggagacctccccctgcccccattaaaaaaattattttgaaatacttgtagattcacatgcagtttcaagaaataataaagagtaattccatgcaccattttcctccaatagtaacattttgtgaaactagtacagtatcacagctaggatattgacgttaatatagtaaggatatatgtcatcaccacaaaggtacacctacttcccttctatctctcctctctccttcatgcctggttacaaactaacctgttctctctatataaaattttatcatttaataatgttctgtaaatagactcatagtatgtaaccttttggaactgaagtttttccatcagcataattccttatagattcattcaggttgctgtgtttatcaatagtttgtttctttttattgctgaatggtattctgtggtgtaaatgtactacattccatgagcatggcatgtccctccatttatttagtttttctttgatttacttcattagcattttgtagtttttgtagtcctgtgtatgttttggtagagttacaccctaagtatttaatttctttgctcattgccagtatatagagatacaacttattgaactcactttttagtttatgctagtttattactaattatcaatacatgctcaagatatgtcaactccttttatttttattaggtgtcacttgctacattttgtggagaataccgatgctgttgctagaaagtgctgctgtcacaaagtgggtttatagatagtaccacgctatccttcttcctaggctagattagaagttatttatgtgctatatgcacatagagtttttgattggtctattgcaaatactatggcatctgaaattttttttttttttttttttttttttttttttttgagatggagtctccctttgttgcccaggctagagtgcaatggcgcagtctcagctcactgcagcctctggcttccgggttcaagcgattctcctgcctcagcctcccaagtagctgggattgcaggcacccgcaaccacacccgggtaatttttgtatttttagtggagacagagtttcaccgtgttgaccaggctggtttcaaagtgctgggattacaggcgtgagccaccgtgcccggcccctgaatcctatttttaagtataaaaagtcttttttcagctctggattatggtgctgcaagctgatattcttctcatggcagtaaacagagaagtcctaggggtaatcttacccctctggggagtccaggatatctgagcatctcccttttctttttactgctagaaagaatttctgctagtagaatttttattttggccaactctgaccccttaggttgatgtcagaatgaggtgtaccaacctaggtggtcagagttggccaaaatacacattttcctgctgagcaatttagtctaggttaagtcatacttgaccatatgccctagtttagcgtccagtttgtgaacattctttacctgagttattgtaattctaatctcttatgtaaaactgcaggtagtcagccctttgtctccttcagttctacatctgcggattccttcaactacagattaagaatatttggggggaaaaacagtaaaaaaaaattacaatacaacaataaagacaacaaatttaaaaactagtataacaactttttatacagcatttgtattgggtattgtaagctagagatggctgaaagtctatgagacgatgtgcatacgttatatgcaagcgctgccattttattgcagagacttgagcatccaaggattttgtatccgtgggagtcctggaaccaatcccccttggatactgagggatgactgtatttacaacatgtctagattttcgacaacttgaattaaaccagaaagaatatgaacacacagaagttcatgtgtatatatatatgtgtatgtgtttagaagggagcaagctgttaaacatgggaaatagttgctagtagtttgtaattttatgattacaattttaaaattcaattttgcaactggaatttgacttgattggttagtgccttacagtaattaacctccaaatcatcagaatgtcatcttgttatttaggtaattgaatctacttttcttgtatacagaatgctttttggaaacaatacactgtatatctagtttgtaccaagaactaattgtacacagtcagatacttgcagttcttttggacttgagtttctttatccttctatcagatgtcacaattccctcttccctttgtagcatatgaaagtagttgtgtgtgcactgtatttgagaatgtcaagtaatagaatctctagaaaacattcatgatttcagtcccaggtaatccagagttaaaaataatgttcataaggaagggtagcaaaatttagattttaatacttataggaggtgtgttaattggccccagggccgcaggctttagcgttcagaggactttagccccaaaggttttgtggaacttttccagagtcctcaccagtacattgggaataaatggaatgcctttggaagtactttgaagattgaattcgatagtgttggtaaagcagtctagcctgctgtgattgtgctattgatgcaaatattctctagcctgtattatttttccttggagctcaggaagtgatccccacccacctcaagcagtaaaggaaagagaggcaggagggtctgaccatgtgaggtgccccaataaagcatctgtattgtaaatcaggaatgtaggtattgggtttccttaaaacaaagcacacctacgtgaccactagctggagcacaatgtgggctcggtctgctgaaagagtcagttggttgcggctgtctaatccaattatggatggtcccagcgctcagcctttcagctgctgcccctcccctgcagactctgcctctctcaccctcccttttagggcttggtctgtggctaccccagaaatcacgtgcactcctaggcttcagcgagtacagccttgttaatctcagacatggaaagcaagttgcctaggtctacagatgagtattcagtttccccaccagttgacctcagtgcaggttttgttggttccagtcatttggggtcagcacctgtttgaagccaggacacttagaacaaggtggaggaaaacctgagggtacatacagtgtggtttccttggctcatctaatgcagagtcagaatgattagccacattgcaaattgtctttactcagtggtttaattgttaaccagggagttaattttttttttttattaaacaaagaagaaaacacctctagatttttctgggacagatggccccattgaaagaggccatgtgctgcagcgaatggccaggcctcgggtgtggcaagtgccttccagctcagtgcttgctttgtgctcctttgcctatttgaagacgtggatgaatcaaaatctataagcctatttcagtcaagtattctaaggaacctggaaacacaggggatttctctgttgcctctaatacagtgaaaaaccactgtctttttttgttgttgttgttgcattgggggaagaaagtccaggtttgcatgtacattttcactcataggatttttttttagaatagtttggggaggacattgtgctctggccaataactgggccagtgtctggtcacaagatgatcaggcaggtgcctgcatgactgtaggacagagaactgggcagctagagagcctgtgtggaacgtgaagcctttccccactttgttgccgtcctaaccttttctcaagtcatggagaattgatccttagacattccttacctctctcacccacttgaggattgctcagagcctgggtttcggattgaaatagcactatttctggttggtgacgacattctgtgagccagcaatgtagtttaaatatccacaagagcgccctggttccatcagcgccccttcgtaattggtcatgagacttggacctccttcggggctgggactcgggcaagggagttgagtagagcttctctttctgggctcctgggaaggattcatggcataaaagtgggacttcagcattctctgggcacacctgtctctgtttttgtcctctcctgaatctttctggcctgcagagcagaataaagtcactctgtgccaacctgacttttgttcatgactatattaggggcatggatagaaagtgcccccatagcactctcagataaaacaccttcaaacaaacccagaaacccatgctcacaaaaccacccaccttaaattatgaaactttcaggctgactaaatcctgaaggcgttggagcgtgagcaaagggaaaatggtgacacagagctttgcccttcctaatccaaatgaaaagctctgtaaccctccccccacctttgctatcaagaaatgttggacctttgggaagcagatgtagagtattgatccttaaaacagagacctctcaccctaggtctcttaaaacagagaccttaaaacagagtattgatccttaaaacagagacctctcaccctaggtctcttaaaacagagacctctcaccactttctaactgaagtgggttccacattggaagtactttgcagaaacttctattaccgcaattacttttgcaccaacaaatagtatcctcaactcagaaggaaagaattggaacactcagctggaggtgtctggtagggacatgtgtctgctttttgaatcagtcgtatatgtttttgttcctgtgcctggaggccctttgtggtgtgagaacattgaatttggagagggaaagggagacaaaagagaaatgggggtgatgcttaagggaaagtagggtttttagtttgttcaccacgcttgatggcagatttgcctctggatcctcaggccacgttcctatggtgggtagggatctctctctctctctctctctctctctctgtgtgtgtgtgtgtgtgtgtgtgtgtgtgtaaatagtgatttctctaagttaataaagaatgtggggtgacctcctacacatgcccgtatgctattgtgtaggaacaaatgcatggtaggaatgggtagactctaatctgaaagcatcaagttgtatgcatcttctgcaattaggaatctgctcaccagcacgagtgctgtggtttctgtagttctgggattcagaggagcattttaaagatgtaggatgttagaggaggaggtgcagggatctccccttgggtaaagagtgggagacagtctctgagtcataatctgggaccagtggaaggtcaaagggaagaactgtcctgttgtctgctaagtcacaggcttccttcctgttctctgagccctgtcacttacccaaggtgcagcaacaattagtgtctgtttacacataacagacatctctttcataaaataatttttaaggcatttgtttggtagaagcttccctgtttgggggagtcttttccctgaatgcatgtaaataacttcacagtttgcgcaagtttgcaaacggtctatactgctcagccttgattgggctacccaaggatgcgcccgccctgctgaggtctgacagctctgggaggccagtgaggcctgtcctaatccctgttctggccggtgattcagctccaggtggaggctgtgcagaaacagccccggtcatctttgtgtgaaatacatttgtcgtcttcattttcttttttcttctgctggtatcttcatggttttcagcaaaactgtgtacattacatttttttctttaccatttctccgtagttatttctagcatttttttttcagctgatgaaagcaaatgaagaatttttatgctccatagtcagtcaaacattgatttctctgacttttaacttagaaagtcattttgcagtggcttgcgtgtgtgtatttagactgtgcttctacaaaaaagcacacgtaggcttatggctcagtttacttgttccagctcactttcctgttcatttaccttcttgtaaaatggaaagacaaacataccttaaacttaactcagatcgtgattgccaactttgttctctgtgtgtaagtagttatattattcctaggttatggcatcttgatttatctttgaaagaagaaaaccctcactgagttgacagggacacattgttctaggcttctacaattgtgctgatgacgctttttcccattggaatgacagggatgataaggtcggctggctagcctttttttaaaatgtagaaaaccacaactttaatttatagcatcatcattttccttatgtatgtagtatgtttcaaaaataatccaatgtcagattcttgcttctgtgatcaaggtcttgtttttgccctttctttgctcaccacctccctgcccctgacgccgagtcctcgccttagaggaggtggtcagcttatattgcaacattgaaaatgttataccttacaaagaaggtgatatgccatttcttaattataatgatgtgcaacagtgacttctgatgtagacctttaacattgggccacgcagctttttctttggaggaggggcatttcaaattggatgatgctcttatagtttaataaagaaacaagcaaacaaaataggctatacagggcatgtgttcttaaactctgtgacagtggaggtgaacccagggccctttcatggccttgggagggtcctcagctttgggggcgagttatctgggtggaaaagcaccatgggaggaagaagtcagagaggcgggttgctggagctcagagaataaaagcaagtctctgccctgaaaatggccctgatttgcttcagatgtactctgtctgccaacatttagtgtctgtgacttagccaaaggaaatgtacattaactgttcagtttctatgtagtttgtgctctaggattttgcctccggaggatttctgtgaaggaagctctgttcaagtggctctgttccacttgggtttggaaagaggccgggacaggtgatttcgaaggaaggatgaggacaatggaggagatgggcttggtcattgcagtgtgtgaggtggcccagcttatctggcattttggggtactatatgtgccatatgaggtgggtatgggtgtttgaagggaaagggggtggcctgggcaacttgtgtccttgcctagaaagatcatcactctttttatttaaaagaaacatgtgaaagagccatcagggatagttttgtcctccctcttcttacaagtgatcattcccttggtagggcagtgccagaccctgcttgtgagcacagaaaacgccataagctcctcatgaaagcatgtctggggaagcttatctcaaatgcagtttgcacttgcaaaggtcctgtggtatagcgggggagcaggggagatggagtctgggagcggtgaaggctgggtcactagctggctttgtagcctctgggcgtgttgtttttatcctcagaggggccactgcacctgctccatggtctcttcccacagcagacccttctgtctctgtgcctcgaggggctatgtggaaagcagagaaagactcaaccagagtcttcccttaaggaaatcggaaggaaaacaaaattaacggcattagaactgagtatgtattaaaacttctactgtcttacaaaatttagttttctttcttatttttctttccatgttgactcagtaggtaaatggactaaacacacattcatttagggcaggaagaacttcatcatttgattacctttagttcatttaccttataatgcctaaaacaaagcagaaagtgacgttggttaatcaaaaagatcactttcttttttgtgttcttttgtgctattgtgagatgcctcttctccagcaagctgtagttgttcacaaagtaaagctgttcctaagccttcattagattgaagcttgtcccagactttctttaaagaagtttgcatagcttagttcatgctcagatgattcagtgatgatgatgggttgttggttagaaattacttaaaaatgcctaatacattattgactgataaatgttaagacatattctttaagggtctaaatcctattcttgtggagctgcaaagatcttgggggtgtggttgcccttgtctgttgcatcatctttcaaatgcaacagctgtaatgatattctgtatcttgaaaaacttaaaaaagcaacaactaacttatttgtatcttttcctctaatatttagtttttacttcacttgtaacttattacatgtattaaggagtttatttttatatgacattttactcataaaaggatgaaaccaagattggtgatctgttcacatagattaaaatcctgtttgtgaccacttaggtgtgtaatgtgtgacttgtggactgtgtcagaggaagattttccaaccaaaagtacccattggtatcacagatgaaaagtccttataccatctgaaaaaaagtagaaggtggggagaagcttgaaaacctaaggaggccattaggaaaggctgtatattttctgattccgtttaaaattttaagttggtgaaaatactatgtgatcgaaggatgaacatattttagtaaatagagttatagtgctacaatgagataaatttcacaggtaaatgtgacgtagctaatgcataatcattctttgtgttgcatggcaattctgtacaaatggaaggtagcatgtttaacgttcctgttatttcacataaatacagactgagagtttcagtggtctggtttgaaagggaagaaatagaagaaggaaggagagaagttggcagaggagcaatctgctctaatatcctccagtacacaatctagctataggtcctcacctggcagggtttgaggatcagaatggtggctcaggtttagacaattctccctgtttgtggggcccagcagctagttaagagaaaaatcttttttccttccctattaccctataaggtccccaaattcattgtatgtagaatacttgagtcagaataactttcctaacacttaggtttcaggtttgttaggtatgcctgacagctctcttatcaactcccatttatttgctaatctaaatgaaagtttgatggtagagtattgtaaatgtagggaaggtgaagtgttcaccttcagatggtagctatttatctcagcaagaagagcagatgactaacacccaaatacataaccattattatataacttagcatttataaggcatttctatgcatcctgagagactagagcactctcaaatgaggtttcagagtaagattaatctttgcaaatgaagacaaattagcaaaatcttcctatttttaaagtgtgccttttgatttgatacctatttatttgtttggaaagaagcttttaaaatcaaaaccatgaatctgtggttatcttcaaaggataaattatggtaggtggttgttacccaggttaccattttaagatgattatggctggcccaaattaggggatcttttcatatatgtattatatattttaacttcagtcttttaaaaatgaatattcctaggtggcatgggagggtgggaaggtcaaaagcccaaacttctcttacttattggctgcttccttgaacttagcgtttttcttttggaaaagtgagcttttgtttttggatattttgtactgatactctgtgcctacacagattttgttttggttcaataagagttgatattttgccaggggttgcctcccatgagattccaaatacagatgtaagtttaacaggcttctgaactggatgtttctatgcgctgaaactctgtaaacgcgtgtagctttgtctaccattgtatattgctgtattgatttgttgggttgttttttttcttcctcctgaaaagctctggtctgtcctctgctgatacaaagactggtccattccccagggtcactgcaagagaacctccagggcctggccactgttagatattactaatctgtgaagttgctccaaattctcttgccccgatcataaagttccattgagttcaattttatgtgaaggttctttgtcaaaaggaataaatgtttattcaacagatccagttgttgtcagcattgacagatgtgaaaattagcaaatagcaagaagtctcccctttagaaaaggaaaacaagtacttaaaaaaaatcttgtgttgtcaataaacaagtccattttaaaagcatctttgaaggtgtgtaatgaaaatggaggccttaggttgtatcagggtttatgaggagccagcttatatgtaatcagatgttcctgttactgttatcactgtagtatagggcttagttctgccctttaagtcacagactcaagttactcctgattttaccagcagtcagaatacatttttctttaaaaggaaaagagacgatatcccagtgcttctctatactaaaacaggaagagaagcttccttgttgaagtgacagtttagatgttgttattttgacagaaatattagtaaatatgtcacattatcccttgctaaatatttatagcatagaacgtatactctgatgcataatattttatgaaagaaatatcttttgcctcaaatccctttcactgttttgacatgaatctataatttatacccagaggtctgcaggaaaaagactttattaagacccttttatttcagccaagataaaactccatcctaagagggaacaccctggaatctttgagacccttaaaggtggggtattctgaaatacctgtgttcgttcctttgctagaatttagatagcttcacttttgcaaaaaggcacaaaatgagggcaatttttgatggaaaattttagtttttgagatgaagcagggggcacagtggcgaagcgccctatcttagcacttaggtagcagccgtaacaagtgtcctgggtattcctccctagaaaggaaatgttggtcacaaatggcagtgtcctctgcattcagttcagctatgtgactgaaagacactgttcttcagcagctgtgagtttacaagatgtcgcacattgagtatttttctctagcttatttagaaacgccagtctagacttccgcagttttggattcgtggccatagttttggcctttattagatggccctcaaaggtacttttcaggtggacattgatttcatgccagctgtcagagatgattttccctagaaatggctgggtatatggagacattctgtattagaatggaggtatacacccatctcttctgtattagagagcaggtgttgccccccgtggtgctcagattgcttagtgtgagaaggaaaagaccagtgataagaggaggaaaactgcgccttccatgtagctcagttaacagcatcatgattctccaggatggccccatttctgtttttatttacaaaatggacttgagaattaattagtaagcaaactgtctccattaggtaagtggcattctgatttgtctgtgtaaagttccatttcccaagtaatgtgttccaaagcatttttatgtacaactactggaaactgctgtacaaatgtttgctgctatttggttgtaacaaaatcagtaatgagtttcaaaatggaataatttcagagcccttcatctacagtagtttgggaaacacttgaaataccaagtgatctgaattcactacaagctctccaactggaaaatgtgcctggtgtcgtcttcaagcaagaatcccccgccccttaaccactgctgctgtggacttgagtcttcaaccttgttttgtagactttagcatttgtattgtgtcatccttgacacctccccaaccccagccttcccagctttgattgcttaccttagcaatgctctcagcttggaccagaaggcacggatgtttccctgaccttaacctcactgtgtatcagctcaaggaagaagccagatttgctgatgttgtaagcactaaattatgttcataacatttaaccctcacatccataagcaaactaagtgggaaaatattgactattgtagcagtcatagattgtttaggaagcagcaaaaaggcaaatttttctttaaagttcaaaatggggcgaaagagggtaggaaaggaaaagtttattaagaaaattgtatactacattaatttgactttgccgtctagacttaaattaaattcatgtatttttttggtcttaacacattgacatgtatcagtaagttaaaaacttaaaaatacacaaatgattagattagcattattatgtgtttctttcttgttttttgttttgttttgttttgttttgttttgagatggagtctcactctgttgcccaggctggagtgcagtggcatgatctcggctcactgcaagctccgcctcctgggttcatgccattctcctgcctcagcctcccgagcagctgggactgcaggcacccgcaaccacccctggttaattttttttgtatttttagtagagacagggtttcactgtgttagccaggatggtcttgatctcctgacctcgtgatccacctgtctcggcctcccaacgtgctgggattacagtcatgagccactgcgcctattatgtgtttcttatagaaaatctctctaattttttaataagcatgtttttacaaatgctgtttcctgagaactgtcgcaccacatgcgacatgccatgcatgcgactggaacatgccagatatttgtgggtggtcccttcgtgtcacctgtgccttcttaccaagtaatttgaaacacccgtgtaaactacctttggcaaataggatagctaaatcaccgctaagatttataatttactttttggatatctgaaacatcaacaatacagccatccatggcgtgttcctctggagtgtggtccgtgccgtctctgcctgctccatctggctgatcccaggcaggcagctcagctctcagcagacacagatccccagcacatatgaacgtgaaagaggcttctccgtgggagcgaagtggccagcaggtgtcacaggctgtgtgggcccagcatcgtgtgggcactgtgctgggggaatcccatcacagcatgtgctggcgttagtagtagactgtgtgtgtctcagagggtccagaaagtaatacagtaaaggcgcctgggggtgtgtgggggtggttggttggggtttgcttgttagtttgttgtaaaagcccagcttttcattcttggaaagatttcagccaactcgagagggttacctgccaggaatgctgcagaagcaagaactcagtgggtgagcacttccatttcttcaacaaatgcttctgagtccctgacctgtgccaggtgctcttcttgagctgagaatcctgcagggagaaaagagataaagaccccatagtcctgtggtttaccttctaatgagcatacttttgtcgatcaaacagggtgacctctctggtgtctctgcacactacctgtatggtctttgcgtagctgatggggtctcctgactagtgattggtgattttaatctggattttgccacagcacttattttctaacatatgacttaatttacttaataattgtgtctattgaatgtattcttatacatacacacaggcatgcacacacggacacgaatataagctttacaaggacagaaaccttatcttttatttatttcttccttgtgtatcctgagcactgagaacagcctggcacaaagcagggctcaggaaatgtttgctgaatgcatgttcacactggatgtgttcgaaggctctcactcgcgactcctgttggcttgtggagagtgcatctagctgtaaaagccatggtgcttggatgtcttggggtgctgagcctgttcccccctcatttgggggtgtggtgctatgctggcgtttgggtccatgccccgcatttctgatggctgccccatctgccctgtgtggggtggcagagttctgtgtacacagagttacatttcgttgttcctggcttctctatggatgacagcagcactgataaatgccacacctgctttctcagcagtcttgcggggtgatttttcctcttaaggaagtcacctgatgtccatgctgagtaggaaatgcatccaaagctttgggagctcagtgttggcccctgggctgcagcccgagccccgttttagagctgtgtctcccaggcagctgtgatgactgctcgaaagcccactcagggggaaggtaaacctgatgcccgggtgtttggacagtgagcatggcgagtggaccgttacctgtgcatagagttgttcatatgtggtgacagatgttgggctgttatttagtaacttcaaattgtttttctttgcgtcggagccatgtctaggttctgagtgcttctcccaggtcagatggagagctcttcatttggggttgggggagcggggtggtgttttcaggtgcccaaggcattccatgcacatgcacctgcagggtatgtgtcatctggggtaagacagagccctcccggttcctcttctggatgtgtgcttttagtttttaaagaatgtcagtatatacattgccatttattcaacaaatacggactgagcattctgttgtgctgacgtagctacttggggttacagagacaaagccaactccattctccaaatggaaaacaaatggaaacattctagtggtagaaacagacaacaaacaagtagacagaaaataatgtcagacagtggtaagtgctatgaaaaaaatacagactcactgattgtgatggagacttttaagttggattctcatagaaggcctttctgaagaggggacatttgccctgccactgtgaatcagccatgagaagacgtggagaggaacatgaggtggtaggccccagcgagggaaagatctccatgatggcatcgattattcgctccacaaatattattgagcacctgctgtgtgccaggcactgttcctggtgtcagggttatagaagtggacaaaatgaggcctctgcctctgtggagcttttattaaagtagggaaggggatgggagggctgggtcacatgttaggtgtggggtacagggtacgtggtgccaggcaggtatccgggtacctttttacgtagggtattcagagaaggtctctagagaggtgacatttggacgaagacctaaaggaaagggaagggaaaggcgaggagcttggagagcttggtgcatcttggtgggggatggggtaaactgagtcagttatgtagggccctggaggccacggtgaggacttcggctttgactctgaaaggagatggcagagtttggagctggtgtgtacgttaacaggaccatgctggcagctgcgttaagagagactgtaagggcaaggacagaagtagagagaccagtaggagtaggctgttgccccagtgtagggcagagaagatgaaccttagaccaggatggtggagatggtcagtggagagaagtagtcagagtctggaagcaccagcaagactgtctggtgcacacaggatgcacgtgggatgtccagtgaggaggatgagatgaggttgggtggctggagcctggtgagtgacaggcagagagggctattagatcacatgggccctggagccatggtgaagaatttggattttgttctctgtgttggaaagttagcagagagcttatatggggggtgagatggcatagggacaatgttaataacagcaacgaatatttattgagcacttactgtgtaccagctgttgcaacagcctctcaagggttcgttctgctattagagccatgttataaatgaagaaactgaggcacagagaggttagctaacttgtccaagatcacacagttagggacaaacttgacagaattatgtgtgtcctggtatgtatttcagttttctttagggaaggtaccacaactttgggtaactatgcccctaccccaggatttaagatgttttgatggttgaagggcgatgtttaagagtgggaccagagaatattgaggtattaaaatctcactaaatctgtattcattatatctgtattcatggtataattcatgtgcctccccctttcgtgagcccctcaaacatgatcatggatatgttttctccacccgtaaagtacgttcatattcatagaaaacccacagagaactgcagacctgaaggtttctttgtaagagctttcattggatagctagaagggctgcagtaagtttaaaaaaaaaaaaacccaaaccaccctggattccaggctgcacagcctctaggaggtgtgggtaatccctttataaagcttggcataatttctgttaagacttgcttattttgctctcagcttgctatcttgatatgtttgcctttgaggaggttagagttattgtgatttaatcacagaccatgtatttcgcaagattcatttggtatctccagcttgttttcttgtttcctcggctgtcagtccacaggcagaggtgggaggcggccggcatgggggaccgagtgtggtagaaaggagtgtttacttagcggaggggagtgctgagggctgctgttaccttcccagaatggctgatccccagcagtgatgagcaggctgggatcgtggtgttaaatttggtattttctagaaatatatagcaggctttcccctccacctgccccccttcaaggtttcgaagccttgtgttttgcaagagttgagaggggaacagttaatagcttggattatcttgtctctggagagaatttatgtatcaattcaccggaagactgctctggtattagggcaacaagaatggttttatttctcccttcctttcctgcactctgttcttatgtaattcttgtattaaaaccattcctggtaaattagaacatgctcttgtatttgggccctgctttgaagaaggctgctgagtctaaaaagtttggtagcctctcgtttctcatggtgatttctgagatttctagggacttggtgttttacagagcttgttgagttgcacaaaccagcctccttggcccttctaggtgataaaagatgctgggctgggagggcagctgtggaaaagggtgtgggcgagggagacagtgcttcatcctgcctggatgaagcatgttggttgttggtttattcataaattagaaaaatatattaagaattgaagttgttccttatctcataagatttctagcaggctgcataaagtctgtagatggtaatatccatttaaaagtggacaatgaaaaaattacctctttgggagttgtgttgctatctctaccccaatttggcaatctttaattaacttggcaacccccgttttaccaacaaagaacaacctttgattaaaaaaaaataaaatgtcagggagtgaaagatacggagtgtgactcagcagatgggaattcctttaataacacgctgggtgttagcgttagaaccgccactgaacagctctgcaggatgccctcccagccctccctccacctatttggattagaccaggagactgcagcaaacttctcaaggggaggcgaacttggtgttggtatctgagcgattgtctgtttcaattgtttccctctgtcttggaaaacaccggcacaaaacacaaatccagtcccagttcctgcagctgctggggcgaagcaggctttttatgaatgaggcccagaagggggaggagagggcttgtgttacagcagcagttgggtaatacatttcattcacttgcagccatctagcccaggcttcattttaaaggatattgttcatttttggcaattcagattagactttttttcttccttgtgcaactgttggtaagttagaacacgaagcatgtgtgtgcattctttttgcttgcttttttgagtgtttgctcctttagttgggataaatggtaggagaggtaggaaggctttgtcatccccggggaccttgcttacttctccctcccagcaccacttaagagaagaggaggtggcctccctctccccaacctcagagccctcaaagcccttgatagtgagcctgagcacttgttaggaggtgacttctacctggggtgtgctggggtccacatgtgccagtctctctgccctgctccccgtgagcggctctttatttgtggcccttgaggccccattgttgtggccaccaaaacctgaattggaagctgtgtgacaatgctggtccccctccctgcactgcttcctgctgggggcagaacaaagagagcgggcattgtctctggcataaatgaacctctatcaaaacaaacacccagagagaggggcagcctggttacagctgcctgtgtgagcctcgacagtgggcctcattcctcacaaagggagctttgaggcccggaagaggcctttccttgatgatcgagctgtgcacagggagcaaaccccaagccgactgcttgtctgtgccaccctcaaacaatgatttccccaaattggacagcctgggtttgtatccttgagcacggttttgggaagagcattctgcatgaggcattgtagctatgtgtatggagtataattctgttttcaggttgctctgccacagaggttaagaactccctcttccaaggtagacattgagaacagagacgaccacactgggttttcactgcagcttttaaacaggatgactcccagcccccatccccgtggctagcagcaagcagggactctgaaacactgcaagccaatggactgagcatcttacttttgctgtccgtgttttggtgttttgtaaacccatctggtaatgaccctgatgccccatgtcccagcaagggcataggtacctgccattgtgcaccaaagtccctttcctcatggccctggctgttctcctgcatggggtcatgtgtgtcccgttaccaagttgtggccccttttcaaccttgagtgccacatctgggctgttgtaggcatgggtagtacaagctgggtttgttactctaaaaatgaaagggaggatcagttgttaataccttcctgtaggtgcgagagggaatgagttgaggattcgatcactgtttatagccagtctcggatcctgattgtgaagtcattctttctggataataactactatatccagcatcttgagagtataaaataaaggcacatgttgtacgtcatctctgagatgtagcgatggcttggactttggaggctgatgagagaaaactcatggtggtgagctggagcagggtgtggctggcggattctgaaggtgctagccctagttttacagctgaccagggaaggtcattgaaccctacagtcttggccctgagagaaccttggaggacttaaggatggagaaaggtgacaaaagagatgcaagccaacagcaattttgtggaacaaagtgtgtacaggatttgaacttaactctgcgaaagacaggggttgcttgtatgcacgaattcacatctgaagaatgcatctgattgtggctgcaatttctgtggacgtgcaaacatctacctgtgcattttatttgtctagcatcattgaaagagttttttgcttgagttgatttcccaggtaattgaagcttacttctcaaagcacaagatattttttctcatatattagcggtcttaagtgagtgagacccctaagaattcttaattcctttatcttacttttcctacaggaaacttattatgttttcctagataggaattgtgctaccaaaaatgaaaagtaaacgtaatatgtaatgttctactggtaattgtttccattttaggttgacaccgaactaatgatatttaaattgtagctgacttgaaacacagtgaaaaaatggtttcctgctgtttttttaaagctggattcagtaacatgaaggtaattaaaaatgtacagatctcagtaatagacagtcatatgttgcttaatgacagggatatgttctgagaaatgcattgttaggtaattggattttatcattatgccagcatcatacagcgtactttcacaaacttagttgatacagcctactacacacctagggtccatggtatagcctgttgctcgtaggctgcaaacccgtggagcatgttgctgttctgaacgctgtaggcaatggtaacacagtggtaagtatttctgaatctaagcatagataaggtgcagtaaaaaatatagtgtaaaagataaaaaaatggtacacctgtatagggcacttactaggagtcaggcttgcaggaccagaagttgctctgggtgagtcagtgagtcagtggtgagtaattgtgaaggcctggataaatactgtacacttaggctacacttagtgaatattacattttatttatttatttatttatttatgagatagggtcttgctctgtcccccaggctggagtgcagtggtgcaatcacagctcactgcagcctcgaccgccaaggctcaagcgatcctcttacctcagcctcctgagtagccgggactagacgcacacaccaccatggctgactaatttttgtgtttgtagtagggatgaggtttcaccatgttgcccaggctgatctcaaactcctgaccttaagtgatccacccgcctcggcctcccaaagcactgggattacaggcatgagccacggcgcctggccacagttaacttttttaataagtagaaggtgtacactcttaaataactataaaaagtatagtaaatacataaaccaataacatagtcacttattatcattatcacatattatgtactgtgcactgttgtacgtgctgtacttttatacagctggcagcacgggtttgtttgcaccagcatccccacaaacatatgaggaacatgtacatcttaccacggttgcaatgtcactaggcaataggaattttctagctatattctatccttacaggaccactatcgtatatgcacttcatctttgaaacgctgttagctgcctcatgactgtatttctattcctcagtcatgggctcaccatgcagtacacatgtgtggtcactggagggaatggaagaacactgaggaaatgcatagcctgtttcatatatttattacactattatttatttagaggaatgttaagaaatcttgcttttatgtagttttagaatgccatgaaatatctagttggggcattatctgccattttgcaaggtaatcttccacttctgaataacgttacaagtaacccgcgtttggaggactgatttgggactaaggcaaggaatttaggaggcacaagtagaggggaagaaataaacacatgacttttgtttttgtttttgtttttgttttttgaaagaaggacagtggtttgcttgttgattctgctttgagaggatggggatgcactccagagaaagtgaaacggggctatgggaggaagagagcagcgcacacacagcacctgcatttgattgtgaatgcgattgtgactccttaggcaggaaggagagtgctaagaccgtcatcatggacactcagaaaatacctgctaatccgtttactggaagatacagggagctgcagataattattgttttttaagatggagtttcgctggagtgcaattgtgcaatctcggctcactgcaacctccacatccccagttcaagcaattctgcctcagcctcccgagtagctggaactgcaggcgtgcaccaccacgcctggctaattttttgaatttttagtagagacagggtttcaccatgttggccaggctggtcttgaactcctgacctcaggtgatcctcctgccttggcctcccaaagtgctgggattacaggcatgagccgccactcccggccgctgcagagaatttttaaaataaatgatagattctcacagataagaagtacaggataattatttgccaaagtttgaaactgccattatattcaaaggcattctcttttgggagtggttttatatttaaggtttgaatttagatgacctcaatcttgaggtgttatcggagcattacaggggagtcttatatacatgcaggtgcgatttaatttgaagatacttccatttaaactttatgctgccagagttggccagctaagcaaaaagaattctgataggtcttattctcctccccatcccacacgctgattttttttttctttgtgtttggccgaaacattttacatttctcatttttcacagagctactgtttctctaggattgttttccctgaagtgtgtaccctgtgtttgggcagagcagcaagaccagacttccaaatggcatgctgcgttttaatgtgctttcataattgtctgttccaaaagggtgcctgtgtgtgtatggtgtgtgtgtgtgtgtgtgattcagagcacctgagagcacactgcccgttgtcccctccagcccttctgaaatgcaggccaccctttctgtttcagttgccccttgggtggcagtctgtgataactcaaggtcaggaggaagtatttgttttggttgtcttgtttaactaattaaatctttaatcttggtccttaaaagaaactaaaataaaatcgtaaagtagttctgataagtccttgccataaattattgcttttgtaaacgcacataaaggactctgaactgttgctactcataacatttctgacgccaaatgtgtggggttttgccataccaacaaccagttgtctaactctccagacaccaactgggggccttacaattcagtgcagttctgacactcaccacctggagttagcacagactccacagggatgagggttcagtcccacgagtctgcccttgctgcagatgcgagtagcaggtatggggtgcccacacttctgtctgacttgcctgaaaggttgagagtttgttgccaggccccttgctttcaggtctgataacttgctaggttattaaacctgaaacttgataacttctgtagatgttgaaattagaacggcctcactcacctgggctcacaaaattccagaaagtagttgacgtcctattactggtttaccgtgaaggctctatgtccagagtggacaggacaagtggaagagtggcacagggcgaggtgtggggggtggcgtggagctccttttcaggagtctctaagaaggtgggactccagcggcaatgccttgtccatgtgctaagccagccgagggcgcacgaagtgctgtgtggtgtccaagctgacttgggagggacaagtttggggccagccccccagcctcccttgtcatgtcccacctctgctggcatctgtgggcttaaagtgccttcactcccatccttttcaactatttcttgattaaaaaaaaaaaacaaaaaactgttgaatagtaggagactctctctctcattggtatttgtgggaataaatattaaataaacactttctaataggtgttaccaggacgcctaaggaaattatctcacagagttttcaacactgtgaaaagagaagctgactgccagggagagatccctttttcctagtccttgtgaacatgtgctggacagccaggagtggcactgtggcaagaaacacccgttctctggcattagtaagagggatatagccaagggtatctgtataccagtgttaggcccatacatccataaaacattgatgtgagagctttagggcacagctgaccctaagcctaacgtgatcattaatgtcatgaaaattggagaattggtcaggcgcggtggctcacacctgtaatcccagcacgttgggaggccgaggtggatagatcacttgaggtcaggagttcaagaccaacctgggcaacatggtgaaaccccgtctcaaaagaaaaaaaagaaaagaaaattggagaatttataacgtctgatgtgacctgttctttaggtgttgaaattagaacggcctcactcacctgggacattcttcagctcacgccctgtacctggcttacagttgctcagtgaaatgctttcttgattgtagcatggtgggatttttataaatccaaatgacttagaggtaggtgtcacatttttagcagctaaaatcatactaatcgtaaagctcagattcctgtaagtagggcgctgagcacaggctgcatcctggatatatgaatagatgaaccagatcgtgtacatgtgggacacgttctttgtcctttgggactttcttttgcttggatgttggtagtaaccatgtaagttcgggcagctttctagaaactttccttgttgtgcaacattatgcaataaatgcactgctttgtgatatctgagacgttttggttttcttcagcttgtttgagttaaatttagactcctggcatagttttaggtttgaatgcattctctgagataggataaggaccaaaacatccactcagcagccagatgggattttatccttgtgctgccatttttgagactcatgcctctgtttcactctctgtaagatggcattaatagtgagggattgttgtgctgtgaggtttaaatgagctaatccctgtgaggagtttacagcagggcctgggccatagtgaaacactgtgtatgtggaagccacttcacttttgtcatagctttgttgtcattagtgtataccctgtctccttgccgtttatgggtccttctttcaagcagtcggattttctgtctgacatagtataagtttagaggaaacaatagcagctgtaagataatagtaattttccttctgaaatcattttggtgaatttagtcagaatatctgatccataaactctcattataaaacattgccttatgattggagttttttctgagaacagttccaatgaacatgattttttggtggtgaggtactatttctgtgcagtaatgaagttgtgaggacacacagataccacatccatgttgtttgggaattgtttgggaaaggtacgtgggatagcctggcatggggaagaatgatgttagggtattctccttgaggagctcagaataaccaaaggtaaagcatttggtggtataagatatattcatcttaaaaataagttgaaaataataagatactgggagatgttagccaccgaagtaaataactacagtgaaatagctctttattaattttgaaacctaaagttgaaagagttccgtattatttgtcagtatctttatcctcttcaaaaatgtttccagctttgggataaattgtgaataattgtttcactttgttttttaatattggctatgtagtgattttgcattgaactgtgatataagaatgatcatcagccccttgagattactgtgtgtacctgtgtcaccagtggcatataggggcttaaaagcaagtaagtttaatatatacattcattgagaacacactgtagactgttaggattttcggtgctggagccatagtgatgaatatgacaaggccctcacccttgaggtgcctatagtcgtgtggaacctaggtcctcgcagggactctagggcaggtatgttcttgaaagatttttttttttttctttttgaagagacagggtcttgccttattgcctacactggagtgcagtggtgcggtcatagcccactgcaagctcaaagtcctgggctcaagaaatcgtcctgtctcagcctcccgagtagctaggactacaggtgtgcaccaccatgtctggctaatttttatttgtattttatttttatagagtcagagtcttactctattgcccaggctgatcttgaactcctatctcaagtgatcctcctgcctcagcctcccaaagtgctgggattacaggcatgagccactgtgccctctgtaaaagattcttatcaacagttaaaataagaagctgctcaagacatttacctatcctgaatgtttcaggccctcaaggtgccaggtagctgcaatatagttctagtgtagaaaagaaaaccctgacgaggtctatatattccaggactctgtctgaggccctttgacactccgggggcaccctgccgtgaccctgactctttcctgcatgtactgaggatggaggtagcctatgggtggcacagagatttgctgtctggctagcagtacttcagggtactgggtggcttgaggacctcctgttagaagcttggattcacttttcccaaggcaaccacgattggattctattagttctgggtcttgagagcctgcaagggcttccttctgcgaaggtgagtctgggagagacgccatggagtcagtgtgagttctgcagcctcccaagttccgctggcgtgagaggcttgcctggtgccagggctctgggcattgggaacattgcctggtctaccgggcaagaaacgtgaaccaccgcagtgaactggcagcgcgttggcatttttccctccatgtttttataaaaccgctgagtagacaccagattataaatcctgtgtaaatagtcttgaagagtttctgggttcagccccagagaagactggtttgggttttgaggaatacttcaagaaaatgtttgttggttctgttttccaacgtaaagtgctgcacaaggactgtgctgtgagatccaggagtgtcttttcagccctcagtgagtgcctgcaggggacacagctgctttggaggaacgtggttccggagggtttcccactctccatcctagttgctaaagtcacgttccacgtattgtgttctgatgatagaatgaaagcccactccccgcaccctggggtctaggtggggaaaggagaggtgtatatgggatagccacggggtttggcatgagctcagtagagacagcaaactgacccagacagactcccgctttagggaagctgggatgaactaagtgaaggtgggtcatgggagcaatgctgaaccactttggtggttacagtgaaggctgctacacacccagctttgggaggtggggcccagggtgtccagctttgtagaaaggcatggtgtgggggtggctggcggagggggtggtgggtggttttcctcttgaatctctgagaaacttgactggtgtactgctctctgctttcctaaggggtccgtagctgtgctggtggtttgcttggtatctgtattacatccactctgtgcttcagcctgtttgtccagttactgtgtctagtgaagctagcattcacatattttagattaaattccacactccacccccaaattaaaaccctgctatttaaggtaaaaataattttaaaatgttttattttggtctctttggataaattaatcttgaggaaagcaatacttactgaatgttgatgtgtgtatatgtctttctctttgtaccatacttaacaggcaagtaactctcttgtaaaatcagattctaaatgattttcttttcttttcttttttttttttttttgagacggagtctctgtagcccaggctggagtgcggtggcgcgatctctgctcactgcaggctccgcctcccggcttcacgccattcttctgcctcaacctcccaagtagctgggactacaggcgcccgccaccacgcccggcttatttttcgtatttttagtagagacggggtttcaccgtgttagccaggatggtcttgatctcctgacctcgtgatccgcccgcctcggcctcccaaagggctgggattacaggcgtgagccaccacgcccagcctctaaatgattttcttaagtgtaattcaggagttggcaaactacagcccatgctgccacatctggcctgccacacctgttgttgcacataaagtttcattgagtcacagtcatactcatttgctttcatattgtctgtagacaacctagaatgttagaaaattctttctctggctggacgcggtggctcacgcctgtaatcccagcactttgagaggctgaggcggccggatcacctgaggtcaggagttcgaaaccagcctgaccaacatggagaaaccccatctctactaaaaatacaaaaattaaccagatgtggtggcacatgcctataataccagctactcgagaggctgaggcaggagaatcacttgaacccaggagttggaggttgcggtgagccatggctcatgcatgtaatccttgcactttgggaggctgagacgggcagatcacaaggtcaggagatcgagaccatcctggctaacacggtgaaaccccgtctccactaaaaatacaaaaaaaaaaaaaaaattagccaggcgtggttgcgggcgcctgtagtcccagctgctcgggaggctgaggcaggagaatggcttgaacccaggaggcagagcttgcagtgagccgagatcacgccactgcactccagcctgggtgacagagcgaaactccatctcaaaaaaaaaaaaaaagttatttctctatgtaaacaaagaaaactctccttccttataacttgtatgtgttgggtctatttgtattctgtgaaccataagaaataagtcaactatcagctgggcgtggtggctgacgcctgtaatcccagcactttgggaggccgaggcgggcggatcacgaggtcaggagatccagaccatcctggctaacacggtgaaaccccgtgtccactaaaaatacagaaaattctctgggcgtgttggcgggcgcctgtagtcccagctactccggaggctgaggcaggagaatggcatgagcccgggaggcggagcttgcagtgagagatcgcgccactgcagtccagcctgggtgacagagccagactctgtctcaaaaaaaataagtcaactatctcaaggtaattacccttttgaatacttgaggacatcttttctgtgccctctgaatatttccttccccagataaaatatttctagttcttttacttgttctttgtttcagagttttaagtctccatttgataaagtatagtttaatagccttcgaaaccacatcgttgagatttaaaaagccctccttgagagacatgaccagtagaaatcataccaggaccgtttagcaccctaactctgggagccatggctcttgggatgcggctgaagattgtgttatcgtcctgaagctctcttggacagctgagtcaatgactggaggtaggaaagttccttgaactctttcttgtgcccttccagctgtgagctgtgtcaccattgtattatttttacattgttgttgttcttgaaaaagcttttttttttttttcaaggcagagtcttactctgtcgcccaggctagagtacaatggtgcgatctcagttcactgcaatctccgcctcctggtttcaagcatttgtcctgtctcagcctccccagtagctgggattacagacgcctgccaccatgcccggctaatttttttaatttttagtagagatggggttttgccatattggccaggctggtctcaaactgctgacctcaggtgatcctcccacctcagcctcccaaagtgctgggattacaggcgtgaaccaccgtgcccggccaaaaaagcttttgaaaacttcgtcgtataatattatggccatccttccaaacgtgacctttttatgttgtattttatctaactaatttgcccttgcccccaacttttatcttggaatttcttacgtattaatatactgtcagggtccctgcttggggcattgtccttgggcttgtcattagataactccaagttggcttgactccagaggagctgccttcacacgtgctgtgaaatgtactgttgttgaccagagaccatcgttatcattaagtccacaaacctgcttcctgtctcttaggctgttccagtcttctatcgaaaaacagtggtttaagtggcttctccgatagtgctggtgaattggaagcttctcgtcatcccccttggctggggcgaggcttacttcctggggccttggcagttttgatctaactgacttatgttacctttctgtattaatcaagcctttttattttccatacttctgatgctttgacatcttggggccttgctgaccctgaagagaccagcccccctagggttagccagttcctaggtagtgaatgagtacaatgctcatatgcaaaataaccaatccaaaggccacgcccctcactcatatgcaaaataaccaatccaaaggccaggccccttaccacctttattgggatttcatactccaggccaatattgccctaccttaatcaccctagggccagataccaggcaagagacagcccctacaccccagagcctgtcagaattactccagccagctagtcctaaacctgcttaccttgtgtgatttattccttcccaaggaaaccacaataaaggctctcctccatgttttcctaccattccctctgcctcaggaccaaccttggttcttctccgtgtggccccttggcatggtgcactacctcttcttggggactgtgagtaacagactttttcagtggcaattgtcttttaactgttggcctcaccgtacctgaatagcagtaaaccctacatcttaaaatactttgagattgtcacatacagtacccagaataggtgaggatgaaggcaatttactggatgcagagcggccccagtccattccttatgtccgaatgctaagacttgagaaaggtggagaggagcctgactatcaagagttgccttcttggatgaagtgggctgaagacacacgaaccccttccattaatacatctacatattttccaccattgtaattgtattaataattggagaaaataacaatgactgtcaacaacaatagcttaatccagtagagatgaggtccggaataggttctggcctacctcagttcatgttttttactttcaatgctgaagcacaagcaaatgcaaaagcttctcttgaatgttttgtaaattgtgggataattgaggtatgtgacatggttaataacccagtgtctgctcattgagcactgggttattaaccatacatagcaaatggagcacatcatcgtgggttgcttgcgtcactagatcctgttgcaaaaccaagattcaactttaaaatacattttaatttaagttactctttctggcatgaatgatacatcactttggagcaacacttaccaggcagtgaaagctttttttaatgccctgtgtagcactgctttcggtgcccttatatgatttggatggatggatggatggatggatatagccacagggtcttgctctgttgcccaggctggagtgcagtggcaccatcatagctcactgcaacctcaaactcctgggcttaagcgatcctcaacctcctgagtagctgggactactacaggtatgtgccactatgcccagctaatttttaaattttttgtagagatgggggtctcaccgtgttgccggggttagtctcagacttctggcctcaagtgatcctcccaccttggccttccaaagtgctgggattacacgtgtgagccactgtgcccagcctgtttatatggttttaaaaacaaaaatgtatatgctctcaagatggctttcagagagcttattagtgtcttggccatttggaattccatttcacttaaattagaagagtgaaagagaaatgaatggaagaccaaaaatggggagaagaaattgtatctgatataagcgtggctctacctgggagaatggccattccgaattactggaaacaggaagaagacttgctatgatgcttccttatatctgtgggggaaaatcaaacttacattctgaaaggaaacttaatacttcatgtttttaaacacaaaaggatattttttcagagtagcagttataaagttgttagtttaatcttttagttcagctttttttcttaccagaaaaataattagtagtacaaaaatttatgcgtttgttttagctctattctgatactgttaagaagatacatgacataaaaacaggaatattttcagtcagtgattacaatttaaaatcatattcgaaatttaataaaaagtttaaaagaaatcaccagcataagatgttgtcatttggctcttggggcaaaccagctctcttctggtgaaagaactttctggatgaggtcgaaaggcaacagaaaacctggggaacaatggctgtctttttaatgggagttgctcctattcctggtggtaacaacctcttcctgttgctcctttccgaatggaattgcctcagtgaagttgttgaagaagtgaggagggcgaaatatgcccatccttctacagtggggagaggcctggcgcatgaaagcaggcctttgtgtatgccgggctgggcccatgcaaacagggcacaatcaggctattgtttgtttgggaaaagctatggcatcctattgcaattatttatggaagaaaatatttgatgtttttggaagaggttaggtgtggggggtgatgagggagggaggaaagagactgggcttacctcttgtcccattcactccaaatctctcagtgcgtaggatagggtccatctggtccaaaggagagttttgtgtgactctgtgtgttggagtgttttcgaaatgcagagaaattcagagcttctctagctttggctagagaaggaacaatggaagtgagtcttattctacctaagtttgatgtggggcagcctgttctgtagttgccttccaagcccttcttctttctgatgctttcttggtaccattgcccacatgctgcctccaccctggatgaggtctagacctgttacattgattctcaactaattaaaagtcaatatggtaaaatatttgcagcattccttctccttccctgtgttcatttctgaagctcaacagtcttccatactcaagctgtggggaggtccctttctcctttgacaccagccattttgtgatctgccctttcaggccaccccagccaccctactttcccagtcttgcctctgcctacttcacctcttctctcgaacctcagaagcttctggagtcttcacagtggccctaatcatgggtctcatccttgttttcctgtctctttgaggttccagcagccagctttgcctcatcaggcctttctctgaaattcccatcaataactacaagatctgcccagtaccttgtgcatatcaggtctcaggaaattgtgagtttcttgtttcattaaacatttttctttccaggaatcatcattcatcgcattgccatatgtgtccagatcccccttttcagggagccagtaattcgaaagcacttgcctgtgttgaatatggtggaaaaaacaaatgtcaaccctagccggccatcactccccatcggcccaccccattctcttgtgccagtaggacttgcctgtgttttctttgggcagttcaaagttgggctcttgagaagttgcctgtaaattcaattgaagtgaccagatctcatccttacccactctgtagctgcagataataaacactggggacttcccttgtgcctgtgttttaatgtaaccttaagacttgatgctccctggagtgtaagaatatgaatagctactcgctgtggatattgcagttaattactccttcctgtcccatgtggtccccagaggaatatgagattgccacaaacatggcagctttctttggggaggtgggagagggagatgaatcttggggcaaggcacattctcataaccatgtggctccagaaagctgcctgactcagagaatggctataaatgcccggttgtatggatctgagatcctcaaagccaggttcattcacttatttattaatttaacaaacattaggcagctgtggtgctctgtctgctccagcagtgatcaagacagaaaagatttcttcaatgctgcgtgtggtggctcacacctgtaatcccagcactttgggaggccaagacaggcggatcacctgaggtcaggagttcaagaacagcctggccaacatggtgaaaccccgtctctactaaaaatacaaaattagctgggtgtggtggcccatgcttgtaatcccagctactcgggagtctgaagcaggagaatggcttgaacccgggaggcagaggttgcagtgagtggagatcatgccactgcactccagactgggcagcagagcgagaatctgtctcaaaaataataataataataataataataataataataatagtaagaatactggggtggggatggtaggatgcacagtaaagagaataataagctagtgatgagcatctaagaagaaaacacaaaacagtactgtcatcacaatgcaggagtgctgggttgggggccaggtgtggttgaggggtgctgtattacgctgggtagtcattgaggcctctgtgaaaaggtggcatttagactaagggagattggaaggtccagccatgggaagttcaggagaaaggataagaagaaaaagctgtcacatgggcacagactgatgaccagcaaggctggaacttggaagatgagggaaactgagagtgattgtcagctcaggctgctttgacaaattactgtagcctgggtggcttaaacaatagacattgcagcattccctctccctctctgtgttcatttctgaagttgaatagtcttccatactcaagctctggggagatccctttctcctttcacaccagacatttcgtgatttgccctttctgaccaccccagccctactttcccagtcttgcctctgcctacttcacctcttctctccagcgtcatggttggagaagcatattctcatggttctggatgctgaaagtccaaggtcaggtgtcaacaaggtctggttctagtgagggctctcttcctggtttgcaaacagctaccttctcactgtatcctcatatagtggtgggagagagcaagctgtggtgtctcttcactgattaaggacattaatccaattgtatcagggtctcacccttatgacctcatttgatcttaattgtctccttaacagccctaccttcaacagagtcacatgaggggttagggttcctacatatgaattggcagggtggaggtgggaggtggccggggatgagacacaattgatttcatagcgtcgagttataagatgggtcacagtattagatgggaccagagcagagagggtctgtaggccatggcaagagtgagaatttactcaatacacagtggaagttggggatgagtgagaagcacaagagtggcacactgatttctacaacagtcagtctagctgctgggtggagaaggggagaaggaggaatagtggaaaaagcagggagaccgcttaggaagctgctgggaccgtgcatatgagagatgttggtggcttgaaccagtgctgggtttctcagcattggcagtattgacattttgggtgaaataattagttggggagtggcagggcggggggtaggggtgcagtcctgaaccagtgccaggtttctcagcattggcactgttggcattttgggtgagataattagttgtggggggctgtcctgtgtattgcaaaatgttcagcagcttcactagtctctacctgctagatgccagaagcccacccaccccgccccctagtcatgacaatcaaaaatgtatctagacattgacagatgttaacctgggattagggggtggggagaccaaaattgtaccctgttgagaaccactggaccagagtcatagcaatttgtagtggatagatttaggaatatttgaagacttgtaaaatatagcctgaagggaatggagactgggagagtgaaagatacctctgagacattttggcttggacagaacagggggtggaggcttccattcctgagctgcaaaggagtggggagggaggagcagtgtagtttgggaagtgtgtggtggagaaggcagatggggcaggagctctgtcttgcatctctcaggtcagaaatgcctcagacatccagggggggcaagctaagatggagttgaacacagcagtgtagggctcaggggacaggccaggaatggagagaaacatttggcactcatctacttgtagcttccctgtcgagaaaaatgaaatcatccaggggttttcaaattcagtggtctctggaccccttcacactgttaaaaatggaaaaccctgccactgtctacatgtttatgttgccccagtaatctatgcattgaaacctaatcaccatgtgatgatattaggagctggggcctttaggaagggattaaatcgtgagggtgggggacctttatgaatgagattgtgcctttataaaagagagctgctttgcctcttctgctagaaggtgccctccgtgaaccagaaagtggagccctcacaagacactgaatctgccagtgccttgatcttggacttcccagactctagaactgtaaggaataagtttctgttgtttaaaagctacctagtttaaggtgttttgttataggtgcccagacaggctaggacaaacgccaataagctttcgtttatgtgggttgtatccattgatacttgctgtatgaagaattaaaattaataactttaaaaagatttattgattcagaaacagtaacaaaacttaatatgcgttaacgtacttttatgttggataaaaactatatcccaccccagtatatgaatagagtggcattgttttatgtgtttaatctctggcttaacagaaggcaattggatgatcatacctgcttctatgtttattctgctgccaatatcacacagcttctggaaacttccacggcacacattcatgagacaataagagttaaaaaggtaaacagtgtcttagtagtgtatgaaaatagtttaatctcatagaccccctgaaaaagctgcagaatccttacgcgttcacaaaccacactttgagaactaaagatcaaggagtacagttttctcatttttatgctgttcagagtgtggttgaagttcagccatcactagtccttcacggatagttcataccccaagttgatggccttgtggaattgctgatgctattttcatatatatatatatatataattctagcctttttctctggtcttataagagtcacatacgtaggtaatttcatatcctacaaatatgttctaaacagcagaatattccaggaaaccttaagtgataactgagttgaaagagtcatattttttaagcaatacaatttaaataatttttaaaggaaacatttctaaaggacgttttacattgcttgcattaaaaagaatataatgaacataatccaactttttctcaatactcagggtcatcactgtgaaagtaacttcattctatgataagataatgatgctcccaggtgggcaaggcagtttttcatctaaggtaattgagacaccttttaaaagcaaaagataaattcacagaccctcagtgtcattataaattacttggtataaagatacttaaatacctacagccttataaggcctaggtgtcaattttttacgcttgcagatcttttacaactgtaagttaaatgattttacacattaagtgcatataaaacaaaaagattcaaacccaaatattaatttaatgacatgggtaatattttgctaaaagtaaaccactgctcagaatgtgaataaactgacctcgaaggcctgagtacgtttgaattacggaacacctctctttgacatcacaattgaattttttctttaagtatcgcaaggccccagttcacggaagtaccacaacataaattggtcttcacttggtatgtgaacacatatttatatgttaaatgtgtcttttctttttggtgtacaacagctagagtaatgcagtttgcttgcaatgtgttttttatgtaaatgctgatgccgaatccacttggcagcactgagttacaagaaggttaagtagatgaactagaagatggataaacgaagatagataaaatgaagaaaaacaaaaatcaaggagaactcaggcgtccaagagtgtgtaaacaacttctggtgtgagacgcgctacattgcgctaaatggcctgtgcgcttctggtttttcccttcctctgttgattttttatagttgtcttttattttaaacacgcctcccccccccctttttaaactgattttaccatcactctctctagccctgcctccctagaattagctgcttcttacctcccttggatctggaacttaaatattaacgtgtatataagttaatagtaagtagaccgtgaatttagaagagtaaaacagaatcatgagtacgtagtcactgtggccccttttctgctggatttcaagttcgtaagcatttttggaagagagtcgaaggggaaggggtggcttgccagtcagttgagtgatgcgtgagggaggcgttaaatgtgcatgatgcactaaaatgcatgtttcgagatccagtatgactgctcttccatagatgatgaaaccaaggcagagaaataagatgtaactctcttaccttgattagtgatgagaatgggacagctttattcatgaaacccggaaaccactagcccattcttgggatgattgatatctgcaaggatcttcaggaatagagtacctggggctcaggagccaagactagaagtgttgaaaggtgagcaggaattagctgctggcctcagacgtggagagacacacgggtgtatgtgtgcacacacacacacaggcacatgtatattcatgatggcttcttaattcccactccaggccaactcatttccctttcccttccacaggtacttataccataaaaggtatatgaagtgctaaaatacttgtaggtatgttgtcaatatgagctactctgtaaatgataaataataattgactggtgagtctaggcaaggcaagtcaatgagattacaagaaaagagatgttaggccttcagaaagatggaaatttctctttgtccctgcagggactgttgcagagcattagagccaccctcaaacagttacccagtgagtctcctcaaagcaagtggcactgagatacaaccttcctacaggttttcaagtcatctcgtgtggtgcacagtcctcgccctacctcgaaggcccgggcgaagttttcctgagtgtgtatactcatctctttgtgttgtctctggcagggagcaagtgagtacaggattggagtaataggcatttttaggcttgagatggctttgtgtgtttggttaatgtcactacatttcctaggggataataaaagtctagcatgataaaagatctcgtcttacaaggtcccgatgtaaagtttggagcctaacttagaatttaaaataaaatacattttgacccattgtattgagagctggtataatttaatatagtgagcccctcggcttctggttggttgggttataaagcttcttattcattcgctcatccattaatgcatttctcctatgaggaagctttttcctttgagctgaacacacaaaattaatcgtgctcgaactctccaaattttgtgagttccctggtaactgactgtatggaagacagaaataaaaatcagaataaacttttattttctgaatcagaaagcagttgctccagcttttggtggtcacattgctaagatgtaaaaaacagaagttaggtgaaataaattaagaataattattttggagaaagagagggtagtgtttgactaaattagaaacattctctgagtcttagaagcgtgaatgatttaaatgaggttccagcatagtattgcatgtggtttctattttagagttttcccacttgaaaacaaactttgaggatttttattgaagtccatcagttttaacttactcaaagcttagcagccaccttttgcttttcttcccgttccccccacctcatgctgtgaagaaagtcatacaccattgtggtgttgattgaaacctttatttctccaggtctcctctcataaactgggctaagaaacacaaaggacatttgacacttcatgactacataagatgtgctgttcctctctctttctgtttgaaagtgacttggcagggtgaagttgagaaccccttggaaaggaggaagccgaaatgcaaacaaagttgaatcatgaagtgatgtcactctgaaccaattggagcagtggtgtcatgtgcctggcagctacttcaaatgcccacaaaacaggagtaatggtttaagctgtttccctcttcccctcccaccaccaatcagcagcagactgctagaggacagatgcaaaacagttattagaccaggcttagttagacatggaggatgcatcttaacaagttagtacctttttgcaaagcatgaagactaattcaaagtctattttctggttttgctctaccagtacggccaaaaccatttctttttaagtgagaagtggggatatggtcaggtttgattccagttgaagttgtgagctgcacagggctggtctgagcccagtggcatctttccaggtgtcagagccatgattttaagctcctgttaaattcacagtgcttagtaaccataacttcttggtttcatgatcataggggtttttgcatagctgccacccccattttctgtttgtgatccagtagttaaaactcccagaaaatatttctcaccctggtttaaataaacaaaacagccaccacaaaaacaaacaaaaacttggctaaccactattttcaggcatattctgagagagaaagagggggaaaaaaagactagacatcctaaaattaagcaacattatttttggaattgtgttgtttcttatactcagtcatttgtgaatgatgtggttcaaacaaaactgaaacaaaaatagtttttctcattaaaaatatgtttgtcgcatagccagcactcggaactagggagggtaacatggaagtattgtcattctcggggctgactggttgacagcagcctatacaggagtggagaatattgacagggctgcccgttctccccaggtcgaagagagcaaatgcacatccctgtgtgcacggccacctggttcctctcctcacttgctggtgagtattgaacggctcacataattaggcagaactcaggaactttcctccctatctctttcactcttctgaaatgccctttatgttttcctctgctctttcagtcccagtgccttttctctggtgcagcctcatggttcggtctcaccttcagcttttccttccctccaatacatcctgtaaattattgtcagacttcttcttatctaaataactcgtttaggtaaggtactcatatgttcaaaataccatggtggctccctgttctctgtgatgtgaagtcctaaccattagactcagctttcccccaggacaccttggcttatcttcttgctgctttccagaggcatgggccattaggctggttttctgaaggttctgccaaaaggctgggcccttgtctcccaccccactgctgttactcatgtgttctcccacttgctcggcattctttcccatgctttttccttgatcatcacttactagctaacatctattttttcctaaacactctgttgcagttgtagtctgcagtcactctcctaagacttgatcatctattacgctgtttcgttctttattttttaacttttcttcttcttttttttttttgaaacggattctcgctctgtcacccatgctggagtgtactggcacaatctcggctcactgcaacctctgccttccgggttcaagcgattctcctgcctcagcctccctagtagctgggattacaggcacgcgccatcacacctggctaatttttgtatttttagtagaatcggagtttcaccatgttggccaggaggtcaggtcgaactcctgacctcaagtgatccacctgccttgacctcccaaagtgctgggattacaggcatgagccaccatgcccggttgttttgttctttaattttacaaacttggcatagcttagaagaccatatacagtggcaccatatacagtggcaccatattagtggcaccatatacagttttccctgagaaaactggtacctcccaacagataccaaaatctgggaccaccccaacagataccaaaatccacagatgctcaagtcccttttataaaatggtgtgatatttgtgtatagcccatgctcatctttccgtatactttaaaccagggatccccaacccctgggccacagaccagtcccggtccatggcctgttaggaaccaggctgcacagcaggaggtgagtggcaggccaactagcattaactgcatgagctccgcctcctgtcagatcagcagaggtcctagattctcataggagtgagaaccctattgtgaactgaacatgcagggaatctcagtaatgcctgatgatctgaggtggaacagtttcatcccaaaaccatccctctcccccacccatctgtggaaaaattgtcttctacggaaccgatccctggtgccaaaaaggttggggaccactacgttagaccatctgtagattacttataacacctaatacaatgtaaatagttgttatcatgtattattagggaataatgacaaggagaaaagtccatacatgtttaatacacaagcatcctattttttttcctgaatatttttgatctgcagttggttgaatccatgggtgtggagccctcagatatggagggcatgctatactgatcacccctatgggtgtgaatgttgggcagatcctccagtgtcaccagccatgtggccttggtgacctttccatacttttcaatcagaatgatgatctccacctctcaggaaagttgtggggatgaaatggtatagtctgtgtgtgtagagttgttaggctggggcctgccatgttaaatgcccatgaagcaggtaattatggtagtagtggttgatatcttgaaatcagggggattcccaaatttctaccccaaatctggatgactgcatattgcgggagttcagtaaatatttgttgcactaatacttatgtgcatacgctgaaataatctaaatatttaaaaaccaaactaacggtaggactttcctcagggatttaacgtttgctgtagaagactgaatgatagaatatataagctgtatttttcttgtgattctacacattgtccatgttgcaacttaaatatttttggaatgcaatgtaaaagtgatttactgtcctataattgttttcctgaaagcaaaatgatatttaagtgaactgcaatgaaaaatgcaacgactgtaatttatcgttgaagggcattttcaaagtgtatagaatgactaaagcttaagtgtattaaatattctagaggaagacatatttaggctataaatctagacttcctttggaatttgtttcctttttctcagccaggtgtatgaagattttaagttcttaggcctcagtgggaagaagatttaaggttccaagagtacatttgtatctcttttaaattttctattgtttatcagtgacatatgtaaatgttttagggagctgtttactgtaacattacctactttagctctgtgcagttgtctggcaaccaatgtgataaagacagagggaagtgctgtattttgttgctgacaagtatatcttaaaagtgcaggtgcacctgaataggcaataaagtattaagagctgctcctggagcagtttgctctctgtgacgtgtgaaaagtctacggggtttataattggtctggccatacggctgcctaggattagactcttttcatatcccactaaacactctccttagaagcaagcacaaggagatagtttattttaaaatgtaattgctatgttactaagatttgaatttgagtaccgagaataaaccatatttctgtttagaggctggttggcttaaaattgtgtctaatccttcccctgccccccaactccgaatcagagaatgaataacaaataaacatgacaatgaagtctcatgctgttgttttcatatttgtatttaggagtttcagagcaaatgacttggaaaacaggcaaatccactgacataggcatttttagccaccttggaatccgaggagggattctgcactatgccctgtaacctcgttcacatgccgtttgaatgtataccatgaagaccccttagctcagggagctttgctctatttaagtaatgtttatattcttaatgaaccaaagaggaagtggtcatgggaaaagagccaggactagatttcattctaatgcttataaggagagttctaggaaaccctcagacttggtaaaccaaggcatttggagatactatgaattggtttaaaaggccatttaccacttcttttgtaattggccttttaaaccaactctcacttagctgattaaatgtggtcatttaaactgctagttaacaatcggaagtgcagtggcgcaatctcagctcactgcaacctctgccttccgggttcaagcgattctcctgcctcagcctcctgagtagctgggattacatgcgcacgccaccacacccggctaatttttgtatttttagtagagatggggtttcaccatgttggttaggctggtctcaaactcctgacgtcatgatccacctgcctcggcctcccaaagtgctgggattacaggcatgagccaccgcgcccggcctaagatttcttattgtggtattctgcagtggagaatgggagttggaaagaaatgttttctcccacacctgtcccgctcctgtctactgaaagctgattaatcagtcagatagtgagttcctattggtagtacgcctccaaaatttggaagaggggaggtggcgtgatgtgaaaaagcaaggctttagggagagattcccgctgggggcattcaccctctggtccagcgtgcctgttacagtgatcactccatagtggttttgcatgaacaagactgcccagtttgcttaggaagaaaacaaaggacataaggtagttctcatgtcttcccagcaccctaaatactcgggctaaacttccacagtcagaccgtcagcttcaggaagggctgctgttgggaactttttttttagtttgcagttagttcagctccagccaaaaacctacaaaaagccactgcaagccctctgcctgctcgtataagacaccttggttgggcccctgtgactgtccatccataggatggttggccattgactgcacagagaggtagggcaagataaaacgactcatttgtggatctgactccttgtacttctgtttggattcaaacagaggaagatagagtagtggccttgggaaaccgtggagagagaaaaggcatagtcagaatgttttcagaggagcgcagacttttcaaaacccctctcatcacgttcccactgaccttcagttccagtgctgtggccacagggtgtctgcaccccaacttctttgccaagaaattaatgatctgtgaagacacacagacatgaggcggacttactatttaaaggaatcctgaaacgaatatttttctgatacatatttatcctaatatatttgctgagcatggtttttttttttttttttttcctattttggagtttttgggttttttaagcctagggaatgcctaatatgtactgtggagtgcatttgttcatttatatcccagtgcattgtaaaatcgagcaattcagtgccttagaatcctttctgtgaacttgatgctacgtgaactacttgagaacaactactttcaagccctccgaagcactcagttacaactgtcggtctaattgcacattattctaattcattaaaaaagtccccaagggcttcttaggatactgctctatgttattagaagtccttccaaatagaaaaactttattaatttaaaaataaccgccaattcagacttcgattcaaacaaggcattttaccaagtccggctgaaagagcttcttaccacatctggcatgtagaatggcagaagactatttttgctagattccttgttgctgcagccgtttctgatgtccttttccccttcacacctttcgtgttacacatgtctgagatgacatgatgctaagtaaccaaagtactgctgcgatggaattgctctgatgtttttttccagagtgaaagctgctattactttaaaaaaaaaaaaacttgaggtttggtttctttccccctctatccgggtgttatacaaatatgtaattaagatgtttgggggttcagatgacaaacaaggagtctacttctaagaatgcatttgcaagccaaaagagtggtgaaccacttcagagtgcgggtctgtgggggatgatgtctgctttgcttcgttttgtggaataatttttaacatttctatttagcattcatgatactctaaatagaagcaggagaacactgtggctctcggatccaggagaggcaggccacgagggctcctgctgtttggggacagtctgtaactctaaatctttttatatgcagcaattatgaccttaaaaatgggtgactctaatactggcattcattgcctaaaaataattttaatgtgcaaatgccagagaccaggtcatctcagaaatggactagaattgaccactgctatgttttggtgaaacctgataaccttgcttttctccgtgtaccttgtttttcattgtaaaactatttaattatgaaaatgagagtgtgaaaggcaaagtatgattgaatttagggggcagttccatatagttgtaacaaactgattatcaaatgtccaccattagtatgttaaaatacggttttctaatactgagacaacagggatggagcagcctatccactgaagtcttgttgtttgtccctgctgtgtcccaacctggaatctctttcttcttccttcagcagacccttcgagatcagcttaagcttcactgccttagagaaactttcctgtctacctggactgtcttctagatttctagagcagtgttcctgcccttttcctttctaaatggggtgggagttctcagagaactcatctcctttatggctttatccatcacagccacacagataggttctgtctggaccatccttttccctgagctttcttctcctttgccatgtgttttcatttctgccagacactggcactggggaagcctcccatcgtctcagactcagggtgtgtgaaaaacaaacctgctttctggactctacagtttgtgcactagcctaagccgaaaatcttgaaatctgtcatcagtgactattgtagtccataggaatacccaagactgggtaatttataaagaaaagagggttagcttttttttttccggctcatggttcttcaggctgttcaagcatggttccaacatctgatcatcatctttttttttttttttttagatggagtctcattctgtcacccaggctggagtacagtggcgccatcttggctcactgcaacctcccacttctgggttcaagcaattctcctgcgtcagcctcccaagtagctaggattacaggtgtgcgccaccacacccagctaatttttgtatttttagtaaagatggggttttgccatgttggccaggctgatcttgaactcctgacctcaggtgatccccccaccctggcttcccaaagtgctgggattacaggtgtgaaccaccacgcccggccaggatctgatcattttctaggaggcctcagggagcttttattcatggcagaaggtgaagggggagcagttgtatcatggcaagaagagaaagagagacgccagatctcctggtagataactaacagagtgagaactcactctttactgtggggagggcaccaagcccttcataagggatccaccccatgacccaaacacctcccaccaggccccacctccaacaatgggaatcacatttcaacatgagatttggagggaacaaacattcaaactatatctacgaccaaattttcctaattcctttctacttaaatgctttcttttccatttatttcacccacatctgaccctaggatttcaacgtgttctaaaatgaatttcttgcacccattttcactttctctccaccagaatccatctcaccacccacctgccagtggcatactccttgcatagaccctgctctagcatgaatatagcccactgttatctgttgtagaacctcacgcccagcttcccaccctgtgtgacatcttcaccctcttgccctggcttgtgccatccacattccgatcttgatgactctggttctcttctctttgacggtggagggttgatcccttccttccccatgatcataaaaggtcatgccaacactcctaaaacaaaagatagattaataagagaaaaacctaacaaatttattatatgtgtgcatgggagtcatacaaaatatgaaaactcaagaaaatggccagatggttgatccttaaatgctttatttattggtgagaaggtattgggggtgtaggagtaaatgattttcagggaaaatgaatatttccctgagacagcaatttacttgtaaatgatgctctttagaatttgaacacgctccagaggcagaaattgtcttgtgaaaaagtctgtctgggtatggttgcattcctcagtcttgagctggtggatggcagggtgcaattgcaggccgtagtgttcctctttggggatctggtttctaggtgggtaagggaacttcagagaacagccttgtcctgtgctttgcgagagacaaaggatgaggaaggggggtcagggaccttgaggctgcttcagcatgtcaagagtgccatgtttgggacgcctcaacactggaaatagccttcattcctctgcttcttgggtctggatccttttctttagactccaagaaattcttccttttgccccaaactcacattgtttttgtcttctgtccctctacttctatgtaattctattattatgcacagattctgtgtgcccaaggagactgtaaactccaggagggcaggaattatgtcttaaaacactagcggttaaacagttaagaggtgtcttaaaacattcctgtagccccagctacactcttgggtgcaggaatcacaagtgccttattccccacagggtccccagcatattccaggagctcattatgtttttaaatgaatgacctactgaaggcaagagaccaggaaggaaagtttgtaaaagtttacattattagattacccctgagatgtgtaaccttctcacgagttagatttcttgaaccactgcccgggtattgtattcctactctaggagcttgaaggattaatgataatccttttacagatatattcacaagtttctgtgaatgtgaattaagtatgtagatcttgattgcctttcttgagtgcatggtttttttctagaaaaacaaatttaagttaggtgggacacctaataaagctctaggctcctttcttttcctcttttaagacacagttaattaccttatgctaagttggaatataggaattatcttccaaaactgtgtttgcttgctgtgtctacataaaaattgatacaaggtatgccatggtttatacaatttctggcacatttacctggtctctgttacaggtttgtgaaaccaatttttttattgtaaatagtacgttaccagcttaattgctttagaacctagacagtctatgtctgtgatagtaattacattctttcatgactttgtttggtaacctgaatgttgaactagctctacagatttaggtcatgtctgatgctagccattcctaggaaaaagtggtgaggactacattatgggcctttccccctagacttaaaactgtgaagaagtcattttgggttgaggtatcccctggtaccctctcctgaacttcaatagaataacatgatgtggtgaatgaaccatattagaaaaaccagccaatcagccaagattcttgtattgactcttctgatctccctctacctctcctttccccatctgccaaacaaagggtttggaacagttaaattctaaagtggtgtcattgatggctctcagtattctgtggactttcctggttgattcagtacttgtgattgacctggaccccctggtttggtccagccttagagcgggtttgcaggtagacaccttcctaatgtttgttccacgtaagcccccggagcacagtatttccatcagctattttgtggaagtgagcgattctcttttggttgtaaaccttcactatttcatgtgggtgacttgacaatggctccatttttgaatggcccattgatagttgtagtctaaaaatttccagagattacacaagggtttatttaaagggaatgggaatagggagaaggtataacctttccaaaacaatctttaaggcaattataagctgttaggaaatgtcatgtaataataacacagatacccaagcttatatcacataaatcattcattttgcatgtttttgacagggagatttattttccaggttaaaaacaaaaaagaaaaatcttaaaagcttaagcttttattgtttgctttttttattaaaaagtaatttggagccagtaacttaacctgtttttcataaacatgctatctagaggcagccaaaaaaatattcatgcttgcatagtcagggtcctcaaatgaacttatgtgttggatcatgataactctggtaattactcgaattacccttgttgagtaatagtatggaccctgaatacaagggtttgatttatgtggccagctctgtgctgctgggtttatgaggacttgccagatgtcatctcctaattaaaatccttctttacccttaatatcctctcctctgtccccaagaaattaatccattctattgctggagcatgtaacagctgatgttgaagttacaagtttacagcttgaactttgcctagactgtaccttttttgggaaagagtttgcaaagcttttaagcctgactcttgtctttagatcaccagcatcaccatggtgcctggcatcagtggagcctcagcaagtgtttatggtggaaacctcagaagctgtcactttctctggctgtaacagttgtcatctttgtttacagggaaaatgctcttgagaaaatggaggtcattaaacactccagcttcagcaatatcatcagagctttccgtcacgtgagttatctcaccaaagggtcagattctggtaaaaactcttgccttcacacttacttctgttttattttgccttatttgacatttcaccagaattgatccataggttcaataaggctccattctgttgggacaaatcaagctagaaagacactgaactctgggggttaccagaaatatctgaaagcaaagcagtgactgtgaggtgggaatctctctgagaatcctttgcagaaccatgtaacagctctgcatcactagacgagccaagcgaagtggtcctggatggttcagtaggctcaagcattgagggtccagagcatcctttgcccctggacatggaagggttttcattgggagatggcatttagggcatccttataaacgagcaggagtaaacctagcaataaaaaccaaacctctgccttcagaggtatatgctattacttctgcttaaaccgttgtcagagctaacagttttggttagggatttttgtgggtccagggcacgcccagacacccagatgcttctctatgtttgtaagatggcgagtgttgagatgtcttataggcttatattgagtgaaaaggaataggatcctttgtcagtagtaacttaggctttttaggtggccagggcaagagaacaccccccctacacacacacacacacacacacacacacacccctacacccacacacacccacccctacacccacacacacccacccctacacccacacaccttcccacacaaacctacacccacacaccttcccacacagacctacacccacacaccaggatttgaaggctctgctaagaggctacaacaactgtagcatacaactagcacacttgttgctattatgtgtaggggactagatggaaagagtgcagataggactacctaccattcacccctaccagcgaagtggaagcactcatcttctttcccttcttaccctttcaaagcaagttgttgagggatgaagaggagagtgactttaatcgtggctttaagtagagattttctttaggagtaattgtttctctcgacagagtggataggcttccatagttgtcttaataccttttgtccaccccaaggattgacccaggcaaggaggatgaaccctcctcaatttgggaaagttaaattttaggcacagcaggtcaaagagtagggaagagctgcagttgttggaaccaagtgacattgatttagtctggaaaggagtcacagaggaatcaaaagccagaccctcctggcagctttagatgtggttggggtctgggaataatgctggtcccaaaatcacctctggaactaactcctgtaaaatgaagcctctgcatccttcagtaacttacttaaaattttgttagggctgcattttcttcaaagccaagttctgaataagaagtatttgttttgggctctagccagattactgaagtattgttgagggagatttgctgtggaaggtgttgggggtacagggattgtgaagataatgtaaaatatttaacattttaaaaattttcagtaagttctctttccccaatgtcagcatgacttcttcattcatgttcttccatcactctccattcagttagaatctcaattgtgtaatatcagtggtagcgacaattatgaaattcgtccagtgaggaaaatccgcagagctagagcccaaaccagcaactttgtagtgaggatgaccccactggccggggagaaactgaactgatttttttttttctctctctctcagctttttattttgaaataattttagacttacaaaaaagttgaaaaagcatccaggcatggtggcttatacctataatcccagtgctctgggaaaccaagacaaatctcttaaagccaggagtttgagaccaagctgtgagactatctctacaaaaaaaaagaaattaagtagccagcagtggtggcacgtggctgtagtctcagctacttgggaggctgaggtgggaggatcgcatgagccaggagttccaggctgcagtgaactatgatcatgccactgcacaacagtcttggagacagattaagaccctgtctctttaaaaaaaaaaaaaaaaaaagtttgtaaaatatcacccagttttccctaacgttagcattttacataatctatacaccaattctcacagccaagaaattaacaatgacacaatactgttaaccatggactatttgaatttcaccagttttcccactaatatcctttttcagtcccaacatccttcattgtgtttacttactatatctagtcttctccagtctgtaaaaatgtgtctatctttgcttgtttttcatgaccttgatatttttgaatagtatggacaggttgttgcatagaatgctccaaattggttctaatgtttctcatcattaaactcatttttatacattttggggaagactactacaagattgacattgcatctcagtgcgtcacatctgtgtgatgtcagcatcttaccactgatgatctcttagccttgaacacttgattgaggtggtgcctgccaggtttctccagtgtaaattttctgcttttcgcattgttactgatatcttagggctgatactcacagtatgcagatgtctcgtttctcttttttcatatttcttttcttttttctttttttgagacagtcttgctctgttgcccaggcaggggagtgcagcctcagacttctgggtttgagcaatcctcccatctcagtttcccaagtagctagtgtgcaccatcactaattagtgccccaccagttttgtttgtttgtttttttgtttgggcagaatctcgctcagtcgccagactggagtgcagtggcgcaatctcggctcactgcaacctccaactccctggttcaagcagttctcctgcctcagcctcctcccaagtagctgggattacaggcaggcaccaccacacccagctaatttttgtatttttagtagagacggggtttcacatgttggccaggttggtcttgatctcctgaccgcccacctcggcctcccagagtgctgggattacaggcatgagctaccatgcctggccttcaccaatttttaaattttttgtagaaactcactatgttgcccagtctggtctcgaactcctggcctcccacctcagcctcccaaccacaactggccaaggtcctgtttctcatcacattgtcactcactgatcttgtcatgctttggtggagcttatctacaataattattactgccatgctttaatggcaattttctatcttattgtcatttattcattggaatttttacataggaaagacctgctccttctcaaactctaaacagtttcattcaccatacttttctccaggtaactttctgggtggctgaaagtgactttcaaagaatggagatatcttttcaatgttgagagagtggcagtctgctggttcccaagatgccttcttcacctagcattgagactctgcagaatgccttgaccacagttgtgatttggatctgttggcttgcaaagcccatttgagaatttacaaaatcattttcacggcctgagagtcttttaggtactgatttttttcatcccttctttactaacagactttatttagtagagtattattggacaggtttggggttcacctttatgagaaaaaacttagattttctaatttcagcttttttattttcttccatcagtgggacaaagttgacatcattgcctaaaagtaatttctgtgattatctgtgtatttcagttaaccatgttctttggactcactgtggtcttcagcagggatggtggccaaactatgtttagaaagataaaaattaaaatgacatctgcatccttcatgtaaacccataaaaaatagcacgtgaccctgaagatcctctgcctctcattccaggcattacaattgaaaatgctatctgggatgttaaaaactaaaactattctaggacttagtggaatattgatagttagggaatgctgtttgctttcttgaattttgaacctgttattgagaaggtagatgcgcctgtttaccccaggaaggctcctctttgaagacagtgcccctggagcacatgaccttttcatgcccttgcctgtcaagacttttccagtactctaaggtcaaagggcgttgggccaggctgatctaatcagggtattaaccttgccccactcatcttgatttattcctagatcccagttcccagagcatccctttagagcctcagaaatggaacacaagacagctgaaataagcccgtggccaaaaggcactctgagcatgagggaagtaagcaggcttccctgtcactgctgaggctctgtcatccagccccagctgtcctcttgtgatcactcagcagacccgggaaaaattcaagaatttgttttttagtgtcagtgggagacgtggggatcctgcttttgctgggagagcttcagttgtctgagtccccactcaaccccaggctcctgccaaggccaccaagggcaggagcactggaaggctgactatggagtgaagaggccactgggtttcacaaacagcactgtcagccaaagctgtagcttgttagccatccaaaagaatcttgcacctgctgccagtgagcttacacctagatgacagctggagctgacactcattcagcccttactctatgccaggtactattctaaacacttgccatatactcagttgtcccacagatacaactatttatccccactttagagacaaaaaattgaggcacagaaaggttaagtaatttggccaaggaagtgcagctagtaaatggcagacctggggtttgaaccgaaatcagtgtgactctagagtacctactcttagaccctactctctactgcctctcattagaagtctcccccacctccctaccaccaccatcaccacccaccctcccagccacatatatgctcacactgggtggttcagatggctagaagtggcagctcaaccttgtgtgcctcggacacgaaaatattaggttcagacaccactcagacttcacattttcattagttttgggtagaggaatgagaataaatattcagcgagacagccttttctaactgcaagattgcattcctcttctttctagatgcagtggcaagaacagtaccctggatggtggagctggtagtggtagatgagatagagcagtcccttgattctgctttgtccccattaatgacagatctgagggcatccagaaggaatctccacaagcccagcctccacagtggctgcttcctctacatggtagagtggtgctcacctccactcctccatagatgccaagtcatctgtggtatagatgtggatgtctttgttcaaatggtccttgagtctttgctcagatgatccttggttcttcatttcacctgggaaagaaaataatttgcctgttgtcattttatccataatattaagaaaacttaatggcacaatctaagctttttaccatgttatttatcatgggattacttttttcaggtgtcttctgaacacgcagttgtcccaccaaactttgacactgcccttgtgattaatttttgcctacattaatcactctcccttgttttaattgcacattacattcttttctgtccttcccggacatctttgctagcacagtgagtgcagggaggactgtcacggactctctcccctcttgaatgggggcattccagcagagtgtgttacatgagctcagagcacatgatgtgagagcctcgtgatgaaagatactgcaaaaacagtgcgcactgttatcaaacctgactgccttcacatcttgctttctgtggtgcaaaataaggtttttatagtgtcctgtttcttctgttatcatctaaaccaatggggaacggtgagtaagtagtaatcttcagaaaagaagaaaagacagggaggagaaagtgtactggaggcctgctttaccattaagttgttaagatggagtctcactctgtcaccccggctggagcgcagtagtgcagtcgtggctcactgcaacctccaactcctgggttcatgcagtcctcctgcctcagcctcccaagtggctggggactacaggtgtatgccaccacaactggctaattatttatagagatggggtctcattttgttgtccaggcggggtttttgttttttgttttgttttttttttttttttgaggtggagtcttgctctgtcaccgaggttggagtgcagtggtgcaatctcagctcactgcagcctctccctcccaggttccagcaattctcctgcctcaacctcccgagtagactagctgggattacagctgcgtgccaccacgcctggctaacttttgtatttttagtagagacggggtttcaccatgttggccaggctggtctcaaactcctgacctcaggtgatccgcccgcctcggcctcccaaagtgctgggattacaggcgtgagacactgcgcctggccgtccaggctggtcttgacttcctttcgcttgtagcctcccgaagtgctggaattacaggcgtgagccaccgcatctggtctctaagttttttttgaaagtgtgtgtgtatgtgttgaaaaacaatcttactgccatcatattgaagttacctagtgcatttcttcttcagggtacgaagaaaaaagaaaagtatgtcctgtggttgatagaaatcagtaaaatggagccctgtacgaggaagtgctgatgagactccaactaactccatggagatgagctacaaaaaaaaatactgattgggttcaaatccttggcctgccatttactggctgtgcttccttggtcaaattacttaacctctctatgcctcaatgttctcatctctaaagtatggaaaataattgcatctgtgtgaaaactgagttactatacgtaaagtttttagaatagtacctgacatacagtaagtgctgaataagtatcagctagagagagagagagttagtttccagcagcctgtttctgtttggggtcacatgtggtctctgtccacctggctttttaggcctctcttacctgttccctgtttatccttgcctgccccagggaggagtttgagttggtacatcctgactgggtactctgcctgtggttagcaaatactctgcatgttgagtgctttcaaaatacagaaacaaacaacttgtggaggcattggaaaagtgtgtttgagaaacaagcagcctcaccatgaatgggagtttgtttccctttctcgtctttctggtcatctgctgcacgggcaggaggagctgtgggttgcttttcttccttggaacatggagcaccactctcccctgtgctgatacacttacaaagaagttcacctactccttggaaagttctggaaaaggggcttctacactgttggcctctcgaggagaacggtttttgtttctgtcttcctggaaaagaggtgactgctggcatcatctttctagataaactccttgctatgatgccattagaagcagtgttcttttgtgttttgcttttgtttttccctgtagacaggaataacattttgactagaaacttccctgatgtaataacgaagatggcctccttagaaagttccagaacagaccccttcacctctgtccccagaagcagaagtaggtgatgcactttcttggcaagccacataactaccatttctctacaatcgaagctcaaaaatctgtgcttgtatacgttcattttttgtttttacttctttacttcctttgataagacagaaacttctgtattaaaactgatttaactctgaggggctaagtgaacaacaatctgttgtcctatagaggtcaaggcagtgctcacaacaggatcattgtgctgctgtagttcagtttaggggacggggaatgtttataaaaacaaagttttgaaatgaggacagggaaaggctttgtttacctggggctctagacttaaggtactcattttgcctgcagaataatgaaatgcagagttgtaattagaaaaggttgatgtaattgatgtgttaacaatttttgaggtttttctctttccactttaggacagtcatgcaattatttttctgaaccaaaatcagaaccatcagtcgaaggctaaaacaggcctggggaaacactgtcttttggcaaagaaagacaaagatccttgttctctaggccagtgtgcatatgtgtgtaatgctttaaagaacaattttgacaagaactcttaggatgcaacttgtagagtgatttttaaggagatgcagtaggatttgtgcaagtattctgctatgagcctaagattttcaacatggaaatctagccatgcagtgactcgttcactttggcagtgtctatcttagtctgggggtgagcgtttgtagaaaatatttagagactcaagtacactcatttgaatttttgctgttagcaaataaatggcaatatgtgtaacgtggtgaatgggatgtaaagctgtctttatattaccacggttagaatttaattttgaaagttgcaagtcaaactgcttcctcttgcgtcattaagttgtgcctcttgtttgctcaccggcatgtgtgtccttgtgtcattttggttgctgtgaaattgctcttaccattctttcatccttcaacctgctgtgctacaatcctaacatgctgtttttgttgaaaatgcattcactctttttggcatcttttttccccagaaagttagaatattgggaattcattggtattagtgaaattcccacctaatgcagcagtttttttctcttacctgcataatagacgcagaacaaattaactctaaacggattagagctgtcaactgacagatactgtgcgagatactgaggaagcctcagagatgataccaataaacaggacagggccttctggtcgtgtttctacttctcttattggtttgtcttagcaattttgaattgcactgaaaacgaaatttcataggtacacgatacagtagttagttttaaaagtttttaaaatattaaaaaattgaaagtatttaaaatatttttaaaatattttaaaatctgctgtgtgagatagataggagacctagcttttcttccttcttaccttgatccatagagaaagcaaccctgaaagaagaaaaactcacccatttgagctttcttttgtttccactgagcaatacggaagaaattcaccgctggttataggtcttcagtgctttcttcagagtgggattgttttttgtttcaccataagtagtagtctattaaattaacagttgctagagaagaagctgcatctatatatgcagttctcttcttgtcaagcagtatattttcacgatagcaatgaaaaaattccatcctcaccagccgctgaaacatagtaatactgcagaaattcctgtgaactatgcgtttgctgcttccttttgtttgtttgttttcagagcagatgggcttgtttgctttttgcttaaacattaatcaaaaatcaatttatggctatgtaagtggcattagataattctcattctgactacagtaaataatatctatttgttcatgttagataagtctgggcggcagtggaatgtaaaatagaattacatgagatatgacatatggctatgtgttttataaattaatgcttttatgcatgtgggaggagaagtaatttagcttactgacaaaaagaaaagcaaaggaaattccagagaaagaacaggataccaagtctaaataaatttggaagacaaagagaatatcatagtttagttcaatcttttaaacaaattgtcacaatttatacgttgggataagagaaccatgagaaaaggtatattctaagtcctgaacatctttctataccctgaagatgtttttatagctcttctgctgactccctgccaaaaaaactatttacggtttggggtagggggcgtgtcatgccatacagctaaatacacttttttcctaatctaggaggcatgtctacttacaaataaattgcttaaactagttaggcttgtgtaaatgtaactgacatttccttgagatcagaaaaagttttgctgattaactatatttgtgtgtgtgtgtgtgtgtgtgtatttagagagaaggagggattttataattattacaatttgatttgaaatgtctagagaaagtgagagattatggaaattaccataaatgctccctttttcatagatttagatctgttaattgcaagaaatctttttttaagtgaatcaatgggaactttttatttcttccctaagattcatttagccttgaaaaggccaaaagttgaatgaagcttctaaatgccaatctttccctccttctgttaaagagtatgcttcaactataattacatttgcattgtttaaaatattagtaattctacagccagacctctgagatagctgagaaaccaaaaagtgaagttcaaagacatcatcaggcaccctctccacacacaacataccaggcccaccaaggagtttacatgagtgtttttgccttgttagccgtggaacgacctgggcagtacccaaaacttagcaaactcttcttgtaccttgtattcagtagacggtcagtagcaccgagagtagggagaagagtaaatatgtttctaatactttattcaatgtatgttgttaacagtgtagacactctgactttccttgtgaattgcgcctcagtatttagttttcatttaccctggatcagatagggcatgataacctttgaggggctttgtgcatatgtaatttggaatctgagtcagtcgggctgtgtctctcccaacttcccttctcatattcttctctctcctcctcctcccctccctcctcctcgcctccctcctcctccccctccctcttcctcccctccctcctcctcctcccctccttccttctcctgccccctcctcctccctcctcctccttccttctcctcctccctcctcctccttcctcctccccctccttcctcctcctccccctcctctctcctcttctctcgtttctcttctctctcttctttctctcttctctctctaccattgctgtcagttgagatgggcctgtgcggcactttgtttgcagttgattggcaatcttctgttctactactgcatctgaatcatcacttgcttccaccagttctctgaatgtcttacctagtgatcctggtggggaaattacagtgattagtgttccaattcttgtttgcccataagtgtttcaaagtagtatttttaaaaactcttctaagacattctctcttctcatagtagatgcagtgaatcttaaaggtgccctaactaaaatttttgtgctataaaattggcagctttacaaaataaaaggttcgagatatgagcctgatcaaggctctgcatttgcaacaatatccttggtttgcctggccctgttatattttgctgttgtgatatgactcctgccagtgctatttccatttaacctttgtttttctaaaagacagtaataatttttcatttctagggagtctctgacatcagctaaaggaaagacacttttctttgactgtatatacatttctccccatttcattaatatcaaagttgctctttcaaatggcttataaaattttaaaattacaccagttgcataagcctgcataaaaagcagactcctacataagctgacaatgcatttgtaccgtggtgttgagcagttttaacatcctccgtgcctctgtgcttctgctagctactgctctgataaagttatcaaggtatcattggatgcattgaccaggatgaagacacaacagtatggccttattaaatttggaaataatgaacagacgagtagagaatttaggagcaatataggcaagcttaataggtctttactttggggcctgtaactccaactacatatggaagaatttaagtacaggaaaagttaagctcttttcccagtagttctgctgacaagttgggtgacttcgggatggttacctcttcatgataccacacggtgatggtaacagaggcactgtccagtctctggttcatgcacactggtcttctcaggggtccctgtataggtgacacagtggagaacagggcagtactgccagactcagggacccagttcatcgagaggggcagtgtttctcttatgctgccttaaaggcattggatgccttttggaaagccagtggacaactcctgcatccacccaagattaatgttaacagcttaaagaatcattgcaatcaagggaaattttgcaacactttgttgggatatttttaaataaatgtgtgaacaccttgttttaggcttgctgaaaatgacccaggaattccttgacccgggaatatagtgtatggctgccaattattatattccttcatcagacaaaggcggaacagttcactctttttcttttttttggacacaaattctcactccctcacccaggtcagagtgcagtagcatgatctcggctcactgcaacctctacctcctgggttcaagtgattctcatccctcagtttcccaagtagctgggatttcaggcacgtaccaccatgcctggctattatttgcatttttagtaaagacagggttttaccatgttggctaggctggtctcgaactcctgacctcaagtgatccttctgccttggactcccaaagtgctgggattaaggtatgagccaccttgcccggctaccggacagtccactctttacaggggggcgtcttggtataagtatggaaagctccgtagatgccgtgtcagtccataccctcaccaccttcttgaccctgtgccgataaactaagagatgtgggcagtgtaccatctggaaaggaaaaggctttggagccaggtagtcctgcctgcatttgaatctgctttctaccacttacttacatcaggttttccttgtctataaaatggaagtccttgtacccaccacctagaatggaagtgaggattaatccagaccaacgatgaagagtccagcatgcaggaaatgctcgtttataaccatggaagtttcgaggacttttgaaattcgatgacattaacctttgaggtgcattttagttggcttgtgtgatgaggcctttctacttctagttccagaatcgtctggatctacattatgtgggaatgtttattcccccctttactttcccaaaatttgctaaacattttcattgctatttgagttttttaggagacatactgagatgaagttagggatgtgaaaggtttactgaggataacaccaatgaaaggaagagaggaggaagatgatgggtgtggggagcggtttgaccaggactctgataggacagacactctgccagccctccgggagctcatttgcagagccccctgttagatggatataaccgggccctgggaccattgctgggctcagttactggccaggagctgcctaggaagagtgtgacctaggccaaaagttgaagtggaccctagaagagctagcagctggagggcatctgctagtgacactctggagctggacagcaagtcctttctgaaagaggatctgagctgagtatccctgtggtccagtatttcaagttggaacctctaggtttgaaaaatacatgttttgggtgagagtttgattattcttaaagggacatatctttcaaacatatggctgtggaagaggaaacttgtttttgacttgtaaaataccagcagagccttgcagtgatcacaacttatgtgaaatacagaccatcacccacagtttacgtgttcacactaaagtgccagtctctctatgggttttagagctgatttagatacatgcattgctaatacagtcagcccagccaagatagtgccatcctccgcaagcatccactaaggcatggagtcagcttccgtcattgttagatcagtacttgtttctttcccttgcttatttttcctaacctctctgaacctgctgtgttggaagcttaaggaacatcatcctctgttgggcagaattcttccatggccaccccagcattatgccccacaccatttgacttactcatttgtgaatgccaactcagaatgtattgctttgattcttgattaggatctcaacctctatttattgttaagactatcaccctttgattcccccccatcccattgtgtccttctaaaggcacagaatagaacatcttctgccagaaataacatacaaatttatcatcatacaactgtacaatatgcaaataacttgctagatgatattactgaagattctacatccaattaaaataaaaagagaaaacaccttaagataaccatactattaaaagatacagaagacaactggaataaatggaaagacataccacatttattagacaggaataatcatcattagcaagatggcaagatgtcagttctccgtaagtttttcaatttaatataaatccaaatacaacagatttttttcttttagttagattctgaggttatcattaaaacaaaaacaaacaaacaaaaaactgaacaagagcaaggagtccttaccaggtattaaaaacttccatagtgcctaaataattaaaatagtgagataccaatagatgaagagacagaccaatggaacagaatagaaagtccaaatgtagatgcaagtacctgtggaaatttagttattcgataaaggtagcttcacaaatcattgggactaagataaactcttgatttactggattggggcatgtaaattatggcccaatcatgccatgtttcttttctctggaaaagaaagtaaattaggttcatacattataccatgtaccaggctagactccaagtgaatccaaggtaaaagtgtaaacaaaactatgaaagtcctggaagaacacatagcgagttcctttttataaccttggagcagagaaagcctttctagtttcaactcaaaatccagaagccagaaaagaaaacattcataaaaattgaatttaaattacaaaaaaactttctgcatggccaaaaaccataagcaaagacagatgccaaactgagaaaaatatctgaaacttctatcacaaagagctaatctcccttgtttaaaaaaacaaagtaaaacagagctcctagaaattgttaaggaagaggctaacagttcaataggatttgggatgaagtattgaacagatagctcacagaagaagaaacacaaatagctaagcatagaaaaaaagtttgatttcactcatacgagaaatgcaaattaaaactacaccaagataccattttttcacttctcatattggaaaaaatccaaaatatttgataacacactctttggaaaacaaccccacatggctgggaggacggcagaatagcacatctatagaggagaatttggcaatatctctcaggttataaacacgtattctttgacccaccaatcttagagggggcatttaccccatagacttgcacacatgtgaaatgacagttgtgcagttgttcattgtagtgtttcaaatggcaaaagatgaaaatgtcccccaaattccatcactgagggaataagtaagttagggtgatagctcccaagcttattttctcttcagaatcacctcatgaagaaaatgaaggtctgtgtgatagtagctggcaggtgggcatggtggtgagggtggtgtttgagcggagacctgaatgaaggttgagaaggagccagccactcacagacacagaggaggccttcaggctgagagagcagagaaggaccctgtggcagagacaagctggaaacagcactgcttccatggtctggagactggaatatgtgggttctgcagacacctggggggggcaccacctggtaaatctgcctttcagctcttggttcttccagcaaaccatgccagctgtggctctgtagccatgtcctcggaagatggcagaggttgcaacgaggcctctctgaggtgctctgggagcacagaggagtcaggtggaacttgtggcatgttgccaagggaagaagtgatttttagacagaataggaatttgccaagaagagaagtcagaaaagcataactggcagaggaagcagcatacgttacaagtaactgcatgtgtacagggaatcactgagtgatggacaagggcttggcacttggtgggggggggtaccatgttaacatgttagcaagaaactaggtaggggtacttgacttgggggcagcagaagcaggtgtgagtgttggacaagacgagaactgagtgctgcaaatgtttggcaagacttgattgagtgcatattgtggacctgtgtctccactggagacacaaattagaatataacaccttgccctggtatgctcagggtctactgaggtggagaaacctgcaagtagagtcggagtacagtgttgaaaacaccatctgcaaccttaacacagtgctaccaaaaccgatttcggagcactcctgcaggaagtgggctggccagggcaagggaagccgtggagaacagtggcctctcccgggcaggcagggtaaggcctagaaagaataagctgagtgaaggtttgtgtgtggcccatccagggacctgcgacaggaacacagcggctgaggaacggatgcttggagaggagggggtgctttacatgccaggcgggcagggccggggtggggccagatgctggaggagagggctggccaaggggtggcagagaggccccccaggtggcaagtttgcaccctgttgcttcctgcaaggagcttttgtttacgttttcagcttggacagtctggctgtctggccaagagtgacaacgtgacttaccatcagagcgaagcaccaaagagcacataaatgaagtggagatccctcctgtgtccagcctccccctccccgtggccttctcctaccttcccagtcctccatcagtaccccggggccttgccagaatctcagaaagaatctctggactctggctcaggacctctgaggtgattatgcatctagaggcatccccaggtgctgcccaatttggggaagcagcacttcccgctggaagctgggaagtttcccctggctgggggtcctgtgaggatggagaggccagaatgaggaatgggttgtgagtcaagaccaaccagaaggggacttagcaatgtcagatgatagcctgggtgaactacatcctgtgtggaaaaggcaaggtgtaactgcttatttcttgtcaagtgagcctaatatcatcatgtttctttttatgcctgctcccaaactcagcccctcccagtgagatcacagctccaggaacttgcaaggaaagggactaacggggcatctgattcacccgtgtgcccttaatggcgtattgtgtgaataaagcaacaatttttagtacagggatttaaaacaacttctgcaaagacagaactaaaaattaatcttaaaaggtggagggttggggtggagggcaggaaagaggaggaactaaattgccattctctttggagactttctaaaacctaagacgaagaagaggagccgaattatggaaacaaaacctttgcggttttccacagaacaaaaatgatgtgaagctgcaagtcagcagttctggcgcaggggctccgggggacgcccgctccgccggctgtggtgtgcgcccttcctgctctcccctccgaggggctgaggctccttttgtctggcgcgcgcgccccaccccgccccgggtgagggaagagggagcgggcaccccgcgcccgcgccgccgccgtggaccaaggttgtttactactttccactccgaataacacgccaatcaccagggcccaccctccccgccggccaatcgctgcgttgggaaattccacctttccgcggggcccgggcagcgactggctggagtgtctgtcagtcaagtgggcatcccgcaaggatgcagcaggagtattagggaggcgatcaccagagcagaggaggagtaaccttccccataaacaagatgtgttccccccactaagaaagcgggtggagggtggaggagccaaaacacatcccagccccggggccccaccggagcgaagcgggccgagcgcagagtgcagagtcggggaatccctccctccgcctcccgccgtcgctgcagttgtaaacacgtttccctccatgtctgttttcccttctctctcaccgtggccattacgggctgctgtttacaaaaatcctgcaggcctttgacaccccgtcctcccttcccccggcatccctgcccttattctggctttcttctcttccatctcctggtgagcacagcatactgttctcaggcttgttttccttttattgctctccatgtgggacaggtcatgctttatcaacatgtaccattttctacaaatgccgcccttcctctttaaattgcttggatgggcagatcgattttgattagcaacactgcagcagaaacaaggtgcatctctggaaggactgggtggttttctcgttattgttgctggtttgggtcacatcggatgctattttaaattctgtgttttattccacgatgggtcttgaatcctttccctattcctaggtttgaaatatgtttcctccctttaaaaaaaagaaggggggcagtattgtgttgaaccaaatgtttttctaccttctcctgtgatctgaatcaggtttcccatttccagcagtacaatgtggttgtattcagtgtgataggggcgtagtggacatgaattatttgcgacagggctgcctggaagatgcggagcggagtttgcgtggcccggagcagctccagtgtctgaggcttctctgtgtcacaggctccaagcaggaagcgcaggcaaaatggcaaaatacagcatgtggcattcagttcaaaaatgcccttttttagaagtcggtattctaaatgacatccagtcttgcttagttttttaagagaaaggaaaaataatctatgaagatggtttggaatattttgtgaaaagccttttcagcataaaaaagatgatcttgagggtctggtttgcggagtggaggataagcctccctcctgcgattctgaattgctttttggtttgtaggaatttcaggaacatgttgcaaagccgtggccgcttgaaagggtcggtgccctgcgccccgtctcagcccctgcggcccctgaactttttcagtgatggggcacttggggagaagtgcggggagtggaggaggaggggaaggtgcattgcaaatagaaatgtaaggcgtggcctgggtggccaggatgtgccagagcagcctccagacctacttaaatcccaggaaaagtcctgcctcaagttaggcacaacatctgacttggatttctctctgtttttttctcttccagttgtctgtctgtgcgccctctcccacaaggaatagttttccacactgatggaattaatgcatatcgtggtattattggtggaatatgtttaacctttgtttcgtgatttgagaggaatggttcttgtgtatcgtgtggtgacagcaggttaaggagagtgtcagagctggtgcagagttttgccccggggccatgaggttctgggcatcatgactctcttatgaagttacaaaactgggcaagtgattgaaggcagaaagacactgtaataaagtgtgctccagtgatgtgtgctccggcttctctcccttactcatctgggccaggtgctttcgccacagtgagcctgggtgtcccctgcctgagatgagcacagtgatgtctatgcgaggttgtaggactcagtgaagtgccttagggattttgcctggcactctcctgggctcatgaggtgcctagggctgagacttccccttctctgtctggtaaatcatctctcccattctttcttctgcggcccttcatatgagctttgtaatttactcagggtggcagggtgaattcatcttttgctgggtttctgcatcacctgctcctttctggccaggtcagcctgttcattttttccatgccaacagcctctaagtgccagtaagtcacgtctgaacaaccaaagcatgtttccctgcgggagaatgccagggcaggcgggtctgggagccaagaggatttctcctgttcagataagtcgggggaatagaagagccctgtgacttgagacaagctttgagtgacacccagtgaatctcccatcactactttaatccctgccccagtgttctggttccccctttcctgcatgaggcagtacgagtaccctggcctggctttgggttctacacggtctgactttagcctgccttggtctttgttcccctctcactccctccacccctgccccccccaacacatgtggagtaccttaccctgccttcctagttctggaatggctgcccctgtgccaggccaccccattttctagaaccaccttcatacagcccctgcgcatcccactgtactatttccttgtttgtttttcctgtcaatcttgccttccgcgctaatgggacactgatgctgtatggtgatgtgttctcccacagtcatcttttcctcctgtggttggggtggggagctttctctgtgtccccccatgagagtgaggacagtctcatttaatggcaccatggtctgtggagccaggcaggcctgtgtgtctgactccacttcagcgctctcagccagcgtgggcacctcggacccagacagacgccccgagcctgtctttctggagaaggaagtagtaataccttttccttgagggagttatgaggattaactgtgcctggccctgaattcgtgccttgcaggtacttaggaagtgagttattacaagcagtgctttttatcatccatagatggagatgttatctatgctataggactgcagaaagaattacagagaattatgtagaatcactagggacttgattaatatttgtttacctttcccccacatggattgatgtcctttattatacttttgtacccccgcttggcaagcccttgacaaatattgatccaacaaaaaattagctctttaatgtatacgtttagaacctgttgctttgtcagtagtggtttttatgaaaatgaatgcttataggtcagacttctggaaaccctaatctgagggaattgggccaaataggaaagtgagccccttaaaggcagttgtctgaccagtacttggagcacaacaggttcttgctaaagcactgtgtttttaaaacagtggagttattaggttgaaattctgaatagcaagaaaaagaataatggaagtgctgccagccccgtgatgctggtgcagctggtcagtttgcagaaggaggccagttactagagcagagtggccgtagaggctgcaacacggtggccaaagcatgaagctgctgtatagtggcaaggtcacagtgatttccccacagcctcggtttagagggagacggggtgtgctgagctgtgcctgcttctgtagaaggggccttctccaagtctgagtagccttaagccattaggactgctgagtctttctccacaaaaatatgtgggaggcctgcagggcaggtgctcaactaagctctggggctgcaaagatccagagccatgcccctccttggaggcaggtccttgtagacgaggacaatcgtagccttcctgattaaagcaggaattgtccaatcaggctatatgacgggcatcgtccatagtcttcaccaggggagcttttctgactatacatctctagccctgtggcttgagccagtcacttaatttcccctgagctttggtttcctcctcctggtagcagagagactatcagagtgaggggcagatgcaatagcatatgtaaaacacttagcgttgggcctggtgtttaactgcaataaatgttagctcatattttactgtgacatagatgctgtatgccttttgctgagtattaaagatactgagctgtagcatgcatacttgcatgaatcagtctgctaagttattttaagtttgcatttgaaaataaagggtggattgctatccaaatataaagaattggaaccaggctctaaaaggatgtttgctgttctttagcaaaataccattcttcttaagtttcattcaatcattccacaaaaatttaagcatctgttttgtcccaggcaggcactgtgcttgtaatggatgtgcaatagcaaacagaacacttgctttcagctcacacagagctgactcctgggcagagaatttcgacagtaaagaaatacaagtgtgatgaaggagaaaccctttggtactacctgctacatgttttaatatttaaatgttgacttagggaggtctttccatctaaaaataatgatttgccctttctcctgtaaatgacccctttctcttaagttttgggtgagagattttttttttttaaggaagaaagatattctacaatcgaatgtacaactgagataatgcttaggagagaatgtatactgggtttgtgccttggaagttgcttaggggaaacagttgtgtgcagttggaaagctgatgctttaaagaagcttctataaagtgaccccacaattaaactgttttgtgtacatctttatttatttatttatttattttttaattgagacagagtctcaccctttcgcccaagctggagtgcagtggtgcgatctcggctcattgcaacctccacctcccaggttcgagcaattcttctgcctcagcttcctgagtatctgagattacaggcatgtgccaccacacccggctaatttttgtattttcagtagagacggggttttgccatgttggccgggctggtcttgaactcctgacctcaagtgatccacccacctcggctttccaaagtgctgggattacaggcgtgagccaccacgcccagcctacgtctttaaaaataaatgtaaatacccaaggctcacagttccgttcttccatctagtctagcaccgtccagtggaagtttccaccatgatggactgttctgtggatgccctgtccagtacaggagccgctagccacatgtggctatggagcacttgaaatgtggctagtgctacggaggaactggattttggatttttttaaagttttaatttaaatttgaatagctacatgtggctaatggctactggacatcacagatctaacacaggattaactgacaaaattctttcctcttaaaaatatgtgtttattttgataaggataactgagacctgtacattccatttttcctgtcatatttagggctcataaagggggtggtatgcacgttttaaaaaatgcaacacaaccagttaaaccagctgtctaattgtacacatttcctggagctgttggtgttgattattagcaaatactaagtacttgtaatgacctaagaactataagacaagcaagtcgtcttctgtaactgagtatcagcggattcaagcgttaaggaaaatgattaagagaaaacaaccaaaaaagtcttaatggttctgtcaatcaagtggctatcaattcatggctattcaaaagcttttgtggctatgaaaataaactagattgaaaaaattctaaaacaaaattgaaacactcatttgagtttaaaattttagttgagttgatttttatttcttgttttggttcatttgtagtttccccccgcttcgttgtttcctcagatatggagaataaagcctggctggtcagtttcagtttttatttaaattcattttgtcttcattccttttaatctagcacagtcctgtgatgtattgggatcacagtgctctggggaaacattgaaatataaaaacattttcctgaaaacatttccagttatatttaattttcctccttgaatagaaaaatatttccaacttaatcctccctctcccctcttgaaatgaattgcatgctttggaaataacatcaatccacccaagtacacaaggacaatctcagccatttaatcgagatataaaggcttagagaactctgggcttcggaggcacagactccacctttcaggatgctaataaacgtggacgaggtctcgcctgggcttcctcctccattgttcagcgcagcaaaccagcacagcactccgtggccagggtttgcggggagaaatctctcactctgttttagtagcatcatcatccttatcagcaccctgcttttatttttgaacagccaaacttcctctttccaaacttcgtgtgacatctgggaccagctatgtttgaaggagtctgaacatgccacatagtggctcacgcttttaagggaggaaggccagtaagcctcctcaatggcagaattctactttcagtctaccctttggttctgttgtggttgttccttagaactttattctgctcattaggaagcccagcctccggggagggtttagcttctcatctaagcaagaagtaaaatgtcataatggaggaaaaaaaaaaaaaagtccaaactttttttggacttttagaaacacatccagtttgagctccactgagctatcattgcagttacaaagcccatgtatattgagatcggtgtaaaaattcagcatgtccacctgcataattatgaccagtgtattgaaagcacatttcatttagttttgcaacagccgatgaggtagattctaccaacattgttttacggaagaacaaatggaagcctggaaaaataaattgtctacctcacacacttcgcaggtggtaaacacaggatttgaactaagacatacttgattttaaagtgtttgcttttcctttgcactactgcatctgcgatgtttgcactcagacactctagaatatttggtgttgcatgtttttgccccaagaaagaacccattaaaatgaaactttccagttcgtaagctttgccctcaagaagggaaagaacttcttgcaaggtttctgaaacaaaaagaaaatgaaaagtaactttactgtatctgggttttctgattaaattacggtttttgcaagcttgtgcatttctcagtgtccagatagccaggatttttccttttaataaatatcactttaaaaaacaaacacacacattcttaaatgcatgattaactgtatagattgatttagttataagatgtcctagcctaaatataagaaggtgtatgtgttagaattaatttcttcaataaagagaaagaaattcaggaattgtggttctgttggtcttctgtactgtatatttttgtgcagccaaagcagcatgccttgcttcttggtttcatgaccacatgggtagtttcttgaagttttttcttttgagatggagtcttgctctgtcacccaggctggagtgcagtgacgcgatctcggctcactgcaaccttcacctcccgggttcaagcaattctcctgcctcagcctcccgagtagctggaattacaggcatgtgccaccatacctggctaatttttgtatttttagtagagacggggtttcgccatgttggccaggctggagtttcttgaagtattgactgatccttgactctgaactgtatgatcaaagacttttgaaatggcacaccgtttcttaacatttaggccaatttcagttgctcatatccaaaaataagtcatgattttcggagtcagtgcgcagcacttagtacaacaatccaaacccttgtacagaccatcctagtagaaatgtggatcttgagtatctcagcttcttagtagattttgaactccgtgaaagcaggagccaggcctctcacagcaagtctctccaatatgctcagtaaatatttgtcagatcgagcaatgaccagatgatgaaatacattaaagccttagggagaactgagactactgcaccagtttttgtgcactatcatgctggaaatctttccaacatgtattctgtacttctttgcttcttactccagtgaatataatttagtcatttctggccaacttgaggacatcagcgagcataaattgttgtattatgcataatacagtgataccctcaaggctgagtgggaggcagtttgccctctgctgaaggtttcttgtgcttattgtgttcttatggtttggttttaccatttttatgtctccatttctgtttaatagacttatttcagtaagaagagaaagccgtctccatcagcccctctgtaggtgattatttgccacttcctttttgctgtgagtgctttgaaaacagatttctaagcttgttagagttatgtgttaagagtaaataggcagtaagtgaaaccaagcttcttcctggtgcttgactaccccagaaatgtttatttgctgaatagttgagttctggaaaggtgaggtataaatgtgtgataaatttattcctttgcatgatttttttttctttttcttccctccctccctccctccatctatgtctctgtctttctctgaacatctctccgtctcagtctgtctctctcatgatagttgctggaataatttaaatgaatgtaactcatttacccacatcgaagcccaactcagtagtgaaaaaacaaatcttccaaatgaatgcactttccccttgatgtgctatatacaagaccttggcacacctagttcaatgacatagtattttagaagggcctccttacaccttcctctcagataaatatacatgcagggacattctgaagaagtttgttatcggtcttctcccctcctactattagctccgccctcctagtccttctctttcaccatgctgacccgcgtagggaggacccttacaccctctgcatgcagcgctggtgctccttagtgttcataaccccaacctccatggcctctctcgcagttctcaggttaggccctgcttctaggggacattagctttccaccctctactacatacttcctagttgttgcagcctttgcaagcaaaacttgttttcatttgggagacagcatggtctgacagagcctagatcctggggtgaagacattctgggtttgtatcccgtctttaccacctctgagcctctgatgctggacaagtcagcaagtctttgcaccttagtctcctttctgtaaaaaggagcttatggggatgtaatcagagaagccttagcatggctcttggtacaaggcacggaccaaatccatggtacgctcactcctttcctttcagtaatactgcctaaatagggcacatgtacctaaaaggattttgtacattccttgacagcagaattctcatcttctgttgcatatcccataatgctgggaacacaaaataaaaatggtagcttttcacattcacttttggcctcaattttttgttattccccaatgaggatcatttcatttggggctggtctccggaaaaaagtagatcaagcttttcagatgagatttgggtgaaaccctgacaaactctttttattgccttccctaccacatagtggtggatcaggaaactgtagggcttatgatgctgggaaatttctgctaatgcaataaagatttttgctgttgaaagaatttgatctgttttatgtataacatgcagagagcagaagcatatattatctgtagcagatgatagagcagggtatatgggcaagttagaaaaacacagttctcactacatttgaagaaaaaggacaaggagttgtcacaaggatccaggagagtcgcacataattttctgtcgtgcattttgttgactgttcctctttgcatccttcaaccatcttaacttcccacttgcacctcgctggaagacaaatctaagctaaattaaatgctaggcaatatgtcagaatggaaagggccctcaacttgggatgcccggttctctaccagcctgaataaactccagcaacagtatttctctaggaatcatctgtaaaaagtagaggtttgtcatatctctaaactagggattcaccttatttattaagctatcagtgactttatcttgaggtgcacggcttttagtaactctggttcaagtgcaaggaatgcaaagttaagtgtatcattggaggtgggatttttgagtttgtcagtcatttattgatttgcatgtatccttatagttcaaaggtctttttctcaacttagttgatgatcatgctgtaagttgttttcttttgctttatcaacttttaaaaacgtttattaactttttaatttgaaataatttcagacttgcataaaggttacaaagagtaccaggagttctggaacaccctccacccagcttccacagatgttaacatcttacataaccgtaatacggttatcaaaacagtgttcactccatactccagtgctgttaatctccagactgaattcggatttcactattttcccactgatgtccctttttttggttccagatccaagagacgatcctacctggcatttattgtgttcagtttttctaattctgggacgttttcctgggttttctttagtcattcacgaagttcgcacttttggagaacatggggccagttattttgtagaatatctttctgttagagtttgtggatgtttcctcctgattaaatttggggggtacatttttaacttggagatcacagaggtgctgctgtttgtgtctttgcgcatcctgtcaggagatgcgtgatgtttcctttcctggtgctgttagctttgatcccttagttaaggtggtctctgtggcttcctccattatcattactatttttctctttgtaattaggaagaatcttttggaggtagatacttgagactatctaaacaagcattctgttcctcattattctttcacccactaattttaacatccattactgtgatgtttgccaaatggtgattttctatttctgttttctacacttagtaattggattctactctcaggattttatgtattttttaacagtgagggacataaactttttaactagcagtggcaagtccacttttatttgggaggacaattactagtcacatgaagaagaaaaaatatgcagaagcttaagaaatcccacatatgaatgttatttgaaatgttcttgccctttctccctacaaaggaggtgaagaagatgacaggagatgttaattgccaaaatagtctcatagttttggtcctggctgcaaatctctcgtttttgatactcaagagaatgctattggggaactgactctgaagcacagcccagatgcttgagatgggttgggaaggtttacatcaacaccatgaatttaatttatcatgtgacattttatttctgagtttttaaagctgtaattaaaagaagtgttcaaagtgttgctttcctcttttagaataaacgtggctgggtgtggtgcctcatgcctgttatcccagcactttgggaggccataggcaagaggattgcttgagccaggagtttgggaccagcttgggcaacatagggaaaccacatcactacaaaaaaaaaaattagcctgtcatggtagcatgcacctgtggtcccacttacttgggaggctgaggtgggaggatcacctgagttcaggaggtcaaagctgcagtgaggtgtgatcatgcccctgctctccagcctggacaacagagcaagacactgtctcaaataaataggcaaacattaccaacatggcaaacaagttggaggaggccccctatttaattaaatttcagcagtcccaaatctaattggtatgaagaaatcattattcagaattttccatcactgaaatactaaaatcacttgttgtttgagacatcttggcctgtcacccaggctggagtgcagtgttgctctcatagctcactggagcaggagcctcaacctcccaggtttaagttaatgctcccacctcagcctcctgagtaactgccactacaggcgtgtgccaccatgcccagctaattttttaatttttcgtagagatggggtctgtgttgcccaggtccctcttgaactcctggcctcaagctatcttctccagtcggcctcccaaagggctgtgattacaggcgggagccacagcgctcagcctaaaaataactctttagccaaaagaaagttttaaaaaattgtctgttgtattctttgattttactctatgtggtcttttctattatttttaaaataaaaaagatttatactcctcaagtgtaacattttatcaaatctcatgcttctgtttgatgaaaccgaatggctaaattttttaaatatcatgcaatccatcccagtttgtaattttattatggccctcacacaagagcgtgcaagctatactaagcttcctgtggccctcgtttttcctcactgatatttgtaactcattccaaattaaattttaggagtctgaaatgtagctgttatatttgggagatgtgaagaaaagaatcgtaggcatctcagtaggctaggtatcagatcacacatgcttgctggaccaaagaggactccttacagtaggatacatgattctgagttagtttgtgtactaagtatatactatatagcttttgaaggggagacgggcacagaattcacaatatcatgcactaagggttattttgtgtttgcagtttccagatgaatgttttaaagttggctgcagaatacagcgagataggtaaaatctatttgagtattacttacagaccccaaaggatatcccaaaggatatgttggactaattcctaaaatatcctgtaagtcattgcaggtacaggcgtggatctgggtttggaaacgccgcctggatcgctggctgggctcctgcagccgccaaggaggggctggctggaggtggggctcggcgtgcatagcggccacgtgactgcgccccggccacgcccaccgtccctcacgtggtcccaggccacgctgggcttcggcatgtgctaaagtggatagaaaagggagtggggcccgggcgtggctttgtggtttgggaagatatgaactccttggggtttttttctcttttaattctttaattttgatatttggaaatgcgtaaaaggtttttcatttgtccttgaccacgtggtccaaacctcaatttccctagcagaacgcggtttcgatcactggtggatccgtctcacagcaccagtcatgctgcctcgctgggaagtggagggctcaggattcccgtggttcacgatccattttatgttggaaggaaatcattttgaactatctcagtacacaccctagtgtatctttaaacctaattgagtgttgatggaaaatctgcggtccgagaaccgtaagaaaagggggctcccacctcccgctctggggtcgccacttgcctcgcaggcaggaggaggctcccagagtagatacaacttgcccgtcacccggatgggttggtagtgcacatatgcacggggcgcagtttaaaatgaaagtaaaagatgcaaatgtgtttgcaaaagaaaaattaacataggatacgtgcgggcgttctcagttgaactcggtcttactgttccacgcgagcaccccatgactcagagcccaaatctcagcggaacagcccaggacgctcctgccgtccacaggaagacgcctctgtctctgtcccccgccgccaccacacagatgcacgtactctcttcacttccgtgtacccagtaaatgcagatcctgatttaaatctgcagcacgctgctttcttcccattgcatgtgggaagcttcaggttctcttcggtttattttctcatcacctttattaaaatgcagtaaagcaaggagtatattaatgcgggcctctgcaaatagagggaatttattgaaaagcagaatggcttgaaagattgaacttcatcttaaaaatcagaaacagactcttgttattaatagctttagaaacgaaaatctaacttctgataaattatttcagaggagtggttcaaacgtgtagtagatagctctgcctggtcatcaattatagtgacgtccttgcatcagctccagaaactcagaatattcatgagctttccagtctgactcagaccttcaggagccatgaaattttcctgttgggatgagaggaagcgctggcggtcgtttcggcagcttaatgaaaccagaaatagataagcacgagtgaggggtgatgtccgcttgtttgctcccatcatgttgtttttaatgtgtgaaagtgaaagttttaaaagtcatactaaatgtgtgatcctttttagaattcactgggtacgggtacgtggaggaagtgtttttgtttttgtgaatttgtttaaacaaatgactgaggctttgttttccactctgtctggccaagcaccattgctacacttttttaaattcatgacatcctgagcagtgaagctgttcttcagcccgcctctccatttgtgactggaagacaaggaggcagacaccaatggcgcctctcacaatggaggtttatttttttttaatctaacggagggattgtagatggtgtaaaacttccttgtgccaggagagaaagggggagagagagagagagagagagagagagagaaataacccattctaaacaactttaggaatagatgatccgtaggcatcaactttgcgcagcaacaaaagccactttctgaacctcgttctgtgaagttttaaaacaaattgggtttgtttaattaaaatatttcttaaaggcaaaaagcactgagctaatttttaagaattttaagttatatattaatatgagtagtgatttataattttctgttgaaatacataaattcgagaagccccacccctaccacttgccagtcttgagtccccacggctcctttgcctaggtctaaagtcactgcttgcacactcctgccttgcatatgccttgccatcgtgtgggcctcttggctggaagtgttcttgtcctcccgttaggtatcttttatgacgtgaatccttacctctaattattatctgtgtgtacatctcatcacctgcatctgactgtgtgccttgtgtatgtctcttagccctcacaattgcctgacatgccttacaaacgggtagaccaagtgttaaatgaacaaatatttaataagaacttaaaagctttttgactttatatatttttaaagccattgtgattaaacactatgtttgatgtggtgctaattctgtgctttatcaactgtgtgaattgtagtatttttaaagtaggaataattgagaaatattttgaagttaggttaagcatagcagtaaagtttccactttttaaaatagccaaatccaggccaggcgcagtggctcgtgtctccaatgtcagcactttgggaggccagggcgggcagatcgcttgaggtcgggagttcgagactagcctggccaacgtgacgaaaccccgtctctgctaaaaatacaaaaattagatggttgtggtggtgcatgcctgtaatcccagctactcagagaagtgtttgaacccgggagttgggggttgcagtgagttgagatttcaccactgcactccagctggggcaaaagaatgagtgaaactctgtctccaaaaaaaaatcagagcgtggtggtgcacacctgtagtcccagatacttgggaggctgagatggaggtcaaggcttcagtgagccatgatggcaccactgcactccagcctggacaacagagtaagaccttgtctccaaaaaaaaaaaaaaaaagccaaatctgttgggtttttttttttggggggggggtcctttagaatggccctgacagatctttaaggcatggaaatgagccttatgcaagctcctggcaatcagtatgtgagttctgtctccttggcaagatacagcctcttagaccctcagtctggggaaataatgctgatttctcctacgagttacgagaattacgctagaaaactctgtggcgcatacaggtgccctgtagcctgttggttagaagcactgaccctgaagtcaggtcgcccaggttggaattccagctctgccttcttcaagctgtgtgactctgggaagtcacacacactctctctttgtgcctcaggctctggttctgaagatgggaacggcaggccctccctctttggcttgttgcacagatgaaatctgacagcgtatgccaagcgcttagcacgggtagcagtgagtgccccgtaaatgttaggtaccttcctactactactaaacattcattcttcccttccctgctagtacctgcagctctgactcatctcacacccttgagagaggattatcttcattaaaaagtttttggtctgcccagaagcaagtgttacctgtgagagagctgggcttgtgcataggttagattatttctttgggttattcctggggaaacctgcaaagaaatgcagccagaggcctctggttcattttactgctcatctcctaaaagtggtttctcagatttttatcctttttttctctttttcgaggaaggggcaaggaaatattttttcatattattcttgtcatcgtctatttatttaataacagttgactgttgaaacataggaaagtacttatccgccaggaaactcccttctattattggacttacttgctttccatttatatgttgtctaattccaaagagatttcgagacagctttcaattaaaaaaaacaaacaacaacaacaacaaaaaaaaacaccacataccgcatgggtattacacaggacctgtatggtcaaattggcaacgaccacaccacatgagaaggaagattattcttcctggaacctggctcccttgagattcttttttttttttttttttagacggcgtttcgcccttgttgcccaggctggagtgcaatggcacgatctccggctcaccgcaacctccacctctcgggttcaagcgattctcctgcctcagcctcccgagtagctgggattacaggcatgtgccaccacactcggctaattttgtgtttttagtagagatggggtttctccatgttggtcagggtggtctcgaactcccatcctcaggtgatccacgcgcctcaccctcccaaagtgctgggattacaggcatgaaccaccgcactcccttgagattcttgtaagccaaggcagaagaagagacatcttaaagtctgtatgtgcacacctgcctccccccattttatatacaattcaagggctttgcttttggaaagtttgcctatgtagtcgtccagggctaaattaacacctgtctctatctgtgtgtaaggctctctgggaggagctgtgaggcaaataaaaataaggaatggtgtcccgcaaggagcttacaatgtgtgcattacaagtatatactgagcatggccctgggaacacagtgaaaaaacaggattcctgccctagtacagtgtacactagtggaagagagagaggcagtaaacctaaaagtaagtcttttaaaaactgtggtaaaatgcacataacataaaatttaccatccaaccgtttttatgtgtacagttcagtgacagtaagaacattcacattgttttgcagccgtgaccatcatttatattcagaactcttttcatctcgcacaactgaagttgtacctattaaacagtaactcctcattctctcttccacctaggccctggccaaaaacaaaaataagtctttgattgtaaacacgatcagtgctttgaaggagatgggaaggatgttatcataaaatgatggggctgcaggaatggcacctactcagagagggcggtcaggagagacctcttgggaatgatgacatccagcaggcaggtcattaaggcatctctaggcaggtccagagtgcaaggaggcataagccaggcaggtggaacagcgtgtgtgaaggcccagagtcaggaaatggtctgcttccttccaaggaaaagaaaacagccagtgtggttggagcaggggctaggagagaaaagatgtgcatgtgtgtgtgtgtttgtgtatccccatcatgatttagtactgtcagcgcttctgtgttctgaacctggagtacaggcagacacagccgcatcccagaagctcaagagtgcccataccaggaaattacagaaatctttgccaaatggatgagtgaatgcaacttccttgatacagggtcagagaggggaaatctgagaaaagcaggtgggcaatgtactcctgacatactcccttccgttgcaatggccttgagtgatggagcaagagtgaaggaatgttcccatggcactggcaccaggatgactttttgtgaagcagagcagttggtcttagatagtggaggtgcgggaggcatgagaactgggcagtctgacggctgcaccagccagttggctgtcctttccacctccatgcccaggagctggcccagggcgcgcatgcacaaagccagtgctcttttcaatcagaaaacagcctgcgtatgttcttgcttgcaactcagatatccagcccactgatccaggaagagattcctttgacctgggaagtcataatggcagatatttagacccagctctcaagcaagcatccaagttgttccggtgaacccgtaactttgagtaacctctgattgaaccagagagtaggaactaggtgcagaaccttgttgaatagaattgtttagcatcgtccatttgttagagcatttcaggatgcctgtcctaaaatttggtatcataatggtatttacctctcactcacctccatctcagcccagtaattaataacaagggacttgcttcttcacctgtttctttattggttgtaggaagtcttttccttaccacagaggaaggagcttctggatccctttgctacgtccagagagttttcatctaatctgggtgtattagtccattttcacactgctgataaagacatactcaagactgggcaatttacaaaagaaagaagtttattggactcacagtttcatgtgactggagaggcctcaaaatcatggcggaaagtgaaaggtacatctcacatggcagcagccaagagaagaagagcttgtgcagggaaacttccattttaaaaaccatcagatcttgtgagacatattaactaataacagcaagggaaaaacccaccccatgattcagttagctcccggcgggtccctcccacaacatgtgggaattataggagctacaagatgagatttgggtggggacacagagccaaaccatatcactgtgtaaaagttgaataaagttatttaggagcacattgtattgggagtttgtttgtttgttgaagagccaagtaaagtcattggaagcatgggaaacttttttccctgtctaaaaggaactccttcctagtggaagttgaaagctttcttggcagcctcagcccccaccctacctccaccaccccagtgggtacctgcatcctgaagacccttcacaatagcatctgaactatactgggccttcaaatgatgtcttgggtaaacccatgtccaacctgcactaaatgaagattattttcgagcgaatggattgaagaacagtgctgaaaaactagaatttgtaatattttcatttgagcagaggtgaaatttgaaatattttagaatcttgtcttatgattttttttctttctttgccacatagccctcccctggaaattaaatctgtggattactagtatatgaactgatcagagacatggcttggggtctccccatttacccacttcccagcacgttataatccactggacacctccaaggatgagagaccagcgggtcataatgcgagactggacatctctcctaccccatgtacacttcagctgagcaggcagaattagcagagtcaggactagaagttcagtctagggatcaaataataatagtagctaatgtttaaagagtacctaagatccgccaggagacatactcagtatagttccgtggtttgccacatttcatcttataccagtagcacaggtgaaatttgtcttatgtgtatactgaggaaaacaagtccctctgatacacagcagccaataaatgacaaagctgggatagaaacttacttcattctaacccgagagtccctgttcttgcatgggcacagcctgccatccccatgctctgcctcctaagcagaggatgaacttaagcatcttaaaattttaaacattgactttccctaaaaccaattaaaaaaaaaaacaaaacagacagacagacatgacttgtgcccttaaaaatgcagccaggctggcatataaatgggcgtaggctgtttctaaattttttgctttaaattttgccagcatagcttctggactggtagttttgtttgctttttaatatatttttgacactgtgtacagaggaatgctacctcgcgtcatcatgtcctcctccctgaaggcaagccaaggatgtcaaggggccacttcaggggatgtgcaccctgaaggtaaagctgctccagtgggaggggttggggtaaatgacaatgttagcagctggtaaatttttttacatgggatatctcacaagacttattgatgcatgttatacgtaataacctgaggcacatcaacattttccactttttcctattctttctgtattttcactgatactttttttcaaaaaaatctccaataagtttaggatcagcttcaagatttctctttaggtaaatagatttgtatttttgatggccatcctagtccagtgtaaagatatggacaagaaaccccacataaaggaagcaagatcgctggctgctttctctaggtagcttgagttgtatactaatttgtagattatttctcttcatcgaaaaaacaaaacattctgcagagggcagtcatgtgtccgctgtgcctctgctcctgtgtgcaccataaaacttgaaagtgagccagaatttgaaaatatcggattgggatgtgatttctttaagcctctggctaatttaatataaagtgtttacacttcatttttctggcagtggattttctatgtaggtggtggaagatttcctgtaagttttgcaagttccagggcaaagagagttgcaatatgcaatatctttctgtggtcacaccaacagaaagggcgatttcttaacctgctgcagttaccatgtgtgtaggtggatgctggctattacagatggtatcctttcaaccctcaaaattgttgcaagttcacaggtatgttaatgaaaatgaataagtggcatttttaggaattccaaatactgagtcttggaagtagataatcttttccctaaatgtatgctccggtcagaactgctgcctaccacacctcgtgggtgaaacagatatttcgagcatgactgagcttattaagagccctgcggcgcttcctctgccgggggtttagaaatttcaaaggatgggggttgagggagggaggagttatgggcatgtgatgtggacagggcgggcaggaggatggaagtaacaggtccaaaatgtatctttggtggcccggcagagctcttgcatggggtgagaatggtaatttaggaagagcaagtcttcccatctgtgaagcagaagaaaaaagtggacttaaggagaagttcgggtgctgtttatttagataggagtaaggagagtgcagttggggaaaagcacttcagaggctttacttagactagcagaagtctgtttggcagggtgggaagcaagtgcagttgggagaaaaacgttttcaataggcagtttcagaattggaaattggaggagggcagtccatttcaacatttccaacagtattaaagaaaatttgcgggttgtttgtcaaaaggggtcatatgctttaaagattgagagatcttttcggtgaagtaggggagctggggacatcgtgatgtgacaagagccgtgggctcagaggctggggacctgggtgtttaacccaactcttgtgagtggtgtggctttcatagctttggttctctggtcttcactttatctgccaagtgaagacatttgactggatgtcgtgatcttgagttgctttcagctccagaattcgaagaccccttccattgggcattcatctaatttcaaagatgctccctggctccagctctgcagtgaagcagaacaaactgatacagcctagcttgggggtggggagtcggccctccttttcccctcccttcccaggtcctctgggtgattgggggaaactgagaagccgttctcttctccagagcactccatttaacaagcattgcagagcctggctcgtgctgcagtgaacaaatgctgacttcagcctttaccctgggtttcaggtcacactgattgtttgcaaaacatgttctttttttgtcacttgccagtacttgttctctgtgagtaaaacacaaacacatcctcagggatgttgcacaccagtttgcagcctgcagcttctgccctctggcctgcccaggtcctcggctccgggacgaggatgctccgggatttcgggagacagcagttgttttgacatgaatctcaaagttcctacaaagcttatttctttgaagaaggccaaaaaaaaaaatgaaacattttcagatctttgttttcagattattcaagtccagaatgttggataagatttttgaagaagagatttatgcttgagattccttttagtttctttctttcttttcttttcttttcttttttttttttttttaggtgacttggccagtttgggtttttacggtgttcagggaaagggttaagaagttaatttgggaagtacagtcatgtgttgtacaagttgctgtctactgatcccttcattgagcaagtaaacttcacacattctcgtgtctgcaaagcatgtggatgcatgggcagttatgtgtatgaactttttttttttttgagaatggctttagtgttcagaccaaggatggaatgaaagatcacgtgtgctttccactgtagagctgccctgcttgttttgattttatagttattctaagtgttaagttccttcatctttcaaagcaaattcctttgatccctgaaaatcagctaatgtttgggaggcaattaaaagatgaggctgtggggttggggtgaaggcttccccagcaggaagagaggagaagcccactggatctgggagcacggtgctaggactctctaagcgtgacctccttcagtttggcccagagtggtcagatagtttgccggggcataggatggatgacaggcctcatacgcatcacgtctgaagggaaagcccttgaattttccacgctactttttagtaacagtaggctttgtcataattggcttcatgttccagctttcctaaaactgtaagtgatgttgggtgggccagcagcaaaataattcactttacaatttgcatgatagtctggaatgaaccgaatacctaaaaccaggaaataatagtagatatttaatggtttggggatcaaataagaatttactcccagatgtttcctaattaattggaaaaagcagaaggttgctggaaggccatctccattgggcatttacaggtgaaattcactcttcaactaggattttactcatgggatgcctgtgttcttcatttgaacccaattttacctatcatctacaaaaaaagaaaactattaagagttaaaaaaaaaaaaagagagagagagtcttgaactttgaaatccttcatccacgttttataaagtgtggggtcagattttttccctagttgaaattgaggaaatgagagttgccaatatgattggatttgtactgccaagatggggttttagcacttctaatgcattctggcaaggctggtatacttgtatcaagtgcacagccccactaccaccagctctaccacccacaaaaataaaaactagcaaaataaaatatgagccaacagaattctgtgggaatggcaagtgttttgtttttgtttttagtagtaatctttgcgagaacattccaaagatgatagttttacatttgtatgtttttttccgaggcacttttgaatcatcagatagattaaatataagttccatgtatttttgaaggtgggagtgttctttggtacagttcccccaaaaaactggttctcatgaggcttatgtggtaattctgttaacgagaatgtatgattatctgggatactctgttctgctctccatcctggataagagtttactttgaaagtctagttgatcttttgtgatttctgcacaatgtaaaaggtactttaacttcaggagatagggccagcaatcagatttgatgatggaaaagagtagtgtagcatttaagcataatgtatactctataataaatgtttacaagtccaaaagtgtgccatcagaaagtaaccagatcaaaggagaggtgaccagagaagctggaaagataagaaataaacaagtttcaaggttactgatctgtagctgttgctgtccatgcttcttggcagctttaattatgacagggagagggacccagagggagagagagagactgacttacacataaaggcattttatcacaaagccatctaaaacaaaagtgttaaaggcacaatgctgtgtttaaaaagcatgtacttctttaagagctcaaatttaaatatataatacaaacttaagatccaaggaagaaaatggacccaggacacgaagagaagttaacgccacaggtaatgcagatggccaagagatgtgtgaaaaagataatccagcctcaccaacagccacagaattgaaatgagatacctgtttctgcttctggcattgggaaagaaagaaaaatggcactagcagccttttttttttttttttttttttttccccaaaaaatttgctactcttgaggttctgtcaaagaatgtgctgtggcctctagaagcatttttaaaaagagactttcacaagtgattgtgcaaaattgtgaggtcactgaataggtgtgtatcctcctaaggaggtagcgttggaggagctgttcttgttcaatttactcagcacctgtgaagaggcttcactgtgatttgcctgtacaggtgtgcaggtaaaaatctaagttccacaggtagtgcaaaaaaatctacctccctaggtacctcgtacatttatcacagtttcctggtaaacagttctgctgttgttgacaaaattttatcagaaacattgcatactcttctctaaatagtagtttccctacaagtggctgtcttcagtttagtcgtttaagttatgttgacataaatgattatgtgtgtggcaggggcttttgcgtaggttgttgaaacattgcaccttttggactaacagtttttaccaaaataggcagaagtgacatttgcagccacagctgtgtggcattgagcgtctaaggtatgtgtaataggcagtgtatcggtagcattgataccttggtcaacaccagtaagccatgtaattgcccagaagtgggctctaacactagttttaggagatgcagccaaaacgacaaagctggaggcctctccctctgagcttggcctccacttggtcaaaacagtccccagtttgtccctacgggacacaggcctgccttgttaggaaatcagcaacatttaggagcccacaatacctcacataactctgtgtacagtaacagagaatggaaatagggctgtaagcatgaacaaccagtcaagttacaaatatagaatactctctcaattccactttagttagtcatggagggacagtgtgagttttataaacttataaggaatatacaaacagttccaaatttaaaataacttgaagtaacttttaagtgtgtgaaaagaatatttttttccaccctgtccatttaagcatctgtgacaggcagtattaagtgatgggtgtctttacgtacacatgcctgttgctcacagtactggggaagagttgcaaaatagtcacccattctgcagtgatttctctcttcttatttgtgaaagactcaaaaaaaaaaaaaaaaaaaaaaaaaaaaaaaacaacaacaaaaaaaaggccaggcacggtggctcagacctataatcccagcaccttgggaggccaagtcaggtggatcacaaggtcaggagagcgagaccatcctggctaacacggtgaaaccaaccccgtctctactaaaaatacaaaaaattagctgggcgtggtggtgggcgcctataatcccagctactcgggaagctgaggcaggagaattgcttgaacccgggaggtggaggttgcagtgagccgaaattgtgccattgcactctagcctgggcgccagagcaagactctgactcaaagaaaaaaaaaataggggggatgtgggttgtgagagcgacactgtgtgtccatgcgtgaagaaacccggctcatgatgacctcgccccagaacgccgaagcagggccggtccagcctggatttcacagtgttcttcattgcctttgtccttgattttttgtcgttaccattataacttatctctctttcccaaatgtataagtaggctttgaatatgagtttaaaagaaagaattcggggatgatttcagagtacactagaatattttttaaaagaatattttataaaaatacagtgatagtaaaagaagtagaaggccaaattccgcccccagccccttcttaatattggactttattcctttgcttttttcccttgctgccatctaaggaggctttctgtgctatagcatccagttcctctgccaggcatttctgtaaagatgaggcaccttccactgttttattctccatcattagagcacgtgtcctgctgactcggagcagaggggaggcacacgggggtgaacattccctgacagattggatgtctcttaactcttttttcctggtatcaaagaatggcacaatttagttgatttgatagcgttaccaaatcgtttttcctttagaatgaatctagaatgcagatagattctgaggtccagatgggcctctctccaccaacctgtgaccagtgtacctgtgattttatcactgcacattcatagaaaggttacagggctaatcttcccgtgatatgaatcatgaaagtcaaaatttatgaatgaaaataaaaaggaatgaagtactgatatatgccacaccagagataaatattgaaaacattacctatgctaagtaaaagaagccagtcacaaaagacactacctattgtctgattccattcatgtaaaatatccagaataggcaaatctatagcgacgaaaagtgtaatagtgattgcctgggaaaggggcgtgggaagcatggctaacgggtattgggtttttctttggggtgatgaaaatattgttaagattaattgtggtggtgtttgtacaactctctaaatatactaaaagctaccaaattgtacactctaaatgggtgagttatagggtatgtgaattagatctcaataaagctattgtaaaaaatgtgtgaaggaaggggaagcatcctataacctataccatcccaacagcccagctagaggacgattcctgagcctccttctcagcctttgtgttaattctttgcattgatgacttctctctctttacccttactaattagctctcaaaacctctatttaataatgatgctatttataactttcctccttctggtttcttgcttgccctttttgtggtgtttgcttgtttttcttttttctcaatactctgcccagcgttgcgtgttggttccggagacttaagtgatccagtgggcactgtcaggcaattatttcttttgctcattaattaagtgttcacagatacattcagcagccaaaccttgtggcatgccttctgtcccagacagtgagaatctacttggaacttggatatttctgtgagccttgattatatacaccaccaaggggatggcatagaactaagttttttcttcttctccacaacagactttgttctttaatttcacaagcttgacatagcctataagacatcatagtggtaccatagacagttttcccttgatgcccatgggggatttgttctgggacctcccacagataccaaaatccacaggtttatcagcaagggtcactgctcaattgcaacaactgaagcagaagctcctctcatcagaggcagttactgcagcatgttctgtagggcaaatataaccatatgtaagtgactgtgctatcaggagacagaacaacaagacccagaaagactcagtgacccacagagccagttccacccaaacaagtcttagtaatgagattagataatgagagtgtattttcttcatcaattcatgtagctcagcaaggctggaaactgcttgcacacttctgcagagaaaaaaaaaagttccatttgctggaactcaataaataaagaaggccttagtgggtacgtgttatctccttagcatcacctggatgcctgacccttttccagagtgtcatgttgcctgggttttgtccttcagtctaagtgatacacctcttagtgtggcggagaaaagggtgctgtatttcttcctgatggatacatgcttaaatggaaaagtagcatgagatgaactcccatagccccttccttttattatttttaaaatattcattcatttatttatttatttttgagatggagtctcactctgtcacccaggctggagcgcagtggcgcgatctcagctcactgcaacctccgcctcccgggttcaagcaattctcctgcctcggcctcccgagtagctaggactacaggtgtgcccaccaccacacctagctaatttttgtatttttagtagagatcggctttcaccatgttgaccaggctggtcttgaactcttgacctcaggtgatccacccgtctcggccttccaaagtgctgggattacaggcgtgagccactgtgcctggccggcccttccttttagacaatagaaacatgctgcaaccacataccaccataaacacggtgggggaagaggctgcaatcaacagtcaggaggatctgggttccaagcccaggtttgcagtgtaacagctgtgtgctcttggtgtgaacatttggtcatgtacaaatgaggataatgatactgcccccttgtgatcattagggggattaaattaaatgcagaaatatatgtgagatgcttaatgtgttgtaaggcgcatggaatatatttagtgaatattaactgtatattaatacaaagtcctgtattcagaatctccagtataaattacatttatatagtagagatatgaatagtttttgtgaacaagaagacctggaacttcaggtgactagaagctcagagtgagccagctatgtttgatgatagttattcttaagatcacacagagaaacggcaagcaagctgctttgggcaaaaaagagcatttctacactgttcagactgcctctgtactgttagaataggtctagggcgtgttgcgtgagtggtgactgagtaagatgttcagagggaagccgtgaccgtcatcttggaatattgtttgaaagtctgacctgtacaaagcagcactcacttcccctgcgtgtcagacacctgcatgagggctggggagggtccagtacaggaaagcgcatttttaatatgtgtatggaggaagttcgtcaagatgggtgccatctggcagtggagtagcacttcctggaaagtaatgagctcccttggactttgtttgaagagtcacccaggtttttgtaaagaagtgtttcagatcagtatgcaatggatgactgtaaatttctcttcagatctaagaatctgtgattggatgaaagggagaaaggactgcataagtgcttgttgcttgtaaactgggccaggtggatgtcatggccctaggagcttcttgcctgcctttgcatgccataaagcagtcctgcaacccagtgtcacctcagagggatgggaatgtagaagaagagagtgaatagggacagtgatgaggggtgaaaatatgtaactccttgccccttctgtataccctagtacattaggaagttcacccttgtctaggcttcctgttaggaagacagcagactcaaaatggagtctcaacccctttcaaagactgcaagatctccttgtacacactggacttgggagaaaatgagagctttcaggcctgctatcttaacaggttcagaaaggtgtggtccagccccctgactaaccagccctgctgtgcacactgagaattctgctcaggtgtacctttctgtgtgctcctgggtgcacccccaaagtgctggttctcttgaaaacctttttatttaggttcagacagacaaactgtggtatcttccattctgaccataaagtgtttcttctgggtctaactactatagtgggatattttctctagaacaagaggttgtttctttttggcattgagaaatgttgccgatgtgattttcttttgtgaacgtttaagacacagcgcttgccacttgaactttcttttgccgtgcgtagctgattccacataatggctgcagctccaggcagaaacctgtttggaagttgttttaaactcttcctggaatctctaggcagtggctcagtggggtttttttccaaccattccttaggatgaccagaagcttgacagaatcctcttgtcttcattttgagaaaatatgtctttactgtgtgtatgtgcagcatttggttttacctcgtgggtctaagcattttcaactaagcttccttttccaacctagcagacttgtttaaagaacttcaaactaatagccaagctgtaatacggtggctctctcagcctgagaagcctgtgctcaccgtcactctcttcttccctggggtgatagggatggggagtagtgtgtgtgagaggacagaagcgaggattgattgaagattattttacgaggcgagagcatggtggcacacctgtcagctgagtggactcagcgcctgccccggctaggctgtcctcctcctgtgccagccgtgggttccctgagtccctctgcagtcattcatgggtgctgaaaataaagataccctttctgtcgaaagtgttcgccgggctgcctctgcctccctggaaaagcagcagggcacacaggcttcctaggcagcccctgagggaggggctctttttattgtcactctggttagtttgaagaccagacagaaggcagcaaaaaccaaccctttgttgaaaactctttgcctttaggcccttggtaccatgttcatgaggctccagataattccacaaatacattattattgttacctagacttggggacagagaagggtgaaacatgggtctgggaattcacagatgaatatactgtaatcccctcgagcacatttcttttaaaggaatgggggtattctaaaggagtgaacactccactggggggctgctaggcccctgtgaacggtggcagccttggccacggtgtgtgctgtgatctctcctgggtcccccgggcatcctcagacctcccccacacccaacccacagtcccttctccatccatctgctgaccacaccccaggatgtttccagctcagatcacgcctgattgcatccacacaaactgcacgccaggcatttccgtttggatgtgtacacaaaaacaacacgtcccagactgagctgatctttctgtacccctcaaaagaaaagttctgtacccggccaggcctggtggctcacacctgtaatcccagcactttgggaggccaaggcaggaggatcacgaggtcaggagattgagaccatcctgggtaacacggtgaaaccctgtctctgctaaaaatacaaaaaattagctgggcatggtggcgggcgcctgtagtcccagctacaggagaatggcaagaatccggaaggcaaagctggagcttgcagtgagctgagattgagccactgcactccagcctggtgacagagtgacactccgtctcaaaaaaaaaaaaaaaaaaaaagaaattctgtacccttccagatggtcctggacatatcttgaatctaccctgcttttcctcatctgcactgctgtcctcttgatctgggctactgaggctagaatgcacatctgatcatgtgcctcctgcttaaaatagtatttttcctcttaagagtagtccaaactcctattgctggattaaaaggctgttccaggctctccctacctcagggcacaccatctttcctcccagtctcccctcccctctgtctccagtgcttccatccttcagtcatgctgaggttgtctttgttacctttgcttctcttggcccgcactctctgttggctctgccagcatccctatgcacctgctagctcctactcacttgtccagctttggcctggaagtcccttcccctggcaggcagccctaagctaccctttgcttgctactggctcatattctcactgcttgtcctcaggctgtgagccctgggagggctgggctgagtccccgaacctgccacgtctatagggtgtaacctacctgaggcctgactgctaaaatcaaaagaagcctttctcatttgcttagctgagctaagtcctttctggagaagaatgcccacgtcctgggtggacttctgttcggcctggggcaggacgctgcatgtcagttcacctagagcccctcgcttgccctcacccctctccctttccttctcctccccgtgttgtctcatggtcagttcctctcctggcaaggcaagagaatcataaaatctctttggaccatgtgtctctctgatgcactttggaggttgaagctcactttcgtgaagttaggagcggttaatcctcctgcacgaggatgcatgcctgctagggaaagcctccctgcgtttatatggaacagtggtgtgtaccttagggcaacccagaaacagctgagatggccctaaactcttccgtattttgattcagaagctttaccttatttgaacatctgcagaataagttctttcctttagaaatgattggggataaaattgtttgcattatgaaatattgtatggccaggtggcccctctttcatgttttgttccttgtgaagaggttgagtctcctattttttttttttttttggagatagagttttgttcttgtccctcaggctggagtaaaatggtgcaatcttggctcactgcaacctccgcctcctgggttcaaacgattctcctgcctcagcctcccaagtagctgggatcacaggcacgtgccaccacacctggctaatttttgtatttttagtaagagatggggtttcgccatgttgggcaggctggtcttgaactcctgacctcagttgatctgcccgcctcggcctcccaaagtgctgggatcacaggcgtgagccaccacgcccagcctatggtatgcttttaaaaatggtttctctgcactaatgattatttaaaaaaaaaactctggcaagaacaaaaacaaatggttttttaaaaactctagaaataatttgatacattcgaggactctggagagggagagagttaaaggctgatgtgtgtgactctttttcctctccccccaaggaaaaaaaatgaagagaaggagcttttaagtgcagtgcctcgtttttatgtgattgcaaacctgaaccaatccttttagtggtggatgtgggacatgttagcttttccaacagtttagatgggcctttgtttttattgttggtcactgtaagaattccaaggaatagaaggatctcatgggcaaaatcagtttgcttttttctctgtatatttgttagtttatagcagcttctattttcctcctatttttaaaagctgaaatgcctttaatcgcactcagtgtgtttattcatggaagccagagaagagggtcccttcctttcccccatagcgccgtaattggaaatttggtagtactaggtgaaattctcagttttggcgctcgcatggaacagccatccatctgctggcgagacacactgcccggggcttttcaagaaatcccttaatggtcctgaacactaataatatttatatacattgagatgagacaaaatttacagcgggctctggggctggctccaggactctctaatcccacacttgctcacgttctcttgcttgcctcctagaatcctttcaggttgtgcttcagtgaggggagcatggtgtccgtctctgcagcaatgcttatttatgcagttcgtcctctaacaaacagagcaactttccttttgaccttcccctcttctccccatcacattccattgctgcccccgcatagagcatgtgcttatgcatagtttgcatcatttaacacgaaggaaccccttgatttgtgatccctttaagaagttgctctgtatataaagaaaatgatttttcctggttggttttactgaagttccttcagaaatagctcccaccaccgaaacacacctgacttccccagcctgtgtatcggttgtggcacggactgactgactggatggtataatttcactcactcctttgggaagtttcgggggactactgctcagatgtgtgggaaatgcggaatatatctacaggtactttgtcagtttttttttttcttttctttctcatcctggaaaatcccggcattgatatttaggtataactatttgcaagcaagtgcagagggacatttttctgttcttttcaacgttcttattactactgcattaatagctacttgatcttaatgtctattacacatcattttatataatgttttctttaaattgtcagggaaagggattctgcaagtagatgttggtccccccagttagtgtctgatgatgatggtaagattctcagagtttccttcctctaatgacaaagcatggtgatggtgatgtctgaagagcagcctcggtgctccaagatgggtgtatgcttaatactgctggcacacgcctgacgagcgggaatgtgagcgttgtttctgtaaccagttttactgaacctcacagatccattatacgacgtgaattttgtgggaataacataggctgggagtctgctctcttccagcctggtccctctcttctttcagccctaccctctctgatcatcatgtcccttgcactgcggccaggtaacctttctgatacgaaggtctgggcatgttgttcccttgcctaaaactttccatggtttcgtattatccacagttgggctaaaccctctgggacaggccttcagtgcctccccgggcagtggtccctggccttcttcagtaacacccaagcccttgcacccacagtgacctcgttgcttttacaagcatttacatgtgatgttctttattcctcccttgctcatctttccactttcaactccacaaaaccgtcctcggcacccagaagcccaggaaacaccaggcagctccactcactcccgtacttgctgtgtcgtccgttccctggggacaggattgtcgctgatcctgcgtgcatctgtctggcacacaggtgcagcacacattaaatagctgctaaatgaataaatgaagaatagatggaattatattctgttgtgaccagtttaaaaacatgaaattggaatacccaattgcagtgtttctttagatcttggaccttgaggtgacctctgtaatggatatatttgaaattattaactgtcttcaagtgggggtttgatgagagagagagagagtgtgtgtgtgtgtgtgtgtgtgtgtgtttacagaaaatatgctaggtttgtacattcaaatttgtgttatcctcttcaagaaagtcaccttggtagacagcatatatatcccaacattttaggaactcataaaatgcatacttttttggtgtgatcagagatgggtaactccttattacttgtgggttagattagtttttggaaatagcctggagtcattgagagccaatccttatcaacaaaatggcataaatggacaggaatgggtttcttcttcactttagagatagctctgaagacatgtctcagttgggattagttcagttgcatatatgaatagcagtcattgaaacaagataaaagtgtatgtctctcacatctaaagaagtctggagtaagcagtccagggttagcctagcggccccactctcataagggactaagttccttttatctcgcttcaccattcttgatgtttcgccttgtggtccaaggttggtacttgagctccaagcattactactgcattccagccagcaaggaggaggatggccatgccctctttgttctcaggagtcttccaggaagttccagtcacaacgtttgtttatatctcactggccagaacttaagtcatatggccacctctagctacaaggaaggctgggagatgtagtctgtaactggatggccatattatcaactaaaaattactgaaaatgacaagaagaataaataatggaaggcaacctgttgtttctgtcaaaggatgacttcaaaagagaaagttgcaaaagtatttcaagcttgacagtatcatgacagttttcttcagaggtgacgctattcatttgcatgtccaagttctgatatctgttttcaagttcacctatttgcagcgaaataggaactcttggaggcaactagtgggtgtgtaaaccggtacaaactttctagaggacagtttaacccaacaagatgaattctggaaattgatcctaatgaaatgttaagggtgctcatgaagattgctttgccgattgcaataataaaaagtaaagaaaatatcttataattggggacaggtgtaacttatgatacattccacaatggagtgtaatactgctgttaaatgtttgtggaattcacaatcttttatgccaaaagaaagctttcagaatggcttgtcttttttgtagatacttgtatttatatgtccatgcacatacataagaaaggaccagggaaggtctgcttgaagatattaataaaggggtcacttgtgggtaggtggacttacttgttctctatattctctttacttgtttgtgatctctggtttttttaatcatgtatttttattacaagaaaaaacaaattctagaatctccactcaatattgcatgtcagagtcaaaaagatacacatttaaataattttgtattgttttccaatttgaggataaagtaggaaatgtataatgcaaaccagatttcatattttgttgatttagacttaatttacaagtaaggctgacagcccacagagtgtgatcacgacagcattgttatggaaataaatgccagctcatgcatttgggatgtacaccatggatctgtggttattagatactgatttcactttagcacacgaagaggcttagcggaggtggcttctaatatcctatggttctgtgggctcggagatgctactcacccacttgtcagaggcattgaaaccagagcaactgcatcttgaataggagctaggtaaaatgaggccgaattcccagacagttaagacattctgagtcacaggatgaggttaaaggtcagcacaaaatacaggtcataaagaccttgctgatctagcagatgcagttaaagaagccggcgcaaacccaccaaaaccaagatggtaacgagagtgacctgtgatcgtcctcactgctgcactcccaccagcgccatgagtgtttacatgtcatagcaacatcaggaagttaccctatatggtctaaaatggagaggtatgaataatccaccccttgtttagcgtgtcataaaaatgggcaaccagcagccttccaggctgctctgtgtatggagtagccattcttctgttcctttactttcctaatcagcttgctttcagtttacagactcaccctgaattattcttgcgtaagatctaagaaccctctcttggggtctggatcaggactcctttcctgtaacacacctatgttcttggacttaagaatgaccctcagacatggtgacttctttgtcatctaacagctttggcttatttgaggtaaaacctttgatatctaaggcagcagaaatttccctgaagtcattttgaatggtatcatctttactatagtgtagtttaatcattttcaaagtaagcatttctgcacactaaggctttaaaagagttttcagtaaggaacatatttgaaatggaaagtgagcagagcacaatgccttttaaattactgataaaccatagagttcctgtagggcttccactggctgacccacgcctgaggcaaccctcaaatgtgggtattatccccctcattttacagatgggaagagagaggatcaagatcacagaagctaatggtttgtcccagaccaaacaaggagttcctaggagagactgaactttaaagatatcgactctctgcaggtctaagtggatgaaaggacagtggtgggggtgaggatttcgtagtgtgtttttgcattgtctcctcaatgagtgatctggtgctggtggtagcagtgaatgacccagaaggatgctggccaggcccagagaaggcggtgcctcccctgcccggtctcatctccgtctctcctctctctccacagtgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagaggtcagtcgcggccacacgtgtggtcactacccgccccacctcacccgccaccctagcacacaaaggtagactctgtcggttgtttcatccgggtgcagccctcaggaagttcactgaggtgggtcattttgagagggctggcttaccttaaatgtttggtgagattctaggaacaattggcatggcttaccgcccccctcaccagtttgttttatattttaagtgcatactgcctggccatttgaaattaagtacttgcttgctggtttcgatacccagagttcatagtctctctgggtacttgccaagctgccatctaagagacagggaactgtagttttggattttcctagtctgggtgctgctagccaggtgaggctttggaagtgcaaaagaaaagacatgctaagcccccaccaccatccttgagaccagcaagcggacctaaacatcttagtgcaagagctagcagcagctcagagtaggcagtagcttaaaataagggacatttttccatcagcacttccttcctctcatccccctctaccttgaccctccctcagtgctcatcatgtccttcattttccttcctgaactttgagacttcacttgggaagcaaagaagttccttatggccaggcatgtggctcacacctgtaatcccaatactttgggaggctgaggtgcttggatcacttgaggtcagagtttgagaccagcctggccaacgtgatgaaaccctgtctctactaaaaatacaaaaattagcacctgtagtcctagctactccgaggcaggagaattgcttgaacctgggaggcagaggttgcagtgagccaagatcacactacttcattccatcctgggagacagagtctcactctgtctccaaaaaaaaaaaaaaaaaagagaagttcgttataacaaatgccatatgcccttttgtacatgtcaactggacttctataaatttgtcattggtttatgcttttgaaaataagatgttagcattgtttaaaaatgtgataactataactttgaaagcaaaagaagattggagatttggggttgctgttccctttcctggagcagagtaaagaacttttaggggctcacgcctgtaatcccaacactttgggaggccaaggtgggcagatcccttgaggccatgggttcaagaccagcctgggcaacatgcaaaccccatctgtacaaaagattaaaaaaaaattagtttggcttggtggcacacacctgtagtctcagctccttgggagttgcaagtgggaggatcacctgagcccttgaggtcaaggccgaaataagccaaaatcgcctcactgcactccagcacaggcaacagagaccctgtctcaaaaaaaagaacttttaggaaagttctgttttagtggactaaatgcctccttcatgattagcaccagggggcctgtctttctgagtctgtcaaaatctattctacaaatataaaaatatcgttagaaaagtaggtgttaattttaaatataatttttgctgcagcttatgaagtacattgaggaagtgtttataaaggggattctttttctagtgtattatttggagacgcagcttctactgtaggcttaccttcaaatcaaagataatacattcttttatagtattagatgtagagcaactttctccctcttataatctgtataaccattagcatactaacaacaagaagaaaattactctgaatactttaaaatgataaataggccaaggacttcaatgagctgtagaggatacatattacatccaaaatcagtctaccacattgtactcacattttgttggcagccttcgagtgtaaaagggcttttactggtgcacacctcgggcccaggggcagtgcctggaaccaagttgaggctcagacactattcagacgtcaccttcctccttggggtggggttaggggagtggtagcttgtccatgaactcagtgtgctatcgtctttgttttgtgaatacattttcttaatgacatttggaggccttcagtcgttctgcagccaccagagttgtggcaaagtgggaatgctgtccatttgacagtgttgtttcttccgctctagtgcactcttcagagaattgagccattatttcccctattcattcttacagtccgttaaaaactatacatctacctttttgtttaaaaataaaacaccataaagaataataaattcccttctctcagcctttgaggcttatttaacaattactttgaaatatttaattttttcatcttgtttataccttctctataccatagtggatttgaggaagcttaatctataaacatgttatcaaaacacttccttagaaaaacattttttaagtgcttgatgactcctagactttttaccaaagatgattggttccattttttttttcttttcttttctctttgatagactctggctgtgtcacccaggctggagtgcagtggcacaatcatagctcactgcagcctcaaactcctgggctcaagtgatcctcctgcctcagcctcccaaagtgctgggattacagatgtgagccactgtacccagcttcagatttttctatttgagtgaaagatggagagaaactaaacatacacttatggtacaacccagcagttgtaaccctggatatttatcacagagaaatgaaatttatgtcaacacaaaaatatgtacaccatcgtccatagcagctttatttgtaataaccccaaattggaaattactcagatgtcctatgatagatagttagttaaactgtgggacatccacaccatggaatattattactcagcaataaaaaggaacaaaccattgaagtacactacttggatggatctcaaggacattatgctctgtgaaaaagccaacctcaaaagatcacatactgtataattccatttatgcaacatcctcaaaatgacagattatagccaggcacggcggctcacgcctgtgatcccagcaatttgggaggctgaggtgggtggatcacctgaggtcaagagtttgagaccagcctggccaacatggtgaaaccgtgtctctactaaaattacaaagtttggccagtcacagtggctcatacctatctcagcaccttgggaggctgaggcaggcagattgcttgaggtcaggaggccaacatggtgaaaccccatctctactaaaaatacaaaaattagccgggcctggtgatgggtgcctgtatttccagctactcaggaggctgaggcaggagaatcacttgaacccaggaggtggaggttgcagtgagctgagatcatgccgctgcactgtagcctgggcgacagagtgagaccctgtctcaaaaaaaaaaaaaaagacagattgtagacatggaaaacagattagtggttgccaggtgttagggacattggggactaggttgggcagggcagtgagtatgaacaggtggcattagggagagcttggtggtgacggaacagttctgtatcttgattgtagttgtgattacacaaatctacacaagtgatcagtgacacagcaccacacacacacacacacacacacacacacacacacacacacacacagagttaatttccaggtttgatacttatatcatgtaagatgtagtaaacattggaggaagttggatgaaggctatgtgggatctctctgtaactttctcgtaaatctttgcagctttttgtgactctataattattttaaaataaaatttttttttttaaatggaaagtttatagggtatgtagataaattagaaacaacagaaggccaagtaaaaaagtgctgaaggaagcctctacccaggctggaaatgagaatgttgaatgcaatggtagaggaaggactctccccatctgtgggtgggtccagttcctgtaggacccttggggaagccatgacccccattctcccaaacacacaataggaaaataccagagaagttttgtttacctgttagcttttaaacaaaacagaaccctgcatctttgtcttagatacaaaataaccttcatgggtagggggaagggacattaataaaaagagctataatttacattgtttttcttgaatgtttttacttcacgaaatttgagagatgatttaagaacaataatgtacatataatggctccccagcttaccatcctattacacacacatcgcataagttcgtattatttgtcttgtttggaaatcagtccaactttctgacccttgttctatatataactatagatcccaaaggttcagctgctgggctagcattttgtctgctatttcctaaataatggtaggtaagcaggaaaagtgccagtcttacttgtccctgactcttggtggttcgtggcatgttcaggatagtatttgaaacaagagctcattacaaagtaatggaaaccccttgcttttattgtgtatgcagcaaaagcaacatttggatcaatttacaagtttctgcaaaacaccgtcaagaaataatttcggttgtgctttagcaagaaaataatggatctgtgctataccacatgccttttggtatccctcactgggctttgccaaaacactgactgcaggagctagactactgttaggcagagacactgcactccctttgctgtccctgccttctctcctagcgactcctccaggtacacaggccagggtcacagtatcagaaagcagctctgttttcctccagaaccccccaagcttcctttctgcagcactgtctctcccacatggaaccagctggctcaccagtcaacagcctatgacacacaaatgccttgaggatgcagcatgtattttgtctggaagcaagcaacacgctcttcctttgtaggctgtttctccttttgcttgcaatgtgagtggcttatcttgggtgggcttgggggtgagataccatgtgaccacatgaacacttcaaaacagttgctttttctaatgcatgctgtaataacaatgaaaagcatatccttatggtttttttaatgcaagaagacagactcaattatgtgtgtttttgattttttttttcttcttcaacagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggagtaagtattccatccccctggaaaaacggctagatctcatggttttcttttgttgatgcttttcatgctcccgtccctgagtcaccactaaaatatgggcttagataaacaacatggtgtgtaagcctcacgcatgacgtctcttctttgagtttccctgaaagataaagaacagattgaaaggcaatctgtcttttagccattggcacgtcatttattcctgtaaagagggtcatcgctcatctttttgttagtcacatcttgcataggagaggcaagccctgacacatacaaaccccagaagagaccattggatcagacgtgtgactcagcagactccagctgtagccaaatccacacatctttcaagtctaaagagttttggttacttgaatttactgagaagactgagcaaagggaagtttagtgatatcacgttaaaattttatgaagtccaaaagaatgctagatttccaaatttacttgtgagagacaaaaggatacaagtgtgtgtcattgtgtacataaagtttcggtctcacccctgtacaatgacctttatttgcaatagatggcattcctggtaagttgcttctgagttggatttgtgcaaaggatttcccactgacttagcctatgatctcttcacttctttggttttttgtgtgtttgttttttggttttgttttgagacagggtctcactgtatcacccaggctggagtgcaatggcataatcatagctcactgtaacctggaactcctagtctcaaacaatccttctgctcagcctcccacgttgctgggaccacaggcacacactaccatgtctggataattttaaaaatcttttcacttctgatttttcattgccaagggcttctagtaatggtgccttaaattctctgccactgggaccacttggtcaaggtactgatagttttataagctagaataaatatcgtaaaatggctttgaagttgaaaggaattttggggggggaatccttttatgaagaatttttttttttttttacagtttgagaggaaaaataatgtattttgagaatgtgttttccttaatatttgttaaatgagtagactgtattcttaaggtttagaaaggacagaaacaagtttgtgcttagttcttctgaattagttgatatcccttgttgctgttcacaatacacccactcccagccctccgtgatggagataactctgttccccacaactagggcttgcccactctcatggtacttctgatgtttaattcttttggctgtgtctgcatttcctcatttacttttaatttgcttatccctagaacataccttttgagtgcctaaacttttttatcttcctgtcctgaagacaaaaatttaatctgtgaattaaacccatggagaagtatcatttatgaagggattggtacatattgatgcatgatgatgaaatgtgtcttctggtttatgtccattgcaggaaatagattggatttaggatgatgggacatctcattagaggggaaatttcctgatcttgactaaggcatgcttcctgccccacgtttaaaattcaggatctcttccttaaaacatcaactgcacgcaacctctcatctttccaacttgaacttccctttaatttttcttggaaagctattaaattaaattagatgtagggctttatcctttagtacccttattattttatttgtatcaactcaaagcaaaatagagcattttattaaatatgtcttcataaattacgcacagtaaaatcccattaattggaccacacccagttcattatagtgtttattataattttagcattagttgaactgaaaattggtttttgtttactatgagaaaaaggtagactaaacaagatgaaacctgttgtttgcatattatgtttgtacatctttattagcaactatttttccaactattttcaactatttttccaactattttctagttataaaagcaatacataaatactatagaaaatttagcaatgcagaaatgaatttttaaaaatccctcatagatagccattgttaacattttggtgtattttcttcaagtcttagtaaaatggaacctttaaatatagatccctgtatcttaggaattagaaaggcagcaaaggcagttcctaatgagatggagaaaatgttgatttagtcatgcccttgtactgtgggggccatactgtctgttgacagagcatattaaaagacgttccctacattcgtcagccttagctaattggcagtctggtatttatgattttatattttgttaatcagcttgggagctgcagtaccccccagcctcctagaaacttggcttcccctgcctgggaggcctcgttccaggagtcgttgttgagagtcaagccagggaagtgtgtttttgtcagggagcagccagtcctgtgctgggagcatctcagggggcacctgccgttgaattgttctcacttgtgtttgtaagaatccaagtatgtcacccttacaccaagtgagcacacagtgacacaatcccctttcaatgtagataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggtaagtgccccaaatttcatgagctgacgttctattacaaaataagcagcgtgcttatgaaactgtgttgctgaggtaagagccctccctgccttgttaaagagaagaaaggaggaagccgcagtattgcctgtgctgctcgagtaggtcttgggtggagtcatggttctccattcttaggaggttgctgtttggaaaacagagatgttatcacccttactggattttgcctcatcagtcaagggttgcgtgtctgactgtgaccagtgagacggcagacgggggtgcgcttagggcttttctgccaagaatgacagcagttggtctggagtgctcacctccctgtgaaatcattgttcgcgcgaccctcatctgcctcaggatgctgtactctactacgcacaactgctccatcttttaagatattggaagtgagagcacgggaggagcatgggcggttcgttttgttagaaagaaacccggattcacgagatggtttttattgattagtttacaggatttgcactattgatagagtttttgccttggcacaggcctgctttgtgataggggttttaaaataaccgtgggcttttcactggaggataaaagccggtgcttattgcatgcacaattgctttccagccgtcagcctgtgtgtacctttgcatatgtacttttctctttaaactctcccttttaaatacgactcttgccaggctttaagtgaatgcttcaaaataaaaggagttatcaattaaagagtgaattccttccaaagagaatttgggaaaataatttaggaaaagaagaggcgagaaggtcatgggaaaggttgtctttgctgatttatctgccccaactggataaagttactgcataagggtttctttacagcctccctgtttttctcagactaactcttggtcagtcttaaattcttaaaattccatcatctgatagagctaacgagagcgggcagctcttcattccatccttgaaaagcacagtgtcctccccactggggaacaccaatccttaaaaaacttctttctcattgcaaatcgaaggaggctgccgctgcacccagccccagactcctcagtcacttacctggcaagctgaggccctaccagtttaaggtgatgattattgtttcttgtattaaattttaaaatgaatttttctccgctttttttttttctaagtaggtttgtgtttctggaatctcgggtgtctgtgagcatttcttcttcagcagagcagtagctgtcaaattttcttgttgcttaatgatatacttttttgtttctagactaagcaaatgatagacatagaggtgaatgctgagaggagagtttaattaatttccattaggaattattatgtggttaccttttcatggagtgttaactaagtattgtgcacttaaatgtagttagaaattaaagcctgatttttatttgcaagaatatttatgatgtctttctcattatctgaaacttgcataaaacctgaagcatcagcaaaatctttttaaggttgcgtgctcaggtgtttgggaggctttccaggtaagcccgggcccctggcctgctcttaccattttagatgcaggggagggcaagtgggccttgggttttccctgctgctgctgctccccagtagtcctgcagctccaaggatgctggctccagcctttcattcctgcgtgcagcttctaagaggctctttcttgagcttgggctcttaagaatcttttacctcccgatgggaagttttctctcaccctgtcttcctggcccatgaccacaaaggtatagcccatcctcacgatgatgagctccccaagagctctgtttgcttcaggtgttgagaccgctagcaacacctcagctgttcatttctccttagactcagggacagagttaggtctggccccttcactagctgccctcacttctgcaagaagggaagagtcagagcgagaaagagaaggacaggatacgatagtcagataaacatcagcagtgcaaagcagaactcgcacagtgatacaagggaaagaaagaaatgtgccctaggcatggagaagagccagatacctgagaagatcagacaggcttctgacaagaggtggcatttgagatgggccttgaaggctttcgggaaaaacttgaggaaagcagaggattgaagtgaagaaaggcaattcaaggtagggtggcaggagcaaaggcaacgagttggggcatcctggggcctgttgggcaactaacactggagaggtgggtggtactagagttatgtaagatgttttgcacgcaggtataaagggttataatttaggaagaccatggaacgtattcaaggcttttgaatagaggagtgttagcagagctgtctgaaatttttatttcggtgtgcttttggtttaagccaagatagctttcatcccagtgtttctcaaactttgctacacattatggaatcattgggggtgggggcaggggtggagttgagaaatcctgatgtccaagttgcacccccaccccaattcaataggagcgtttggggttaggatccaggaatcagtgcttgtctaaagatccctaggcacttcagcaggcagcaaagattggaaaccactgctttatcccttcatttcttcccatgtgcatatcacaaagcactttgacggttttttttcctaaatattttcccctcacactgctgcctaatgttttagaggttcacccatgttgttaacacgtgtcacactattttcttgaacttttttttttttttttttttgagatggaatcttgctgtgtcgcccaggctggagtgtagtggcgctgtctcggctcactgcaccctctgcctcctgggttcaagcgattctcctgcctcagcctcctgaatagctgggattactggcacgcaccaccacgcccggcttatttttgcttttagtagagacggactttcaccgtgttgttcaggctggtctcaaactcctgaccttgtgatccgcccgcctcagcctcccaatgtgctgggattacaggcttgagccaccacgcccggccttcttgaacttcttttatagccagtgataacataaatgtttccatttggttcaataggatgaaagttctgttctgtagccttttgtttttgatggagaacagaacaattcaaggtacagagatccttcaactctgacaaccttggctttccaaaatgtcactgagatccccctcaaaaagtctcctgagccatccagaacagaaaattcaagcattttacatagagtagagctcttattcctcactcagagcctgttgacttttatatcgcactcggcgtgagctgattttgtaacccagttacaaaagccatagccatggtttcctcaaggacaccatagggtgtatttctagagtaatgaccttagacattaagaaaatcaagaccgctctgctgtttacaaaggaaacaggttttgtaatccacatgtacacaatttttataaaatagctaatttttaagctcttgagtaagagaatattttcactatctggaaaatccccttgtttggacaaccttgtttcctgatggcatcagataaataaggagttaaagtttcacattatttggtgctaccaaggattgttgccttgaaaagaagaaggaaaaagtagatggagggtggtgagttaaaagaattgaaattcgcggataggcatttctatgcttttgttcctaccactcgactgtgcaacacgcagtgctttgtaataccttcttggagctcaaaggtcaggctgaaacatggccgctttttcacatttccctgggacttttggaaaatatacaccaaccctgtgacctagcaattccgggatccacccaagagaaatgaaaacatgcccacacaagacttgtgtatgaatgctggtagcagtattactcataatagcctcccgggattcccccgacccccagcccaaaagaaagacccactggaaaccattcagatgttcatcagcagatgagtggatagaaagataaatggataaatgaaatgtggcacaaaggacaactgactactcaacaataaaaagacgtgaagtatgacacgtgttacaacatgggtgaacctctaaaacattaggctaagtgaaaagaaaaaatccagacacaaaagactacatattatatgactcattcgtatgtaatttgcagaaaaggcaaaactatagagacagaaagcagaccagggatggctgcaaggaagaggtggagattgaccaccaatgggaatgagggaactcttggatgatggaagtgttctggaactgagtagtggtgatggttggacagttgtgtaaatttacggaagctcatggaatgatgggtgaatttttttttttttttttttttgagatggagtctcactctgtcacccaggctgcagtgcagtggcgctgtctcggatcactgcaagctccgcctccgggttcacaccattcccctgcctcagcctcccgagtagccgggactacaggcgctcaccaccacgcccgactaatttttttgtatttttagtagagacggggtttcaccatgttagccagtatggtctcgatcatctgacctcgtgatctgcctgcctcggcctctgaaagtgctgggattacaggtgtgagccaccgtgcctggcctgatgggtgaatatttgataggcaggttatacttcagaagtaaagctatttttaagaaacacctaaacaaagaggaaacattgtctgaatatctgtatggtgcctggttccacctagatagacatatccacccttgctgaacccctaaggttgatgtaaatattggatttgggggagagtggacatgatataaaccagcctgtttgcagatggattggtgggagcatctgcagaaaggcaaaaaaggccaaatactcttatcagttgcagatggctctgttgctgatgacagcctgtgtcctgggttctgatgccccctagagacagccgtgaagaggcaattttctcctcgaaggaaggaactggaatgattggttgtataattgcagaattgttttcagtatgtcagcaagcactgaaaatggggaaactgtcccttcctacctctgtaggctggagacctcgggttcagctccatttatcagggcacaggaccttcctgttctgagactttgttccaggggactttcacacttcagagaatagcacatgtcatcctgcacttttgtggggtgattaaaagctcacggtatccttttatgtttagcccatccaattcttccaactggcctcagccagaaaagcagggaaggcacccccagtttgcagctgagagactccagcctgggagagctgaataaatcttttgcccagaggggttcctcagtaaatgctggagatgaggctcagacctgacctttggattcccagatggagtgctctgaaccgtgtacctggggctgtcttcaccactcaaatatcgatagagataacatagagatgtcctcaggaagataaccaactgttcccatcctgtgtggtctacagattgggagatagggcctacccaagtgtagaaataaacattttttacaacatagagaaggctgagaaccaggataccaatatcaataaaatctggatatcatagagcacatggaagctaaagaaaaataagtaactggtcaggtgtggtggctcacacctgtaatcccagcactttggaagaccatggcaaggcattgcttgagcccaggagtttgagaccagccagggcaacatagtgagataccagctgttaaaaaaaaaaaagaaaagaaaaattaaccaagcatggtggggcatacctatggtcccagctacttgggaggctgaggtaggagggtagcttgagcctgggaagttgaggctgcagtgctctgtcattgcaccactgcaccccaacctggattacagagtgagaccctgtctcaaggggaaaaaaaaaaaaaaacctaatttttaaaagcattctttgaatgtaaaggcagtaagctaagaaacaattaggaaatcacatttactgaataatttacttaagtaatctttttcttcaggaaacaatgataactttagcgtatgcatattttaaagatgtgcagacaggtctctgccttttaccttctcttaattctcacctaatcatggaaggaatttagcggggagccttgccccaagctgtggctcgaaaaacaagcatggtattgacaggcagctcatgaatggcttgattattattttgacaagggttttatttttatttttctttagcttccacaggctccataatgcctgggttttattgatattggtatcctggctcccagcctcttcaatgattgtaaaaaatgtttgtgtttactgtaaaaagataatcttgcttttcaaagtgattagtcaaatacacagaatttcagtgtgcctgccattcatttgtcaaattcctggtttataattcatgcttcctcccgtgggggagaagaatgttttgttcagaaggtatttttggtgtggttccgttccctgctagtgaaattagtttatgaaaagaggcctggttctgggtgtagatggaagtttggcctgattaattggtccttaccggcagcccagaggtttcttcatcaacaaggagattttgtcctgtaactaactcaggtacctggaagcagcccgacatttgggggtgcatcgctgcagtctcctttggagctggagaaacctatgagcaagaatgggcttatgacacatccatttccactccatccctccttccgttgtatgactgcatggagcccctctgacctccagcagtgtcacctgcagcctggtagtgagaaacagcaggtatggatggggtctacccccagcaacagtagcgccagctgggccatatcctggcactgctccccaggaaacacaccttgtgttgcattgaccagatctgggatcatttggacaatgtcttatgctgcttttccaggatagctgtgtgttcaggagggagcccttactgaaaggaaagaactgttgacttacaagtttttgctaccggtttggtggtcactaatgtgtccagaggcctgaagatgggcgtgtgaggagcctgacttagcttcagaggctctgtctttcgactcacttgtgtgctcactgcacccctgtgctggcaggactccaacctccacccccagcacttgtgtggacagagagcccagtgctcaggaaagggttgggcttcaggcttgtgatgcagattccgtggtggctctgtgactccttctggtcgttcttaaagtagacagggagcttagatgtcacctgtgcattccccttgttgtcctacgagtgagtaaacagggctacagatagcactaagggatctgcgcatggctgtgcagctcattcatggcatttctggtcctgggtcccagtctctgaactccttcctggtctgacgtccctttgtgaatgttcaggaaaatgtcacagggctgcttggcagcattgtaaccataatttgtgctttactgtaaatgagaatcaggctgaggattgaccagctggttagaggtcctggtttgggtgtaaatgaagaccctcaccagatgcagagagatccccaatggacatagcctccagggcagacgaagccttaggggttctgttttgtcctggctacgctggctctgcagggagggctggggttctttctcctttgtgtgtttatacattagatctgtgagtggatcttagaagtcactcaaagtactgcactgattcccaaacttagtaagaagcagagcaggaagaggagaagaaggattcacggtccatggggatcaggcccatcagcacagaggactcagaagtcaaccctggcattgtctgctgccttcctggggaagccagagagaaaggcccactgcggggatctttctctagacctaagccgtagctgtctgctttcttgcctctccagggatggacttgtcctgccacctgggtagccagatagaacggcttcctgtgctggttggatctgctactcgtgtgcacaccctctggggcagaagccacgtctggtttggtgggctttggtcctccaccacctcactggaactcagcctctcctagattgctggttctccacgtgtggtccagggaccacagcaggggtcagcaccacctgggatttgtgataaatgcagattctttgcccaccccagctgaatcagaagctctgggggtggggcccagccctttgcaaacaagctttgtgcacactgaacttggagaaccactgtgttggactccgagtcctcttgcctggatgagaggcccaagagcactgcatgttagtggctcttcctcctcccccacacctccagggactggagctggggctgctcagaatgaaagatgaatgggggagggagaaggcccagggttgaccccccacaagcttgtctccctgtctcatgctgtctcctatcccatcatgctgctgattgggcaggatttacttccatggataatgggagactttagagcaaagtgtacgctgttccgattgggtagcagagcatgtctgttctctcatggactgctttcaagcacgttgtacatacttggctgagaaaaataaccaaaggcatttcttgggaatgattctagtaacatcctctggtacaagaagcattatttgatggtaatagtggtcatagaattaattagcatcttaccgattttgatatgttatccttgaatcatgttgctgccattgttaacagcaactgtctgttctcctatagtgttaataactaaatctcttattggcaaaggaaatgtattgtggagcaggtggcaaagaggacctgtgttacgtggccagcaggctagaggggactgtggccaagggcaggtgcgctaacatcgatttctgtgcttctaggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgagtgacagcatccaaaacaccgtgggcccaaccatcatgataacagcagaccctcctcccatgtgtgatggcagctttcctctgcggcccctcctggtttcacatgggggaccactagaccatcttaactagcactttgctcctacttatatgtcatcacaatcagtagtgggcagatacgtgatgtattcgtatttataaattctgtacatctctgtgagtgtgtgaaacacttataagtaggttctcaaactttaaagtgctgcttacagaatgcacagttaaatgtccttttatacacaggtgcacagttagatatttctctttcttttttcttttcttttttttctttttttttcttttttttttttttttttgagatggagtctcactctgtcacccaggctggggtgcagtggcatgatcttggctcactgtaacctccacctcggttcaagcggttctcatgcctcagcctcccgagcagctgagattacagacacctgccaccatgcccagctaatttttggatttttagtagagacgggatttcatcatgttggccaggctggcctcaaactcctgacctcaaatgatccacgtgcctcagcctcccaaagtgctgggattacaggcttgagccaccatgccctgtccgattatttttcagggaagagccagtgtgcttcagccctatgagctctacccttctgctcccacagaagggaagcacaggcctgtggggtggagggggctctgccctaagcgcagcccctgtgggccacgggtttcctgtcccttacactcggccgccttgtttctcccaccccaacatgaaaaagatggagtgagcctgcagccctgagttgatattgctttttaaattgagaacaatataattacagccttgtactgtttataaaactttaaggtctcatatcagagatacagcagtgcctttctcatctaaccctgtgtagaatacggctgttgagaatggcgtggctctctggctggatagggttataaaagtaaatcgtcttttcacctttggcttttaataagggaagggtattagaaaaaaagtaatttgtatgatgaagggtgatttgtgcgtgtgtgcagacagacacacatgcagggaggcaaatcagaaccgatgcgtgtttggctttggcttgtttcgctggtgtctggatttacctggcgacacttgttgctctgggggatcttagagggaagcacgctgactgacctagggctgaacagcaggctgacgaccagcgccgcctcccgccccctgctcactctatccctgcaaagcccctgccttgctccctgttcagatcatagtaaaatcggatgtatccgagtatttcagagtgcttgtctccttagagtcagccagtctgacctgtcagatcataatacatagtagccgtttattttcttttgaaagcaaaatcatggtttcctctctaaataacacttcagcaggaactgtgacatttcccaatctcagttgcgcacattttgtcctaaagacttcttagctcttttactgtcttcagtccctctgcttcacctcttgagtgtgtagtgggattcaggcagataagagggcgaaaggacaattcgtcagagagctctgggtctccatgagggtgggcagtcatcagtctttccctggtccttatcgtagtttgaatttggtccaaggaataagagagacacttggcacagcttccctgccatacccgccagccaggctacttcccatagagcacgttaggcttggccaagtgagatcttcttgtcagtgcttaatccagcctcccgttgtttgtcagccctagctggaggcctcacaggagttcctgtgtccttccagtttgataccaagtttagaccaagaaaagttcctttctgtggcacacctgtagtctcttacctgtctttggtggttgtacacgaacaggcagatatccacaactgcagaacaagtgtcatcgtctctcttaagaagtttcagggcagcctaaaggctcaccttcaccctaccaggccccctttcatagccaggatcttagggatggagaagaaagataagttcacctcgttcactgaagtcgccccttgttttcaggttaggaaacccaggttcatgtccaagtccctgggcaagtagccagcgtaactgattgacctaaaacaaaggatggagcccttggagctctgcatagtgaaatgtatgatttcttagtggaaaacgagaaagccactgaggaagcccagaagggaacttagcatatacagccagctttggggaagggggaagcagtgccaagcaagacaggtgcttttcagagacacatgaatctctgtcactcacggatgtactctttgccccaggtgaaagtgacgtcctgcatttcacctccaccaccacgtcgaagaatcgcatcatcataacctggcaccggtaccggccccctgactacagggatctcatcagcttcaccgtttactacaaggaagcgtgagtttctgctttgggtgatgccattctgttgacagggctacgaatgggagaggccagtctttcgatccttgaatgggctggctgaatacagggggtcagcagagtccccagggagagccacgccaaacatccctacttcatcctcatgcaccctctcgggctgtccctgtgatgtcagtcacagccagtgacagccatgattgggaaagtgttagctcgaggcctgtcattctttagtgagtgattagaggtgtttgaataaaataaacccaaaatggggaaagcttgctttttccagaattaggtcagtccagactcatgaacgatgatgggggacttcactgaaatatcgtttcagcctccttacctactaggcctactccaggaacaccctgcaggcacgtggctcttttgtatcatcttattcctgtctctctctctgtgtgcctctcccaagctgtggccctctgctctaggtcatgagccttccaaacaagcgaagaaaagtggagagagaacaaccttcatgtcttgagccttttgtgacttctcctagactctgttgggagcttttcctgtgtgatcacatgacattcccccatctaagcagccgaggcttattcctcccgactgcagccctctttgatctccctcttccttcctttgccttctatatccaggtggctaccccggtctacttagccatcccccttacccaggtcccatgttaatcccatagttctctctcccagatgtgtggcttccaaagagcagcaaccagaggcaccttatgacagcatcttgtactctttcctcctgccagagctggggtcctatgaatgagaaattgggtacttaggattactaggctttcagagtttgtacacaggggagcccctcatgatctcccatcccatgacagcagacggtgttttgttcatgtttgtttcagaagccagcggccagcagctgtccagcccttttagctgataaatataaaatacctacccaaccatgcatctgtgcgaagtactatattctctgatagtcacaccagtgctttggcaatgtcagctggtaatttcactgaggacttgatgctggtttctaaggcaatctggaaactaaatatttgaatattataagatgcttaagcatcagaattgtttatgagcaatctgaattttagaagctacttctgtttgtctgtaggaaagtcatttttctccaacagttaccttctttcaatatctgatatttgcattaactgactatgcttgtttttttcttgatgaaaaaatgctgcaatcagaagagagaaaaatagtttttgcatatgttcttaaggaatagtaactattgaatcccagtaactgttgaagtggctcttcctgaggcagaccattcaattctgtaatgcccgactggggaagcccagagtccagtcacttcatttcttcttctataaaagtctaattgattatttgtttatttagacctcccattatagaaagtgtgacatgctgggcctctggggaagatttttgagggttttgatgtcagagccccgaactttctctgaacttaattgtctttcagaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcaggtatccatgcctagacaagcccccagcatccacacttcttcgcaagctcactggccttgcttgtaccaggtgtcattgtagggttagcagtgagctatgcctgttgtctttcttgtcaataggtaatactgtgtcatattcatttccccactgctaacacattaggctcttctgtgccattttctggcctcggtactatcttccatcatctcctgctttgtgcctgtgagcccaggtcctccagggtgctgggctggtttcattggaaggcccagcctggaaacagccgtcttcagctgcccttgtttcttgtttgttttgatgttcaatcctccaggaactgaaaccatgctgatctgtgttccacttaattcatgtagctcactggttttccatcttcattctggagcttatagagttccaaagaggtcaacaaaagttgaaagcctgcagatgtagtatgttgtggatattcagagtattcactgatgatgaggttcctccttcctttatctttaggttctaaaccatctcatttctcaactccagatctggaaacagtaaaagcaaacgttaatagtttccagtatataaaaactagtttagaagtaggaaaatccacttcagttttaaagacactgattgttttagtgtattggagcttctatcacaaaaaaacagtgtagcctgggtggcttataagcaatagaaatgtatttctcacagttccagaagccacaaagtgcaagatcaaggcgctggcagatttggtgtctggtgagggcccactccctggctcatagatggctgtcttttcattgtgtccttgcatggtggcagggatgcgggagcactctccggggcctctcatagaagggcctggattccattcatgagggcttcactcccatgacccaatcacctcccaaaggccatgcctcctaattccatccccttaggggttaggattttgacatgtgagttttggtaggggacacaggcattcactctatagcactgataaacattctttgataatagccattattttagtgggtaaggtgtttttaaatacccataagcgagcacaaaatcagtttaaatggcagagaggagggtgagaagaaaatgctggtggggaaaaccttttgctgtgcacgcctgctccttcctccactcctaccccatctccatgaccctgtaagtggccacagtcatgtcactgggtaaagtgcttattgaaacaaaattggcacaggcttctgatcctgcgtgtgggttggtgtagcagaggttcagtgcaacagaagaagtttttcatcttaaaatttggaagtaacccctggccagcaattcactgtagtgtttgggaaacataggaatatctgcttattgtgacagattctcaagaaacctgtttcctttccacaaagatggaaaccaggcactgtaccaatgagtcagttcactacgttttgtcctctgtccttacacgcagcggagacagacgagaacttggtcctctgcctctgctgtttggtgacacctatcgtaagaatgtatctaggaatgagctgtttgtttttgaagtacttatttttggaaaccctaaagtggctgagcatcaagtggttgtgttttctctgaaaacgccagtattagtcataacctttttccaaagtatcatcccttaaagatgttcagaaccttgtgtgtatcgtataacctggagcaccctcaagctgtccgcccttttcaagttttaaaaatggcttaggcaaacatattgcttaagtgatatccagtgaaggtgtctcctgtgctttgaaaaaccatcaacattgatgcttttttgtgacccaataaggacaagatttcagtggttctgggatgcatttgatctttatgcacacttcagctctgggtttcagttcaggggtcagcataagtaaagcttgatcagataactatgctttgcctataatcggcattcattctgctggtgacagagtcctttgctcaaaatgaggcttccatgcgtttgcagttctaaactgcttttcagagtcatgcctcagtcattgtactgaaggatgcctgtggaaatggtggacttccgtgttctttgcattgcctctcccccatccctcttacacacagctgtgacatgggcatgcacactccttcacacacacagactctccaggcccctttccacttcctctttccatttggcttcatgacatttttatcagagattcaaaatctcagatgaaatccaagtcagcctgttttaccagttgtcgaaattgccggagtgcagcactgtggagaatggcagttgtaataaatgagaaataccaggtgtttgaattagctgtagattttcacattgtctcttctaaccctgcttgtgcccccgcagcctttttccatttacaactcagtaatgtttgttttcacagagattaccggaggaaatagattataaagggaaatgttggcatttatagtagtactatttcaaaataaggttcacttttcactttgtatttcattgttcattgttattttcttatccaggtcaaactggcagtttcctgttggcttgccagagtatctgatagcctgactcttaagttcatttcattttctagaatgttctttgttcccctctccagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaaggtaagggtgcagcagcggcctggacggagggtgtgaccgttcattcctgtggttgtaatgtgcctgagccctaatattacacgtatcagacaacagtgtagttctccattggaaaccagctatcttctggttttttttttttttttttgagacagagtctcactctgttgcccaggctggagtgcagtggcacgatcatggctcactgcaatttctgcctcccaggttcaagcatttctcattccccagcattccgagtagctgggattacaggcatgcaccaccatgcccagctaatttttgtatttttagtagagacggggtttcaccatgttgcccaggctggtctgaaactcctaacctcaggtgatttgcccgcctcggcctcccaaagtgctgggattatagccttgagccaccacatctggccgagaccagctatcttcttgattaaaggtactgagagctattatttttccttacaagcatgtataacggctttcattcccactcttgttttggcttttcttttccgagaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccaggtacccagctcatgtgaaatttcagttggcaaaacccactgctcaggccggttctgttgcctttctccccaccaggtagtgtgtaagtcagcagctggggggtacaatacagtagccactgagacggagccgaaaaagatgacaggttcggtgaagtgagtccctgcggaagccagtcagccctgaagggaacagggaccagggcttgggttgctggggccaccggtgtgacaggtactgctgtctcagccacaaccccccacagagagcaggtgggcaccctgtggtagaggcagggaggggaaactcaaagagtattgacagctgctgcctggtgagaggaaaggccaggatttgggtccatctctgcccttcctaattatctttactgcctctctcagcctcacagaggaggagtgaagcaagagggaaaaaagtcagagtctgtgctggaaagggcctgacttcaaaacatagccaggtgccacaggcatcctgtacaagtaagtttgggaagcagtgtagggcgacagcctgcattggctgtttattccgtggttactctgtctttcaaagcaacacagcccctgccccagggactctgctcctctgctgtggtcttggtttctggggagtggggacaaaagcagaggaaagtaaacgttcatagcaggactgttcatagtagccaaatctggaaacccagtgtacatcaacaggtgagtggctcaataaaatgggctcgaaccttacagtagaatattattcagccataaaaagggaggaaattttgatccatgtcacaacacagatgaaccttgaagacaccatgccaagtgaaacaaggccagacacaaaaggacagatagtgtatgattttatgttgtgtgaaatatatggaatgggcaaatgtatggtgacagaaagtagatttgaatttaccaggggatggggatagagtgtggaggggaatgggaattattccataatcgataggttttctatttggagtgatgaaaatttttggaaatagataatgatgatagctgtaccattctgtgaatgcaattaatgccactgaattgtacccttaaaatgattaaaatggcaactttttatcttacatatattttgttttgttttaaaattttattttaacacaataaaaaatgttaaacaatttttttttcctttcaaaaaaggattagcccagtagtgtgtgggaaaggagatggaagcacagtggtgctccctggccccctcttcctgtaagattatagtgcagattttggaaacgacctcatgcctgaaaactaggccaaggagttggatttaaatcagcatggcacccatgagctgcccatccgcagtccccacagcacccgctgccagcaccccacccagcacgttcccttcccctcactgcccccgaccctgagaggagcctgtagcggctatttattccacagtgactctgctcttacaggctttcttaggctgtaacaacaaatggtttttaaagtgattttttttttctgccaagtgacctttttgatatttgcaaaatggttgaaatagctatctcacttcgagaaatcagtaaagtgggaaataaagactggttagaactggaggcattatttccttttgagagtgcgcctcttcattgcttggtggcttttttctcctcccctcctctctcgaagttcaaaccaccagagcagccaggcgcggtggctcacgcctgtaatcccagcactttgggaggctgaggtgggtggatcacaagatcaggcgttcgagaccagccgggcatcatggtgaaaccctgtctctactaaagatacaaaaaattagccaagcgtggtggtgcacacctgtaatcccagctacttgggaagctgaggcaggataatcgcttgaacccgggaggtggaggttgcagtgagctgagatcgcaccgttgcactccagcctggacaacagaacgagactccatctcaagaaaaaaaaaacaccagagctgtgagaagggcctgcgaggccctcatggcctctcctagcctgccccgctgggggagtcttctgcctgctggtgtgtggcagggctttgaatgtgaaccttgaggttcagtgcccaaggccattttcttatccaggatatctttgtatcactggtggttcctagaaagcagaaagtttgaggactagaaagattgcaaagaggtttggaaactggaactcaatgaggtttggtgacttctctgacatcctaattaattaagaatccgtttgggacctggtcctcattcccacacaccgactcttttccccctcttctcctccattgcgttgcttctcgtggtcctttccacctagaccagcagaggcttagctcgtggcagctcctgctgcccgccacacggaaggatggatttagagtgtcccaaagcaggctgggcgggaagtttgtttttctctatcatgggcccttggttacgttgctgtcttgttccaccaaccagcaggaggttcgggttgtgagtcaaggttttggaaagattttgctgaaaggccccttgctttcagttgtagttacgaggcaagacctgtttttttctcatcagatgtggagcacaaggtgaagtgacgtgaaggcagagctgtgattgacatgttattaatgcacagcattggtggtgttgggttcaaaacaagtttcctgtgttctactggagaagtgtgtttatctgtcccccgagtccttcctttctctctcctaagacaagtccaacttgtgattctctgttttcatggatgtatatgaagacaatattttgtccgtggtgagaggccataatttttaagaagttaatatttgtttttttgcctcctactgagttctggcagagtccaggtgaaggagtgtccagcagagagaatgactgaatcacagaggctggctttctgttttacacgtggattgtccgaaaatggatttgatttctttcagttcattctgagaacaatgtatttgtgggataaaaccagttaagtaagatttagttccttataaattgtccagaatatcctgtatgttttgaagtacagtggaagctagagtttgtaaaacttactagtttctgaagtcaatattcgcagtaaatgcctttctttgactactgtctttattttgtaaatcacatagtttggtttaactagctaaaatgttgacagatgttggaaagtaaaaggttttccaatagggctaggttgtattatgggatggagtggggaaagttggcagtaatgtttgcttttgggcgtacgatttggaaatgtagttgtttaccaaaaaaaatgatgtatgggccattgtgcttcccctgttcctgccttccagataatgttctgtgtcacctccctccccttgtcactgccttgatgtcatcagcattgagagctgtgcagtccctaaaagtgtgatgttgataaacaagtaaactactgagtatacttcatgaagtaatcccagttaaatgggggtgggctgagccgggagaggggttttgacagaattattttgcggtacatcaaacctaagcaacttctgacagacacaagtgtatgttgtgttggttttgaaggtaggcaggaaatttgttgatgatgtgttgacaaagatttccctgacagtaaatgtggtttcttgtgtttttcccttccgggaagcttggttagctagttggttggtttgcagagtgtgaggattgtggatgatcagcctcatgtccttacccttcctcccccagtattgtgaaagcaaatgtacacgccctgaccttgtggttttctgcttgttggaacgagcatatctgtgttgggcagttcatgccttcggtaggacccccgtgtgccactacacaaagaaggaccgtgttttcctcaggggaatccatgggctgagaagactggggagcctcagaggccctttcccaaagccctctgctctccccttccaggttctgacctaaggaccagccagaagcctgccgagcgtcagccgaacctgcaagtggcttctgggctgttccgttccctgcgtgagctttccctctctgctgctgctgccgcgctctcccctccatggcactgatgagcttcccacattctggactttctcatttccctgggcagatagaattcatcccatttgccccctgccttttgcctattcctaagaccggtgaccccagccgaaggcctcagccctgttttctcaccattcgtccatggctgacctgagggttgccctttctccatctgggtgctcctctcgtattctgtttgtttttgttggttcctgtaaacattagaattctgttttaaggtttctagggggagccacaaagcccatttcttcatatttgaccaaagcagcaattagagggtcgcaccctcatgcctcatctgccctttttggtgagaatgtcctttttgtgatgactttatgcactcccttttgcttttcggttgttccaagccccattcaaatccatgacgaggactctgctctctgatgggcaggaccttgatgaggccacaggtgctcactgctgagtgggaggaagcctgggtgggctccagggacctgcagagtgtagcaagcacagacgcttggggttgggggtgggctcgcagcaggagcccccaagaagagagagccctggggtccgtggaactgcttgctgctagactccaggcatctttatttccacagtcagagcaaatccaaggagccaccaccacaggctttcatatccctctgccccaggtctctggggcctctgccacacacctcacctctcccctcctgccctaataaatcttaaccacagctgataggtttgccacctttaaggcttaaccataaggtctgtgaccagatggcctgagtgttctgatgacacagccaggactgcctggccaagagtggcagagacactatttgcctctaggtaaaatcgaagaaccactctgagagccggggggtgggggtgagagtttgtgtgcccattctgacacttgcagagtagagaaagcaagataatgaggaaggacatccctgtgttattcatgagttcttacctaagggggctcaatagctccttctattccacggttaagattcttctgttactcttactcaagtcatagaaaagacaaaagaggtaaaagtacttaaaagccacatttctctcctccttgcagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcaggtatggtatgatccagctggccccattgccaccttcctcacaacctagtggagaagatgtgttttatggacacagggtctgacacccagggccatgacccttagacccaggcctgcctgctaaataacgtgcagtcattggcaggtggcgtgtagaccagctgcccagggaacagagcccacgctctcctagtgacaccactcccagcttggtctctccatagaacgtgctgggagcagggagctgtctgcagggtccaccctccacctgctacttggtgcacatcgtgcattcctgctgtcctttgccccctcttgcgcacaaatcgggttgccccctcctgagctctcacatgtccagagatgtctccagttagttgccttgatccagagtaaacattgcccctcaagatcaactcctggagcagcctctggtcttgcttatttagtctttggctttcccttgttgttagacactgcctgtcactcgggcattcatccatctttgaaggtgggtgccttcaaagacagaacaagagctgccctgtcctttagtaggcctcaggtggtagaaagagcacggaggtgaccagagtctggggtgtggggtcctcctgggtgcagttctggcactgaagtccattgtagcgtgccttgaggcagtcgtcaggctccctgcctcagtttccttagccctcctgggagagacatagccagctaacccctcaagtgccttttccggctgtaactttccatgacctttgcttatcacaactttgtttactgcttcaagaagcaaaagcaagaaaggaaccactgcaaggtcagccagccgctggaggagttggtgccggcagggagggcttgccctgctcttagcaccagcctcctagcagcttcctcacaggccgggctcggggccatccttcgtgcctgcataaaaattgcagttgccgcgtgtagacgcgggccacggagggtccctgtcacagccggcaggccccgtgtcctgcttctgcttactcagcatctttccagggctgcttgtgtttgatggcttcacaaagctttcttttttcaagtggtaggcacagggtagaagaaagttacttaggttgccaagattttcctgctgtgcttggcagcaggctttttttgttgagggactggggagaaaggaggatcttgtggcatcttgagacgtgcaagttttgtggttggtgtattctgaaccctccgctgtgtgagcagcccgctcaggggcagtgtacgtggctgatctccactgtcctgcccgcgtggatgggggcgttattctcagtgtacgtggctgatctccactgtcctgcccgtgtggatgggggggttattctcaggtcagcccagtgttggcctccctccctgggaacccaaatccaactttgtcacctgtttaaattgtacagaaggagcagatgacattcctgggccagtgacctgggagccaaggcctgaaaactccatctttttaaagtggccggaacctgagaatcccaatggattgattctaatgtatgaaataaaatacggatcacaagttgaggtaggactggggcagtggcccgtgcctgcatgtacttccatccattgacagcatatgctacctgactgcacaggttacctcctggttagcataggacttaaaacaataaaatccatgccaagttggtgaggatttgggtctttctacccactctgtactctccaaggagtactgcatagtgtgcaaagagctaggctgctttttgccctcaagaaacgatttcattgtgtaagataaccttgtggcataggccaggtcagttctaataacttttaatccttctggagttcttggttacaaaaatgtttggttaaagcttttgggtgtgcttaaagctacttgaagacgaccttttaagatttgatttctttgtctttactgacactcaggatcattgttaggtgggaggtcagatcaggcagctggagtccccagtgtggtgagtttagttggcaggccccagatttctcctgcattcatgggaaattgacatgtatgttttatttccccaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaagtaaggcttgtggagggagaagaaacgtggtaaaactgaaagcagggtggtccaggatcaggacagcccgagtgttcatggctgtcttattttctgttaaaatggagttggccagcttccagaagggtcatgctaaggtgccggcacataccggcactgtgtgtgaaaggttgggcagggcagatgccgagctttgggctcctacctcatgtggcaggaagggagaggatccgagcctctcctttgaggttgtgtaaccactggagagccagaggagacagttgctttcaacctggcttacattcaaagacttttttttttttttaaacaaaagacattttataaagcattgaattgaccattccacctcctacttggtcagtaaagctagatagggctcggattcagggcttgaaatcctaaggggtgtaaggaactccagaggtcatctggttcagcctgctacagggcaggaatctccacggtagcatcgcagaccctccactgtccttttaaagtccccacatgcattggaaatgtacggtgctcaccctttggtacagagactgaggaatgtgagtttatgctcaagtcattaacaagacagaattcttaggctgttctgtgtgatgacttcagattttaaaacaaattataagatgtataagcgcaacaagggccacatacttgttgtttgaccaacaaaacttagtattttggtgaaattagttctgtgttgagtttctgttatttcttatttcaaacccagtttttaagattatttcatgttcatggaatgggatcaaatttggcataacacataaaatagcaatgcagcctcacttagtggtaacacttttgggtctagtgggctgatctttcctggtgtccacatttctgctactcacatctggagttacgttaaaacatgcactccgccgggtgcagtggctcacgcctgtgatcccaacactttgggaggccaaggtgggtggatctcttgaggtcaggagtttgagactagcctggccaacatgggtgaaaccccgtctctactaaaaataaaaaaattagttgggggtggtggtacacgcctgtaatcccagctacttgggaggttgaggcaagagaatctcttgaacctgggaggcagaggttgcagtgagccaagatatgtcactgcactccagcctgggtgacagagcagaactccatctcaagaaaaaaggaaaaaaaacaaaaaacagcgcactcaataggtccagcaatctcacttctagtatatttccaaaggcaatgaaataggtatgtcaaacagctctctgcactcccatgttcactgcagcactattcacagtggccaagacatggaatccacctgatgtccatcactatgtatatgaatggataaagaaaacctggtacatatacattatagaatactattctaccataaattagaaaagaaaaatgtcgtttgtggcaacctggatgaacctggaggacatgatgttaagttaaataagccagacacagaaagagaaataccacatgatctttctgataatgcggaatctaagaagttaagctcatggagagtagaatggaggttaccaggggctgagggtgagggagcagatttggggagatgttagtcaaaggatacaaaatttcagttagataggaggaataagttcaatagatatattgtacatgatgacagtaataatgatgtattcttaaaaattgctgagacaatagattttaagtgttctcaccacacacaaaaaaatgtgatgtaatacatatgttaattaggctcattcagctgttctacaatgtatgcatatttcaaaacaatatgttgtacatgataaatatacaatttttatttgtatattaaaattaattaattttaaaaaagatctccagtagtcacctggtcagcaccagatattctaatctgtttgtgatatctgaaaatcctaatacagacagcaaaagcaggatggggtgaatagaactgcaaatcttgagccaacattttatgtgcctggcactgttcctgggttcaggtttttaggggtaaatggatgtttaggcagataattttgtcaattaaaatagtctgaattgttccatctagtccagttaacctagtctcaccagttagtctatgccacctttgcagcacccagaagcttcataatattcctgcagccttgtccagggtagtggcttgcttgctttctatctttccccagcctccttccctcctctttttcctcccctccatctcctagaaacagatcctagtttgggggtctgtgatctgtgaaacagcaaccttggcttctggggttgagtgaactcagcttgttttggtgacatgacatgttcctgtctggctttgctgctccatttttaaccttgtaagtgccaggatgccagtgggaaatcgggagtccttctgatagaatttttccagcagatgttatcacgtactgcagggaaattggatctgcgtgctggccttactgttgagaaatttttccttatgtcagacaagactctgtcctgctacagtttagtctcatttcctcttatttaatcctcagaggagatggaaggtttggaagctttcaggcaactgccttccttttaggaactccttgtgtgcctgaatactattaaattactcctcagacttctcttttccagatgaaataatctcaggtcttttggccttttcttgtagcccaatatcatacaccagtttcctagccatttaatcatttttgttattctctggatgtgttccattttctccatgtccctgttgaaatgtgaaactcaaaaagaacacagtacagcctgaccagtagtataagtgatataaacagtgatataagggccttgggggaagaaagaaaaatctgccagctttccgttggtaatgatcacctctgagtgtttttaggaattgcaaaatgctggagcctgcatccattttgagagctacaatatcaataaaaatatttctttcttcgattaaaatacttctaattttaaaaattaaaatagctgtagtagtctttaaagagtaaccatgatcacagttttccatggcaaaataatcattgataggggacttacgattaatgtttacttgatccccagtgattccaggcccatttccacatagacatctgtatttggacgtcccagagaggtctcagattccttgtgccaaaaccaaaatcacagttgttgccctcgaaaggcctcttctctcctttgctccttagctcagtcagtggtcttgtaatccatttgttacccaagccaggaacctcacagcatccttcactcttctttctgttcagccacccctttttcattccaacccaagcctcatggattctgcctcttaaatgtctctggaatccagccctctgtcaccaccagcaccgccacagctcagactccaggtcactcgccttggggggatggtatgagctgtcatactgtatgagcctcatcctggggccatgacttaccaagccagatcatctctgtgagtctgcctggtgtaaagacaaggatcagtgacttctttgtaggtctgaactgggtaatgcagagcatgccctggagacatggcatgtccccccaattctccaagacatgacagtgccttctcttactgccaggtccctccgtctgtcctcagcacagccatttccctggaacgcgaatctgatcagttcactgctgggcctgaaagctttcgctgactccttttaatctgcagaatgagggtgaaactgcttagcttgggctgggtcccttgtgagctggccctgacttctctccagtatcatcattttctaggaaagccatttccccacaacccccaaggaaagcatatcataaacaagttttcccttggggaggttccctcgactcccttctctcctctcccttcctctctgaattgttgccatatgtgaagtccacttttctagttgtcatgctacctgttgacactaatttcccatgtcccacagaatgttccagggtatgggtccatgtgcctggtgcccagcctagcatctgccatacaagtgctggttctgatgatcagtggcttctgtggtcttagacttgtagcaggactcaaatgtctgcagcggcattggaaaggggtgccgtccagtgtgtgcatgtgtgtgtgtgtttattttaaattgtctgtggaactatctcaaagattgaggccagcaggacttgacctatacatagatgtagactgtacatagatgtaagaatttctattcattttatgaaaatgaatagaaattttcattctatttattagaaatagaatgcttgctgctgcaagcatttgagtccttttacaggtgtgagatcacaaagaccgcttaccaacagaaccaacacttgtatggcagatgctaggctgggtaccggggacatggaccaaaccctggaacattctgtggaatgtgggaaattagtgtcaaatgtatgcattttcactaacagtcattaaactgcgtacaaagattatttttcttcagtctatcattgaaactattgcaccagaatatactgtactttaaaaaatgagtatatgcctcagtctgcacatatttactcttttttcaaataattgtttgtttgccgtgttctatttctgacaccatttaccttcaggaattcttactgtatgatggggagtaaacgaatatacaggtatttttttcatacttccaactgaatgtgaagaaatgaaatgagcaaattgttcacctggtgatattttatcatttcctcctctttgctgcagcaggatatgaaaacttcatccatctgatcatcgctctgcccgtcgctgtcctgttgatcgtgggagggttggtgattatgctgtacgtcttccatagaaagaggtcagtgatgtgcaaagttatgacactttctgtggctgagtggtttgatgatttgaatgtgagtgaaggtgatatttttgaagatttcaaggaaatattttatggactggaaaacctgattttcccatcaaatgttcttccaggaaaagagaaccttttctaatgattttaacaacagccaaaataatttttcgatggtacagaccttcccctggctggcttttctggtatacagatactgctgctggtgcatacttttccaaacgcgatgcgctagccttcccaatcaaataagcctttttatttccaatgaagtaaagaaacagatgtttcttaaaaagcgctaatctcaggctactgaggaagccagaagatgtgttagcaaatgtctgctggctcacccaggcctgaattgggagtgtagacaagagctgctgtagacagtaagctctccccattctgttctgataccgtgtgagagaggataaatgaaactgttgtagcgaagatgaaagtatatacaggaatgtatggaggtggggttttgttaacgtgaatttaatctttttgacagaaataacagcaggctggggaatggagtgctgtatgcctctgtgaacccggagtacttcagcgctgctgatggtaagagtccgggccaccagcactgccagcgtgcagggcaggtagatcgggagctttcaggagggttgctaatttgggaaaggaaggaggtttgcattattttgagctacctttggccttggatctgtcttcattaatatttctttctttctttttttttttaatcaaagtttttagcagttcagtgaatatgtcaaaacttgtgggactgtatggggtgccccaaggaaacacaggctttagagatgaatgtggccagcgcagtaatcaatttatttaattgcttgagatgttatgctagaatgaaaacagctttttaattgttaacatctagtcagaggatatgctgcagctgacaaaacagtccttttaaactagtttcagcttgagtatcatctcattataattgtctttgatgaattacagctctgcttttttttttatcatggaatttttctgtcattcccttccgactagggtcatacgctcgtggctcattcacattccccttggtaataactaatgagggccattcagttaagtggctgggaaggtctgacatggaagttgggtgatcctcaatggttatttccttttttgctctttctagcatttttatatccagaccttttgagtgagtcggattagggtgaggggttggtcactgagtccagtgatactaggacccttaactggcactttgctaggggcttttacaaacaccatcccatttgtttcttaaacccctgcaatgtgcgttttcttaatgcccatctgcaggtgaggaaatgaactctgggaaaaaacttgtgcaggctcacatggttagacagttgagaagtcaggaggagaatggaatcactgtggaaagggctgtgaggtcccccgggcaggcaaggaaacagccctcaggaggggctggaccggattcatcaaatgaataataaataagtgcatgatgttgagtgagtacatttagaaaaagtgtttgctgtcttcttgcctcgggagaagtgaaagtagatgcaggagatgtgaaataaagagacatgattattctaattattgtgatcaaataagaaaacataagaaaatactttaataatgtgaaaacaccgttatactatgtagggttttactatggtttctttaataatttctaattcagtttatagtaaagtcaatcaaaagcagcctcctctgaatgggaatcaggtgcagaataatgactttatttctatctacataaaggtctcacaaagttggttttttaatagtaatatatatatacatacttctgtagtgtgtgtatataaggcagagagaacattctggacggatgcacaccacacttacaagagttgttacttgtggagaggatctttccctttaaaaaaaaaaaaaaaaaaaaagccagatgtggtcgaaggcacctgtagtcccagctactcgggagactgaggtgaaaggattacctgagcccaagagctgcagtgagctagaatcccaccactgcactacagcctatagagcgagactggctcttaaaatccagcaagaagatagatatgcattgtttgtatgaataatagcttctaaaaagaaaatcagtaaggaagggagtcatcccagatgatggaattgatagaacaaggcaagaccactttctccctctgtgagggtggactgtgactctacgagagaagctattctgctttgaaatgcggcactagaggttggtgtgtgtagcttttgactgtgaagtgtccaggaagagaaagcatcaatacaacaaattcagattctcagggctctcatggtgacttgaattcacattttgtgtccttctagaatgctttcatgatacgtcttggtacttcattacaacaaaaacaaacttattgccacccaggtcgacaggtgggaacagtgtcaccttatttgaacttaatttattcggcctttgagaagcacttatagccagtttcctcgaggggcaacaaaatgacattgcagttcaaaagtgctttaaaaacttctttttcccaaagctataatctgcatgtcaccattctccagagtacattgaaaatcccctacaggaaagtgctgataacattgtgcacagaaaccgctcctggctggtggcactggggacgcctgcttaaagtcggagccgttgggttgaatcgagagaaaaggattgagcgtattgacttcagggacctcccagggaatgaatgtgattggtttcaactccatgttttatggcaggctaaacagttaattctgattaaaagcaagcctggattctcagagataaatggctggagacagtgaactctttacactttctgaggcgcattgtgaagagccttatctcctgggttgtcttgcatacttactctcctctgacaagcacccgcctcttcttcaggggtgcaagccacctatgccagctggagggcagagttccattcgtgaaacccttgaaacatacgtactatgaaatacaaaaatgtgtaggaaagaaaacaagattattaatgaagttcatattggacacccctcagaggtctaaaatgatggtgcccctcctgggcctaatttataataaacatctctcctttgagacatcacttaaaggttgatagttgggatatggagatgttaggatacagttgtcagcctctcacatccagccacaggcccagggtcagcatctgaaagcatgaaagcaaaaacaggcaccttctccacctcctttctgagccaggaccacctccttcccacagtcagtgtgtggtagagcctggtggcaggtcccgtcaggcaaggacattagcacacagcgtcagaggaattactgacatttcatatggatcttatggaacaggttgattttattttcgtttttaccctacccatttggaggtgtagaattgagcctgtgtttggttttgttttctttctttccaacctttttcctttctttctctttgttttgccttccttcctgcatagaaatatttatttattcattcattcatttttttgagacaggttctcactctgttgcccaggctggagtgcagtggtgcagtctcagctcccagtagcctcaacctcctgggctcaggcgattctcctgcctcagccccctgagtagctgggattccaggtgtgtgccatcacacctggctaattttttaatagagacagtgttttgccatgttgcccaggctggtctcaaattcctgggctcaagcgatcctcccaacttggcctacgattacaggcatgagccaccgcacacggcccatttattttcttaaaccagatcgaatctaaacagaaacagaaactggagaagaaatcctattcaggcttggtatctactgtgcattcctcccaaatctctacccattggtcaaggtccctgagttcacagagcccaggccagagccctggaaacgcctctgcccgtccgctgcctaattgcctgtccacgctgggcaccaccgggtctctccctcagtctcagagctcagttgcttctgcacctcatcagggatccagccatcaaagccaaggctgggggacacttggactagagtaatcctaccaataatgcagttcagctttgtaaccgcaaattttctagtagccgtattttttaaaagtaaaaagaaacagatcaaatgcattttaatagttttttagttccaataatacgtttcgtgtaacccagtatatccaaaatatccattttaacatggagtcagtattaaagttacctaaatatttcacttttttttttttttttgtctaatctttgaaatcccatgtgcatgtctcaaattggactggccacatggaatgctcaggagtcccatgtagggaccagctgccatgttagatagcccaggcatagcatctgtgttgagggccctgacacctcttttggattcatccaagaagtaggaccttacgtgcaccatcatcacctctcatatgtgactctggcctttttcccgacccagcataagaactcttccctctccctactactctcctcctttttacatttgcgttttaatctgttggtgaagatgggtaaaatcctgcttgaccatttcattcagtttctcaatcccctgtggttaatttgtttttttcaaaaatgtgtttttatgtgatgaaaagaaatttttaaaaaccaactgctttctttcctatactagacttccttgctttgttctggtccttctatctgttagtatcctcaaattatcttgaaatcctcagagatctgaaatactagtactgactgtacagttttcttactcaaatctatagcatgtggaaagttgacatcaagccatgccatcgcctcctggtattctctgtgggtttaaggaagcagcatcttatattctttggcttagagttcccccaaagcacgttctgtctaagggcttgtttctgtacctgctttaattacggtttcttctccagtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtaagagaaagttcctgaaaagccaaaatgcagcacagggagagggtatcacacaagcctcccagtatgttcttggctgcatgtacccgtgggtttggtgtcttgcctttgccttctggatagttaccccattacctcactgctaccttcagacccctgtgctcagaccaggccgcagcaccacagagacagttccagacaacacaggcatcagcaagggccacctgaccctctgagtctttctctttttgattcctcccaggtgcgattgctgggtgtggtgtcccaaggccagccaacactggtcatcatggaactgatgacacggggcgatctcaaaagttatctccggtctctgaggccagaaatggaggtcagttttcatttccaccggtattgcatgttgcctggcctgctctcttttcctttataatctccctgcaaggaaatgctgtgtctttaaatcagtttactttccagcatccagtgtttcttactgcatgctcagttgtaggtcatttatgcaaaggatttccccaactagagtcagactctgatcttcgtgaggggaacttcctgttccttggatcccctctgctaagcccctctgtgcctttgttcctgcattccctccacccccagtcccctccccacatcagtgtccacctgccaagccaggccagcgccactccctccccgaagctttcctgccccactccagtagctatcttctctgctaacttctcgatgcgcttgactcacatcctcgtatgtgttctctctcgttatgttgtgttgtgctgttgttggagtgtgtcccccctccaccccgttgtgtttagcttttcatctcagtccaagtgtgtggctcagggccgcatttgtggcaggcactctgtcaataaatgtatgttacagttcaaggttaagctgcctggattcttgcccttgcatctgggaagttgctgggtgatttcccacccagctccgtgcgcaagatgtgcactcattcataaaccccctccccacacacagtccccttccccggcattgttggcggtccttgtctttgccactgggaatctggtttcctcagactctacgtccacgtttcaggattgatccagagtcagtgtcctgcttacgcttttgaatgaatgatcccacctcagctgcaggatttctgcttagtttcctaaaaatttcactttgggttatgagcttccaattctaaacctgctaaagtcctatgcaatttttcattaaaagtcaccgtggtgtctcccccctctgtagtattaacccacaggccagctttttaacatatgcgggcatgacttttgagtaattaattctacaaataaactgggagataaatgctgagacataaagccagcaagaactgagttttcatttggttgcctccgtgggtctgaagtctttgacccttactttgctgcttactgggtaagcagtgtgtctgcttttattccttagaagcagtgacttccccttctcggcccctttggaaattcttttgctgttcttcatttgggcttaatttttttttttttttaatgttctttgaatcggcaacttaatcatctcccaagtgacagtttcttaattttagttccaaacacctgttcacatatgacttcatgtatttgcagcacatggtgtttggggccaagtgtggactggggcttcaagcaggatggtttacaaaactcccaccctctgttctgccaagcattggtccccagcacccctgggtgttagtgcctcttcctggttcactcactcactttctctggccctctctgtgtctctgtcactctctttctttcgagatggagttttgctctgttgcccaggctggggtgcagtggcatgatctcagctcactgcaacctccaccacctgggttcaagcgattctcctgcctcagtctcccaagtagctgggattacaggtgtgtaccaccacgcccacctaatttttgtatttttagtagagacggggtttcaccatgttggccaggctggtcttgaactcctgacctcaggtgatccacccacctcagcctcccaaagtgctgggattacaggtgtgagccgctgcgcctggcccttggttcactttaatacacaaaacagcatgaaggagaaaagcttgatgaaataggtgactggagatctggcagagtatttcttgccagcatcgattgaggcacctctgaaaagtccaaaactcactcccttcctccccagtttcaggcacagaataaaaattcagaacacatggccttggtcctggctctgcggctggctgcctgtggtcctcagacagccgctgcaggttcctgggcctcagtgtcctcaatataaaataagagggtgggacaagattactgaagtccctttcagaactaaaattcacctttagattggtcagatttaaactttttctttctagctcatgtcaagtattaaaatgtgtgcacttaccctgcagtttcattatattcaacctgctcccccgaccaagtttcacttacgtatctcactacgagtaggtgtatatgtatacttgtcttaaatagctctaaccaaattaaaggaaagaatggcagtgtaacaccatgaactgacaaaatttcagccctctgtctttctccatgcttaaagttgagtgcttttgttgattctgttgctcacggcaattataaatgaccacttcataacacatataggtcatactgtaatatttaagaattgtgagcataaactttacatttcatgtgcatatttcctcatgcatcacacgtatctaaagccctgaaaagtagtgatttggacttacccccagtgacttaatgttgcttccccagataaccacgtgataagtgttttaagtcaccaagagacagctttgacagcctgttcagaattcaaaggtttgtgtcaccaagtgtagagaaccaacccagaagtaccgaggagttgttataatgattccaaatactagctttcagtagaaactagcacctcacagggcagcagccagcatccactgggcattgactatgtgccacgcaccactgggcactttctgtgcgtggccccaggtcatcttctcgtcagtgaaaccactgtgataccccatgtggaaaagcctgggcatgctcagctggtggccggcctgcaagtgtgggacctgtcagagccctatggctttgcagtgctgtgtgagatgctttgtggtcaagaaaaccaaggtgtagagtctgttgcacttgtatatgcaaaagtaaaaggtaacattaaaattagggactagtgattgttttaggatggagagacttgggcatgtgttttatataaaacttttttctaaatggatgtattatttaagggtaattctttttaattccaaagccagcacgttgctgtcctctgcaaagaggaatgcttatccctgttacttattcctggtttcctccaagactagtttcagctggacttcagttgccaaggacttgtcttccgtaatgccgacagaaaataataatgccacattgtaaggtgaaaacagtaatcctggtatttttgtattttagaagaaggttgaagggaaagaaaaggattaaataatttataacgatgctcttatgggaaataaaatataccatgtccatttggaaacacatttgcttacttccacacagcctttgtaacgtgctctccttcctcttacctgtacttcggtgatggaaataaaaggaacatataaacaaataggaatttgagtaactgagaatccttactaccaaaaatggcttgtttcactttaaaaaaatgttgccctacccaaaatagaaaatgttggtcctaaagagtgcaaattggtgtttccctcaccagctctgatgtggtcagggagcaagtgcaaataagcttgcggggagcaagcaggtgccatgctctccatgatggtttgttccttccgagcaagtcctggtttcttagcataaacaacccacggtgcccagattgaacaaagatgatatgcaaacctcgaaagaaattggcatggaaaaaaaaaatccaaaattctcatgtgaatttttttaaatctccaacagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggaggtgtgtccttagctttccaggtctgggcaagaactaaactcaggtgttttgaggactttgttggcattagtctgcccctggagaggttttctagtgtgtcccttgagtgcacggactccttcttgggaatgatgtgattgtctccagttgatggtcacaaacctggcacggtcggtcccaatgctgatagctcatggacatggtggttcagatactgggcacggtccctgaggctggctctccagacgtttgaggcatttcttggtagaacacctcttagcattggttacagaaataattaagacaatgtcttcaggagattttgacttgggaataaaactcactgtccaaccttgcattcatccctccaattttcctagcttttaaggagcattgctccccttccagggacccacattggtttctaagaggcaagctgccctaatgacgaagcctctgcacggagcaggagcagtggcaggagctggcatggcagtcccttaggtgagggacgatcactgctcactgggtttcacggctggggctggccagcctccaagctctcgaccactctctcacaacacttactgtcctgctcttagctcaccagcctactggttagactcccttgttgccaccacccactgtcacaccagaaaaaagggttggattgaatttctgagcaatggttaaaacccacttcagcctttaggtttgtgtttttacttcggtcttttaatctgcctaataaaaacacacataacatcagggctgctcaggaaaccacctgcttttaccaggattctcatcttcccactatgatacaatgatagtttagaaaaataccaaatatttatcctgagaaactgcaggggagatttaacacccaaaagaagctatttcaaatggacctctgtgtctagttcttgaactgccttttctggaagtgttcaccttcctttagtaacatatttttttcctttagtagtgatgttttaatgaaatgttttagcccctttggtgaacaatgagaatcttttagagaacggtttctttttttgagacagagttttgctcttgttttccaagctggagtgcagtggcacaatcttggctcaccacaacctccacctcccaggttcaagtgattctcctgcctcagcctcctgactagttgggattacaggcgcgtgccaccacacccagctgattttttatatttttagtagaaacaggttttcatcatgttagccaggatggtcttgaactcctgacctcaggtgatccacgcacctcggcctcccaaagtgctgagattacaggcgtgagccaccacacccagctgagaatggtttctaaagtaggggtgagtgtctttctttttactctgtaggagctagaggtattgaaatggaaccatatcccagagcccacatccctccgtcatcagagttcctcattcaggatccaccagtgtgtccctaggtttggcacgttgagacgtcctcacgtttggtgctctgtgaagctgggcagccctcagagaggcaaagaagtcccaagaggccgtcctgcctcagggctctcaggaaagagccgcccgcgtccctggctgggcttccttggtgcacccagctcatttctccttccctctctgtagaactcacattgtccccgtggaaatgccagccagctcccctttcccagtgcaggggggagccaggtgggcctgaggtgggccagttctgccgctaatgggtgagagacttgggccaggtgccttacatccgggagcctcagtttcctcacctcggaaatagggtgataatgtaacagaccccatggggttatgagaaggacttggtgcaggaaagcagcagcacgtgcctggcacagggcagggcctctccagatggcagttcctgtctgtgtcttattcccaccctccgggcacatggggggaactcagtttctccccactgcgcgtcaccctgggagaggtgttttttgtgccaattgccattttaaatccaaatcagcagggatcatgtttgctgttcaaccatgtggcatatttatagtgattttttttgtaatcatggtttttctttctggaatttcaagtttttcatttgtgctgaggaaggtcgtttgtgttttttaataggattccttcttttccaccttgtgcaagtaaaggcaaatcccctatttgcatgtcactgtattaattcacagataacactttcacacttcatttttattcttctcaagggctcaagatgttttcccaatgcccagcgtctcatggatgacaaatatgacaagtaattttaccagaggcagtttgagggctcttagcatagcacaagtaaattatgttggttcaagtccaaggaactttgttctctttgtgtttgcttttgtagccttacctctttggggcatgagttagagacatacatgagcattttaaagtggagcagccctttctcctgggaaggagaacggaagagtccacttaagaaaaggttgtatgattgagtgcaaaatcaaaatctgacaaagcagcaataatttaggattataaagcgagcctgccatcaaacataattatgtggcatcttctggagacatggaaaatggaagaaattttcaaaaatgagtgggaggattatgttgaaaaacagtattgagtaatagcttcaggggcctcgtaaatagcatcttttcggcatcttactgggtacttttgtcatcatgaattgttaccctgaatattttcccccttattaagcagtgaaattatttacttttctccagtggtggggcagtgctaccaagttaagtaagcatctgtactctcctgtttatttggtcaggttttaaaaccatgtgtaaatgaccagtggtctctgcagtactatatattttcttaaattgtgggactctaatttttacaccgcttccttttttcttatttttattttcaagacaggttctcactctgtcacccaagctggagtgcagtgttgtgatcatggctcactgcagcctcaacctccagggctcaagtgattcttccaccttagcctcccaagtacctaggaacacaggcgcacaccaccactcacaactgactaatttttaaaattttttatacagacagggtcttgctgtgttgcccaggctgatcttgaattcctgggcacaggcgatcttcctgtcgtggcctcccaaagtgctgggattacaggcgttgagtcactgcgctcagcctgcctctcatttaaatgcaataagggcattaacttcctaagggaatcaaattgtaaatatattaaaagtggagattgcttggtatttgctcatcatgtgattaatcatcccttactgtctccaccttataaaattgcaaaccctaatatttggccaccttaaagtgggacgtgtctgtgtcttgccttgcgtctctccacacataatgagtgtagggtcctctgctgtgacagcagtggtgcctgctccagcgtgtgactctgcgccctctcttcccttacagattttggtatgacgcgagatatctatgagacagactattaccggaaaggagggaaagggctgctgcccgtgcgctggatgtctcctgagtccctcaaggatggagtcttcaccacttactcggacgtctggtatgagaacctttactgcattgccagcctggagcccccagcctctgcactttccaccagctcagtctctagggctttatctttctctgttcattgttacccgttgccagctttagctcagtgttgtgtgagccacacttcttcatcattgaggtgttcctgttgtcagtgggctagctaagggcagaagggcattcgtgggattttaaagaatttatgggaccaacattctttccgccttcagcagataccgattatgtttccaggaggtgggatgtgccagaagccgtcacctctttttgtttctcccctgcctgccttctttctcttttcctctttctcaataaacagatactgtctgtgtgtctgcctcacctaatctaaccctcagattgcagacagtgctttatttagacccaaagcttatgagtcctgattgtgttttcctgctggtcccatctgctgtctgtctttcagtgggcatccaccgttgtggacccagggatggttatgggaagcaaaacgtctcccttaatcataaacagtgtctaccagtggaagcccatcgaccgagggatcagaggcctctcagtagtattgtttattgcagttccttggcaacattgcagagaggcagtcaggttctgaaatacaactgaggttattggcaggctgaggccctggcacaggcaccttctagaatatcagctagtgtcttggctttcctctggggggatcccgttgctgttgtgttacagaaatggtagttgtttactccaacagtctggatgaccgcatagaggaactatttcaatagtgactgacatcattttttttttaacctcgtaaacctttcacagttcaggggccttggatcttattttgaagacaggtgcaaattggaaatagcatttgaatatgacccggcaaagcatgattgcttcttaagctcaagtatgagatctgttttgcaatcagcttgtccaagatggttatctcttcactgtcaaatcaaagtgctctgcatggtgtttagagattgggatggtgaggagagagcaagcctgggtatgtgcatgcatctgtttattctaggcttcgtgcctccaggagcttggaggtcagcttgtagtataataaaatagaaaactatacagccggggagaacagaagcagaatagaaggataaagtgttgttcatatctctcgggcaaattttacccaaattctgacgagcagttactgcacaagcaacaacaaagggacctagagtgtgttcattgccaattctgtccatttggctacataactactgtgaaccaatacaaaaagatatgtataaacatgaataggcgtttggtattcattccatgaaatgctcaggcattgacagcgcttcaggttttgtttgctttttaacacaggctttgaggatagcacaggtcaggaaggctagggcgttggagcaggtttctcagcggtccaggctctaaactaaagctgtccctctcaaaagaatggaaatgatttcagattgtattcagcagcacgaagcaatgattcctaaatagttaaaaatctagaaagaaacactaagaattgtattgggctttgtagaagagaccccagaattttaggatttgggatgtatccctgcagtcaggcccagtccccagtgcacctgcagatctttgacagctgctggttgagcttctgctaagaggtttccttccagggactccatgttcactgcctcacaaaggcaggccagcctcatgctttagacatccttgctcttagcaaatctttcgtgttctgctacgtcagcctctgtgtgacacccattggaccttctctctgtagcacaattgcataccttgctctgttcttgataagataggtctaggagtcatcgaagaggtgtgtctgttctagccagaacacctccaagtttcctgctgtcttccaggacttcattcccaggcccttgggcactgtggctgctctccctgcagctccctgtagcaccatgtccctctgaaatgacaagggtgccctctaggcatggaggaaaccagacgaaggactggggagctgcaccccacagcctagagctgtgcttcttcccgagcatctggatcacccaacacataatctttattttttattaagaagctttccaaatagtcacaaatagccaaggttatttgcttctttcatgactaattaccatctgtggggaatgtggatttctctgtaggttttaatttgctggtgagtgggccattgctaccatcccctcctggtgtggggaagtatagttactgaatgctgcctccagccagcacgggcattgcagggggactcacagccgccggtcttccccctggggaaacaacgtcaaggttcctaattagaaagggctttacacagagacatgtatctactgtttgaagattaaatctgtccatgaaatggaagacttgattttatatgaagtcatgaagagccaacaccacatagtaaaataccggctttgaaaaacacagaggtgttgcatatttctcggtgcttctgactggctgtgtggccttggttaaacctcagagcttctctggccttcggttgctccatctgtaaggcaaggtctgtctcgagaagtctgcggtacctgaatagatgttgaaatggctcctgtggcaactggtattgtgtagagatggttcagtgtccacaccttgcagttgtcacattaagctgtgaaggacgactgactctagcactcagtggtcctcagtggcaggtgatgttgacctcagacaagagttgctcaggagataggctttgcagttcacctcgacaagcgtttgtggagagctaggtctgctacctcctgtatcgttgcctgtgggtgatggtaaggctcttgggggtgtggaagatgcggggatgatgatgatgacgatgatgacgatgacgacgatgacagcgtcgtcgtcgtcctggtcctggaaggataaagtcttgtggagaagaggaggcaattctgacagtttggggttgcatcatcttcttcacagaagagatgaagttgtgtaggcaccctaagtatggattgtcacaaaaagagcactaggaagcggggcggggcggggcaggggtggggggttcctggcagtgggaatgctgggcaggcatggcagtagggagcacctgctgcaggtggggttggtgaggtttcctcgtgggacttaggctgcagagagatcaagacaggcctcagctgttgtattaggcatcctggactaattctttaagccctgttaaggtttctgaaccagagggtgattagagctgtgcttgaagttcttgttagccggagtatacagctgcattgagcaagatgttgtaaccaaaggagaggtggtggtgggccaggcaagcaggatcctgcacactcagggagctctgagggacggaaggagggtgccagaccttggacagatgtgagcctgggtggacagttcgcagtgggactccgaggaggccaagggcatgggtgacagcaggcagactgctcgggtggaatgggcatcagctgcagggaagccgggggaagaacagggcacaaatcggagttcagtgtgagacgcagtgagtttgtgggtagcccagtaactgggaacttggaatggagcagttgggccgggagggccagggtgggagccgtgccgtgagaactggctgcctgcaagccgctgacacagccaggaagggcacgtggggcaagaggagaagtgggtctgggagggagccacatcctcaggccatttcccagaccagcctgcagtcagcaaaagcagagagctagtcatttcttcttattttatttttaattttttgttgttggagagctagtcatttcttgtaccaagctgcatttcagatgtgtgggtactactgccactggcatctgaggcatgctgcctgtatggctgggctggttgtggaaggcagagcttcccgcacaaagctgatggagagccccttctcccctgggcccaggcctctctaaactgcacttttggcctctgggtgtcttgtacaacatgaagacgacagcatttcttggtcacttgtaattaaaaaggaccttgggttggtctgtcctctgattgctaagattctatttctgtctaacatctacttttagtatcaatttgtacaaaaatctttgattcaccgaaagtagctgaagcagcgaataaaacgttctcatacagtcaggagcactgtgggcttgggcacaaggtcaaggtcccaagagctcttggttggaaatctcctgccccaggtttttccatgtggcttgaccagcacctgcagcccaggacaggtccagctagaatccctgctccccaccctgctcccgcccctacttggtgatgagtagcctattttactccaccaaagtgaaccacatggaaaggcacacaggtcagggagaatttgtgaattacggaatttgccctgggagggcacatttgttttgcagattccagcattgtcttttttaacattctgtctgaaagttgtgtgtgtactctctgttttgttttccagtggtttgatcttctaaactggcaaagctgcatgcatatggcagaattgctcactacaaagttattcctcagccaacttctctgcttaaggattctttgtccatgataccccctcccagccagtgcagcccaccctggtccccccacctgtgacacagaggccctgcaggccagcagctccccagctctgttgtgggtgggggagcagcaggagttctcttctcccttggcccaactggacctcaagatccctatagatcttctaaacattccaggtcccaggccctcaccccagaccaatcaaatcagagtttctattgggtgcccagccctctgtttaaaaacctccccaggagattctcctgtgcagccggcagtgagaaccacctgggtagaggtttccaaaattgtctgattgtaaaaatcacctgaggagcttggtaaagcttgactgtcccaggcctcatttgaggctactaagtcaatgtccaggctggggcttggacaagaatgtcattctttttgggtcaaagccaggttaggtgataccgccttgccagataaatggccgggactaggtagatgctgaacccagtatgctctgcgttcaaagcacagatcaggggcttcctgaccgtgcaagggatgccggaagcgccctcaccaccttccttagctccaccaccggggctgaatttagtttacggggaacattagcagcaacagagggaggatgatatcccgcacttagcccagggcctggctcgctgtctgacaagcactgtcaccatagtaaggacagtttatctgctcgggatgtaagaagtgctggaaaggagggggcagcattgttcagtccatccctttccaagctcctcacagtttttttctccctgtaggtccttcggggtcgtcctctgggagatcgccacactggccgagcagccctaccagggcttgtccaacgagcaagtccttcgcttcgtcatggagggcggccttctggacaagccagacaactgtcctgacatgctgtacgtacttcctgggccctccgtgctcttctgagttctcttctcaaatacctgttttcttgggtcacaggagattaggagattaaagccattctctctggtcctgcgcctcccttgccaggcgtggctaagaggtttgtccttgtggaaggagctgagtgggttggtcgacctgtgcttttccgtgggtaccttaattctaccccatattccgtaatgctttcgttccgatttgcagttcacactgtagtttctcaggccaaatgtctctgtgaaatgtttggccagagtaatccatccttactcatcctctccatgtgaggtttttgtttctttttaaagaaggctacaacacaacacatactactctgaagtcgaattcaagagccccgcgccccacctgtggcaggcctgagggagccgccgcagtgagtgtgcacacagctgcatggccaggactccggcatgcaccacgtagggtcagcttggtgtcttctgaaccctgccccacatgtcttctctgttaagtgtttacaaaagtcataaaccatctaagtaacatgctctccggagcttcatccgctgaccaatgtggacctggagcgtgtgtgagctgacatccctgcggacagaaggatgccagtgctggtgaatttgtcttctcactgcactttttttttttttttttgagatggagtctcgctctgtcgcccaggctggagtgcattggcgtgatcttggctcactgcaacctctgcctcccgggttcaagcaattctcctgcctcaccctccaaaatagctaggattacaggcacccaccaccactcccagctaatttttagtagagatggggttttaccatattggccaggctggtcttgaactcctgacctcagatgatctccccgcctcagcctcccaaagtgctgggattacaggcatgagccatcgcacctggcaaccccacttattttgaaaaaacactttgcagcttttagtcctaagttttgtcagatgacgagagagagtttgtgatgcctcacagtgttggtgaggcctctctgctcagcgccccctggagaagccccccttttggtggaggacttgctctgtgtccgtggacggtgctgttttgtggctcagtggaggtcagagctgctggagcagggaggccttgttgtccttcctggaatgagtttgaggagggggtgaaggtgttccagttcagtcatcaggcgcacaacaggtacaggttgggagcagtggccttgcttttgacatgcactttaaggcaggcttcagagattgatctggatctccatagctgaacaggaaggtgggctcccactagtatctcaagaccaattcaggagatttccagaaatgcttttcaggacaggtttggcttcattttggaaaggatcctgaggaattgctgggctgttatgtctgcatgaaggcacccagctcctatctctcacccatccacccccctggagccagcacagactcaggctgggcccacagtggcgggataatagatagatatgaaccagacatgtgtcaggtggacaggagggaatgagggctccagcagccacaaaagttttgctcatttggtctcctacagtgtctgtgggccaggaatccagatgcaggtgttcttgctctcagctcagagtcacaggaggcagaaatcaagatgtcagtggggctgcagtctcacctgaggctcagggacatcttcaggctccttcagggttctgcacttgcaggactgaggtccccatattcttggcacctgtcagctggggactgctttcaactcttggaggccaaggccactcacagtccttgccatatacagcctccataggccctctcataacagcagcctatttcttcaagactgataagaggacagctctctactgcttctactggttttttacctgataaagtcagatctacccaggatactctctcccttttaagtgattcacagtcaattgatgagaagcctgattagaggagtgaagtatcctctcatgttcacaagtcccacccgtactcaagtgaggggattatatgggatatttacaccaggggcaacgatcttggggggcatcttagaattccatagtctcagaaatcattgtccctaatcaaacaatcaaggtgctatttttgtttcaaagcactttgagtgttgctacaaatactgaatccctaagctccttgtaaatggccggccagcggagggcatggggtggggaagactggatacacacccctgtgctctgggagtacgttggctgggcggcatgctcattagctgctgcttccgaacataggttcagctgaagtgtatcccaggcagtggacacttcgtgtggaattcagaaaggtggcgcaggaaggataccagggaaagccagagtgaaggcatcacccttgcacagctagcacatgtgggggctcccattgtcccatcaaggcagggccagaaccagaaagtcggctggtgccctgggcctgggccagtgatgggaggctcctcttctctgagggtggcacctacagatgcagtggcactgggtttcctggagccctcatcaaggaaacttcccagcatggcctcttcagaactccacaatccaaacttggaagagactcgaaagaccacttagtaccttttcttgcccagtatagaaattcttcttctccccttctgtgttagttttttatcgcagtataacaaactacccaaaacctactagttaagagcaacagtaaacatgtattatctctcagaggtttctgaaggcgaggaacgcaggagcggcatagctggctggctctggcttggagcccttctcgcggttgcagcccagctgtccgccggggctgcagtcatctgaaggcttgcctgggggaggcagacccacttccaaggtgttgctgcataggtagtatgccctgcatgaatcgccctgttctacgtgggcctctccgtagcactgcccaagtgtctcaggatgtgtagctggcttctctgagtgcagagttcggcacactctttctctaaaaggccggctaaaaaaatgtttttggctctgtgggcccatacgaccttgactgtgactactggactctgccactgtggagcaaacacagctgtgggcgtcacataagctagcgtggctgtgttccaatacagctttatttttaatactggaatttgaattccacatcatccctgtgttgtcacaaaatattcttattttgaatttcttttagccatttacatgaaaaccattcttagctcatagaccttggaaaactaggcagcaggccagattttacccacaggtacatagtttgcctgctgtgccctagagtaaaagatccaggacctgagcagaaggcacgacgtcctttctgaccaaacctcagaagtcacactgaggctctcaccttctccttcaggttacaccatgtgagagtcaatcacgtggggatgtgagctccaggacacaggggagaggaccactggggatccgggagcctggctaccccccagtaccccaccaacacacacacacacacacacacacacactgcccctcacaggtgaccatctgctccacactttgagcagcgcagccactgttttcttgccagccattatgagaaaaatcatgctttcaagtctgaatataagccatggagtaagaggtctgatgaccactgaatctgcataaaggtacagtgctagaatctaggctaatactagaactggtggtattttagcaagcttagaaacagcccatgaaagcaggtgtgagttctgcttctgtggtttagggtgggtgagggagagcggtattgttctgtgctttctctttgactcgggtaaacgtttatctacaagagacttgtgggattcttacttggtccacctccaggtgactgggcttttactattaatgtaaactgcctgggacgcagcccctgccatgggaaacgcagggcacttcctgttctcagcatagagtgacaaggaaatttactcagagcggttactctgacattcaatgtttagttcaggaggcatttctgctttgccatcgagaatttttctcccttctaagaaaatgttttctcctgagaaaatttttctcccttccaagaaaagagtagaatgaaaggaggcaacttggtttcatagggagtgtcatgttgtccttctgagtttactgatgagcttacctgagaaaggagggttctagcatgggagttctgttgctacaagacatgaaagaatggcctccgtttatcccggagaggagagtccctgagcccttgggagttgccttgaaacctctgccgggtcccaggtgagaaagtgtgtgagttgtgtggttctgagatctgaacaggcaccatctggtgacactaggggctgaaggagctcggtggctgcaggtggactggagctcaccatcaggaagtagccagattctcacccctcagtgtcaccgagtgttctggctttagaggaaggactccgtggtccccaagccacaaggtgtcgaggtctgagtctcaacgccatgactcagtgtgaattaacttagcaggtatcacaacatcagatttgggttgtggttccctgctgggtctgtactttagattgatgacaaagcccgtcctcagccttatttcagcccagatctcggtatttatgccacagatactgttgagctcctctgggtgcgtgctgaccctgaggtcacacagatgagccaggagtggccctggctttcaggaaacgtagtgacgtaaaaggtcccggctgctgcgggataagggccagggcagaggtgtgaacgcagccgtggaagacttgggccaggaagccatttgttctgctgctaacacttccacagctccacgtgtccagactgttgccagagacgtctttggtctacaggattcaggagggaatctgaactttagcctggagcattatcaactcatagatgagtctgaaacaaacttagtgaaatctgatgttttttgtagttttccagtacagtttttcccatcgctggaatcctggtttggttctgcgggaatcgagtgcttgagtgggacccagacagacaggaagggcgctcctgctcagttagccccagtaagctcactgaggcacacaggccccatgtccacagccgctcctggctgaggcgtggttcctaagacgacccttactgttgagggctgccaggagggagagacacattcagccccgcaggtcctctgggaatccggtgagcgtcggcaccgggctggggccgtgctgattcccggcagcgtgtgggaatgtgcgggtgcctcgtggcctgctgacatcgcacacaggtcacagcctgtccagttcaggacatcagggccaagagtgaagtgagaatacggaggcacctctgtgtgctcaccctgctgaccgtcacccagcctccggggggggtcacagctggcccccaggaagctgcttcccagcagggcaggaattccatttgagtcttgtccctgttccaggagaagggctgggtatgtgtcccccaaaggggagagcattcgagaaggatggcgccagcctccccagaactgacctgtggttaaaaaaaaaaaaaaaattgtgctttttaaaagatgagttttatcagctcacacatccttctagagtctaatggagattttttgtgtgtgtggaaatagtaaacaaggtcttgaatcccacagagcaaaaaagacttcctttcatgggcagcactggaagggttgttactctggaatggtttaaaagaggcgtcacatggcttgtttgtgctgatgtcactgcctcgctgctctcctgtggcacctcctcggtccctggccacagggcacagagccaagcacatctcatgctcttggcccagttacgcttctgcccaggggtaagtcagctggagaggaattcacagcccaggcatttcatgtcgttatggcctattttaatttttttaaccccaatcatttttcttaggaagtgatggggagtttggaaaggcaggcttatttgtcatcaagctgccagcttttatcaatgcaaaccacatccctgtgacatctgtgactgttccttggacagttaggtgagggagggtctcctggtggccccagggttactcttatttaggttgagaaaaattcctttttccaggatcgttggtgatcaaagtgtagtcattctgttgcgcagagaactccatcccagctccaccctcatgaattttgtaatcttggacaaattatttagtatcttagtgcttctgttccctcatctgtaacatgggggtatattatagtcagtagcacctgcttcacaaactcgtgaggacttcagcagttcacacacataactgcctcgctgcctggcacctagcgtgcacatggcattctaccgtggggtagacttttaaaattctggctacagagatacttttccataaaagtggccacatggaactctccaaatctaagaagcatactgtgggggccttcatattttgtctaattcttttctccccagaacaggaacctgcacccttccttcttttaaagggcgacgtggtaaataaacatttttagacttgcaggccacagtctctgtcctaatgtcctcagctggtagttgtagctggaaagcagctgcagcccacatggaaatgagggagcgtggccccatgccagtgcagctgatgtagaggcgggcagccccgggttaggccctgtggagacgcaggcccccgggctctagaacgctgaattctagtgaattctggatggctctccctcacacccaggcccaccctccctcaaggttgcaccttctccacctgaaggaagctgccaggtggccataggagcccttctcttggcaggccagcttccaggcccagtggcttctcttacatcaggggcctccccttggaatgttccctgaaggccagacacgggcaggtagtctgtggtcaagcagccaccctgacaggaggctagatgccactgggtgtgctttgagtttcctagatgtggagagttctgtgtggccacttttatggaaaagcatctctttagccagaattttaaaataaagaggataacttcctggtgagaacagacgtggaaaggaaggcactttggtttcacgctcatgtaagagagggctgttggcggtcactcctcagaactatggccagccctggatggtagccagctgctttttgccccaaaagtctgtttagctgggtctctgcattctggaagcttgtcaaagcccgggcctttcctgggtcagggcagccggctttccttgtccacgtgtggccggctgttttcttggggagccccggccacagccggcaggactccctttgctccatgtgactctgagggcctcacaggtatttgcagcccaggtgctgtcggagcccagccgatgcgaccgacacacagcacaagcgtcatcctgttctgcctgtcccttgcgtgtggaggggactcgtgcccagggctctccttgctggcttgttggaatctggcttcaggtctacacggggcctctcgtttggtccagaacagcctggctcatcggctggggcttgcttgtgcagggctggagcgagcacgtgctagatggagacagcagactcggagtgtgcatttcttcgtgttgcaagcctggcctcacagtgccttcttcctttggttgtctgccaggggtagccctgcaccaggaggaagcttagaaatagcacaggtgggaaccggagagagagcactgttggggaagctgcggtcactcatcagccttcctggtgagaaaccaggggtttcctgctaattctggaaaggatgtttcagcagtgcctgcatgagacgcctcagatagaaaactggttatttttgtttcttagcactgccaccatagataacagctgtcacgatggacagtgtggacctggattagtccttcttgggaaaggagagtttgggttttgtaccgtggtggttctgggttctgggggaagagaatggaaccgtacgaggtaaaacaggagactctgaaggccacttggccatccaggcagaaagccagggatggagaggggcagcagggctgtgttcagtgctcccgccgtacgcttgtatgcgggaaaccactgcaggcggcccatgaagcctcctggccatgtgcgccctcccggtttggaccccctcccgtgtgtcttggctgcaggtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaaggtattatatgtaggagttttcttttaatttattttgtgataaattaccagtttcaatcactgtagaaaagccccattatgaatttaaatttcaaggaaagggtgtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaaggcgtggggcattgggtttgctccccttgctgctgctccatccctgcaggaggctcgcgctgaggcaggaccgtgcggccatggctgctgcattcattgagcacaaaggtgcagctgcagcagcagctggagagcaagagtcacccagcctgtgcgccagaatgcagaggctcctgacctcacagccagtccctgatagaacacacgcaggagcagagtcccctccccctccaggctgccctctcaacttctccctcacctccttccctaggggtagacagagatgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcactttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacactgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccctcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgactgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgcatttctgtctctggtttggttttgtccctcctggaagcatcactacactttggtggcagggaagctgagctatgtggggcacgtgtgttcacgcatgttgcctggaagcgttctccagaaaagcattgcctcttctctgacagctgagctttctcagcatgcagattgccagtaaagacgacagggaagctatctgtttctccctccattaaatcatctggaaagaaatttgaatacataaattacgaaactctgtactgcagttccgactgatttgtagacttttttcctataccttccactaacaacagtcaggccaaggcaagtctgatctgcatgaccccaaggcagaggacttcagttcttcacatttcccatgtgctttttggtctttcacagctgacatgcccacctcggggggatgctggtgagaacccagtgggcctcacgcagaatgtgggtcactggaggagctccaaagtcctagttactttctagctgctgctcagtgatctctgtctgcccctagggaccctacaatgtaaacattatttttgtcaggggaaatggcatgtatggcaaggtgtgttctagaatcagactaaggattcagacacatcaggcagagaagctggtcatttccttcaactttatcatgggaaattatgctccaatagcaaaatcgggccagtagaagaagagctgtccagcaatgtataggtagaagtaaaccgaagaccatggttacttcagacctgttgagcctcagaagtgtttgcacctaaaagcaaaggcctttctgaaaggggactctcagctggggtgcggtggctcacgcatgtaatcccagcactttgggaggctgaggtgggtggatcacatgaggtcaggagttcaagaccagcctggctaacatggtaaaaccccatctctactaaaaatacaaaaaattagtgggacatggtggcgggtgcctgtaatcccagctacttgggagggtgaggcaggagaatctcttgaactcaggaggcagaagctgcagtgagccaagattgtgccactgtactgcagcctgggtgacagagtaggactctgtctcaaaaagggtactcaagcttggcattgcttcagggttactgctcagtgttgtcaccgagtgcctggcactcaggggatcttcattaggtgactgatgatgaggaggtctcaattctgaggctggaaagcccaacagggcctcctccttccctggtcaggtagatgctgcccttccaggttgccacagtgcagtctgcacttggcctgcccagccagaaggagcagcaatatctaaggatgaaggtgctgggtcttcagaagcattagaacctttcccctccaggccatttcttaagactgcaagccctcaagagctatttctgcatttaccccccaagtccaggtatgagtccatactcactcagatgtgtgatttttgtagtgttctaatgttgctaaaaagaccttcacatccattctctcaccagatgttcacaatcaccctgcaaaggaaggattttaattactcttacagatgagcaaacatacaggcatgctcaagacccctcccccgcccccccacctccccaccagctaccaactcaggactcagcctctcagccttttctgctgtggttctcaatctggcttcagcactgccagaactaagcaggctctgtgcatactgacaagggatgctgggtgaagtacacagcccaggtgtgaatgagacttctggggttctccctggagaacttcaggggccacagcggggggaaatgatggggaagttcttgaagagggagctctgggcctcccaactggataatatctaaaaatttaaaaaatgttatggcatgctgccaggcagtctgaaatataacactggagcccagtcctgggggccccttgcttgccagtgtcctgggacagaattgcccatagcagagacagatctccacattagcaaccatgcagccagacctgtgcacaccgcccagcaccacctccccccatcccccaatatgtgggctttgatctgttttctagcaaatgatccaggtgtacttgcaaagggagtcccctaaaggctactccaaatgcaaaaagcgtgctggcggccttgactgcttcctttggttttcttgtgggtttttgtttgtttttttttttttttttgagacacagttttgttcttattgaccaggctggagtgcaatagtgcaatctcggctcactgcaacctccgcctcctgggttcaagcgattcccctgcctcggcctcccaagtagctgggattataggcacccaccaccacacccggctaatgtttttgtaattgtagtagagactgggtttcacatgttggtcaggctggtcttgaactcctggcctcaagtgatccgcccacctcagcctcccaaagtgctgggattataggtgtgagccactgcgcctggcctggttcctttgttaggaagctgcaaatgcttttcttaatagtgaatgaatccaaacactaactgatgaattttttaaatgtagtcaagtgaaaaatggtagttgtaagcacaccaacgtaacaagaaatttcccagagctcacctaccttcactcacttcctccaaaaaaaaaaaaaaaagcgatgttaccaatgggactcccaaaggaaatctgcccctagaaaacactgaacaggtagaatcttgctgggagaagcttggcacaagacccggtgctgtgtcataaaagcaaaacaaaacatgaaacagaaaggagattctgcttttaaaaagggaagacaccatggagagaagctaagcccggctattaacctgcgccttcaaaccaaacactaccagtgtgactgtaaaatggtgcagcccctgtgcaaaacaaaatggcagttccttaaaaaattaaacacagaattagcattgaatccaggaattcacctctggagattgacctgaaagcaaggactcggatacatatttgcacgccagtgtttgtagcagcatgatttgcaagaaccaaaaggagcaagtaacgtaagtgttcatctacagctgaatggatgaaatgtggtccatacatacactggaatattattcagccttcaacagaatgaaatcctgtcccatgctacaacatggatgaacctggaggacatgaggctgaaataatacgccagatgtagaaggaccagcgccgcatgactccctcatatgagctacctacagtcagattcatagggatggagggtggagtggtgagcaccaagtgctgggaggaagaaggaatagggagttaataggtacagagtttcagtttgggatgaggagaaagttctggagatggatggtggtgatggttgtacaacaaggaaatgtactgtatactactgaactgtatgcttgaaattattaaaatgagtagtaaaaggggcaaacacagagacagagaaatcatacagtagagcctcggtggcttcgaggctacccaggacctggacacacaagctcaaaggccaggaatggggtccctggagcagcggctgtctctgtgcttctgtaagcatctccaaaacaggtctgtggtccccacagtctgcgcaggatcacacagacccactgtgtagatttttggaagaaaacagatgactcggatttcattttattgtcatgaaaaccataactgaagctagttcatcccctgtgaaatgtccacctttcagagtgttctttctcctgacaataaaataaccctttgtgattttgttgggctaattcagagttttccaccctctttgtcttacaagcaatttttgaaaaagtttctcaatgcacagttgagtgctacatacaggattgaaacattcaattttctctagaggagcaatcccccggtcagttccctttggctggaaggaccatggttgagttttcttcgaactgggctctgtgcttgggctttcccacctcttccagcatttcctggatgatgactctcaaggctcttcccagcaggctggccgggagcccgcgcgatagtggagggacatggatgagtgccgcgcagccctttccatgatgcagagacaggtaataggtataatcacagacgtatctgcaaccacaggaaatgccacattaattctcggaccagcctctaacctcagtgaaacatacgcagaagtggcaatgcaacacccacaaagcctgaggagggagcactgccacccaagggagacttgtgttgtttcacctcagaaagaacatggtgccaggatgagctggggagagctggctcttggcctcatggcctcatgaccggcaagtggccaaggcagaaaggggtcagatattccacagcacctgcatcccagtgaatccctctcattcatgtcttcgttgagtcacttactcattcattcactggggaaaggggaaaaaccacctactggggatcggagtttggagaaacaaaggtaaatcaatctttatctggggctacatcaacacagttaactcacaacttcggtcaccccaaaaatcaaaatcagaaaacattcacgaaatgttagtggctcttgaagtctgccttcccatctcttctcctagatcaacacaccaaagaccgtgtttccacaggcaggtctcacaaacgagacctcaggcaaggtgtgagcaactgtgctggcctgcacacagcaaagaggggcaatctgggggcggcaccgcatggccaagtggccagctggacgatacaggatggcttcttggaggtcggggggacgctgacggccattgcttctctcctacctgctcagagtcctgacacccacagagcatacctgcctgcatctcgggaaaagatcacgtcgacaccctccacagctacgcgcttgcagactgccttcatgcagacccctgactccagcacgtctgggctgccaggtaggcacacgccgccctcgggccagaagctgcggatgtcggcgtcccggtagccttggttcttgccagactgttccagaatgatcgccttggcggcggtgtccatgcccacatgcacgacgagctgtgtgaacgggtaacagcagagagaacccaggaaaacgaggcccaccctgctcaccaaatgtgcagaaggggccactccttttgagagcccggctctgtgcaaaacatctcaaaccccaaatccactgggaaaccccaggatcccccaccagtgtctcctaattaatatggctggaaagaaaaacagctggattcttttagctgaataaaaactcatgctgcatttacatttaaatgctttttacttcaaattattcttacagggtaatgtattctctttttgtggggggagggttggagggaggagaggcaagctagtaagtggtgaggctaccacagcagagtcttcgtgttttggtggaatcctgaatctttttattttatattttatttatgtatttatttatttttatgagacagagtctggctgtatcacccaggctggagtgcaatggcaccatctcagctccctgcaacctctgcctcccgggttcaagtgattatcctgcctcagcctcccgagtagcggggactacaggtgcaccacgcccagctaatttttgtatttgtagtagagatgggatttcaccatgttggccaggctggtctcaaactcctgacctcaagtgatccgcctgcctcggcctcccaaagtgctgggattataggtgggagccaccgtgcccgcctcctgcatctttttttaaatgaaactttaataaaggaagttagtggccatccagtgaaatcttcttagaatttattcaagctgattatttttcctttttgaaaaatagctgcccaagtatgttatcaaaacatctggggcattgtctgaatggcttgatagtgtatgttttattaacctcatcacatctggtccttgtttggggttttttttgggggggtggggttgtatctgttttttatacagtaattatgtccagataaaatgggctcgtgctatgaagatgggcctcccctaggctggccaccctcccagtcgctccctgggcacagaggtccttgcctcacgtccaccttcaaacctacctgcccctcatgggtatgtgtggggcccaacccaagggcctctcccttaggtggaaactatttttgagtcctggctgggaataatacttccatttcttttcctcctcctttctctccagattttctattaagatctaatccatattttggcttaaacttttacaaacagacccagaaccttacacaatcagctgggaccttgcatgactggtggggcctggggacggggtgcccctcaaccatcaaccctagaaccaggacccgggggttcagaggctccagctccacatcgccagtcccatgccccactgcctctggccatcacttacttgcggctgatgatcttcccagattccggtgaccctccgcttagcctccctgtaatctacaggcagctccagagtccgcagctgcaccactgtttcattccccaggcccagcttggagagctcctgaggaaagcggcaggtggacttgcctcagttgatggggggggggggggggtgggcaccaagagtccctgaaaacccaatccttggggtctacttccaggggtcttccgcagcctggactttgccctcaaggagctcacaaagtggcaaggggccaagaagagagccacagttcctaccagagaggcaaatgcacacagcagcacctgtctgtaatcccagctacttgggaggctgaggcaggagaatcacttgaacctgggaggtggaggttgcagtgagccgaaatagtaccactgcgctccagcctgggtgacagagctagactctgtttccaaaaaaagaaaagaaaagaaaaatccaaagtgtgaaggaaaaaaaacccaccaacaacaatactgtacccagcaaagctatccttcaaacatgaagaagaaataaagactttcccaaacaaaagctgaggaaatcaatgccagacctgtcttacaaatctaaagggttcaacttgaaagaaacagatactaacatgtaacaagaaaacttctgaaggtattaaactcactggcacaagtaagaaaacacattcagaatactctaatatggtaatggtgttaagtgaatcatgtacgtcttaagtgtgagactaaaagacaaaactataaaaaataattactacagttggttgagagataggcaacataaaaagataaaactgaaacactaaaaagtcaaaaatgtgggtgaaggttggtgttaaattgtagtttgtttttgatacttttctttgcaatccatgttcagttgttatcatttaaaaataacttattataactatccaatttttttataagcctcatggtaatcacaaaagaaaaacctgttagagatacattaaaaataaatagcatgggccaggcatggtggttcacacctgtaatcccagcactttgggaggccgaggtgagtggatcacttgaggtcaggagttcgacaccagcatgactaacatggcaaaaccccatctctactaaaaatacaaaaattagccagatgtggtggcaaatgcctgtaatcccagctacttgggatgctaaggcaggagaatcacttgaacctgggaggcagaggttgcagtgaactgagatcgtgccatcgcactccagcctgggcaacaagagcaaaactccgtctcaaaaataaataaataaataaataaataaataaataaataaatagcatggaataaaaacattctactagagaaaatcacttaaccacaaataaagatagtaagagaggaaaaaaggaagaagggatctacaaagcaaccagaaaataagtatcacaatggcagtagtaaacacctgcctatcaatcataaccttgagtggaatggattaaattatccaattaaaaggtgcagtgggccgggcacagtggctcacgcctgtaatcgcagcactttgggacaccatggtgggtggatcacgaggtcaggagatcaagaccatcctggctaacacagtgaaacccccccatctctactaaaaatacaaaaaattagcagggcatggtggcaggcacctgtagtcccagctactcgggaggctgaggcaggagaatggtgtgaacccaggaggcggagcttgcagtgagcagagaccgtgcaccactgcactccagcctgggtgacagagtgagactccgtctcaaaaaaaaaaaaaaaaaaaaaaaaaaaaaagtgcagtgtagctgaatggattttgaaaaaataaagatccaactatacgttgtctacaagagactcactttacctaaaaagatatgcacagactaaaagtgaagggttgacaagatattccatgcaaacagaaaccaaaaaacagcaggagtagctatacttatatcagataaaatggactttaagtcaagaatggtgaaaaaaaggacacagaagaacatcatataatgacaaagggatcaataaagcaagaggatatagctattataaatgtatatgcacctgacaccagagcacctgaatatataaaacaaatattaatagacctaaagggagagattaactgcaaccaataatagcaggaaactttgatactccactttcagcaatggacaaatcatccagacagaaaatcaacaaagaaacattacagttaaactgcactctagacccaatggaaggaacagacgtttacagaacactccatccaacagctgcagaatacacgtttttctcaacagcacatggatcattctccagaatagttcaaatgttaggtcacaaaacaagtaacaaattttgaaaaattaaaattatatcaagtatcttttctgaccacaatggactaaaactagaaatcaataacagaaggaatgttggaaactgcacaaactcatgaaattaaacagcatgctcctggacaatgaatgagccagtgaagaaattaaaaagaaaatttaaaaatttaagacaaatggcaatggaaacacaatatatcaaaacctatgggatacagcaaaaactgttctaagagggaagattatagcaataaatgctttcatcaaaaagatagaaagacttcaaataaacagcctaatgatgcacctaaaggaactggcactaaccaaccaaaccacacattagtagaaggaaagaaataataaagatcagagcagaaataaataaaaattcaaactaaaaaagcaatacaaaagattgctgatatgaataggtggttttgggaacaaacagaatcaacaagcctttagctagactaagaaaaaagagaagacccaaatacataaaatttgatatgaaaaaggagacattaaaatcgataccccagaaatacaaaggatcatcagacacataatgaacaactataaaccaacaaattggaaaatatagaagaaataggctgggcacagtggctcatggctgtaatcccaccactttgggaggccaaggtgggcagatcacttgaacccaggagttcaagaccaggacaacatggcacgaacccgtctgtactaaaagaatacaaaaattagctaggcctgctggcgcacgcctgtaatcccagctactcaagaggctgaggtaggaggattgcttgagcccagaaggttgagactgcagtaagccaagatcacagcactgcactccagcctgggtgaccgtgtgagaccctgtctcaaaaaaaaataaaaataaaaataaaataaatttctggacacatacaacctaccaagatttaaccacgaagaaataaaaaacctaaacagatcaataatgagtaacagatagaatcagtaataaaaagtctcctgacaaagaaaagcccagaacctgatggcttcactgctgaattctaccaaacacttaatgagctgataccaattctactcaactattctaaaaaattaatgaggggccgggcgcggtggctcatgcctgtaatcccagcactttgggaggccaaggcgggtggatcacctgaagttgagagttcaagaccagcctggccaacatggtgaaaccccatctccactaaaaatacaaaaattagctggcgtcatggcacacatctgtagtcccagctactcaggagactgaggcaggagaattgcttgaaccctgggaggcggaggctgcagtgagccaaaatcgcaccacttcattccagcctgggcaacaagagcgaaactccacctcaaacaaaaacaacaacaacgacaacaactaaaaagagatataccatattatccagaaatctgactgctgggtatatatcaaaataaaggaaatcagtatatcagaaagatatctgccttcccatgtcttttgcagcattattcataatagccaggatatgaaatcaacctaagtgcccatgaatgaatgaatgaatggatacagaaaatatggtaatcatacacaatggaatattgttcagccagaaaaagaatggaatcctgtcatttgtagcaacatggatagaactggaggtcattatgttaagtgaaataagccaggcacagacacacaaacattacatattttcactcatatatgaaagctaaaaaagttgatgtcatggaggtagagaatagaatgatgattaccagaaggtgggaagggatgaacgggagggaagtatgaaaagaggttggttattggatacaaaaatgcagttagaaggaataagttccagtgttcaatagcatagtagggtgacaatagttaacattaatttattgtacatttcaaaatagctcgaagagatttagaacgtcctcagcacaaagaaataagtgtttgagatgatggatatcctaattaccctgatttaatcatcaaatgttgtgtatgtatgtgtctaaatatcacttgtaccccataaatatgtacgattggcctgggcatggtcgctcacgcctgtaatcccagcactttgggaggccgagacgggcggatcacttgatgtcaggagtttgagaccagcctggccaacgtggtgaaactccgtctctactgaaaatacaaaaattagccaggcatggtggtgcatgcctgtattcccagctacttgggaggctgaggcaggagaatcgctttaacccaggaggcggaggttgcagtgagacaagatcacgctactgcactccagcttgggcgacagagcgagactctgtctcaaaataaataaataagtaaatatgtacaactattatgtattaagaaaaaaattgaaaagaaaagatgtatggtgaaataagccagattaaaaaaaagacaaatgtgtgatttcacttatatgaagtatctagaatagccaaattcttaagagaaagaacatacagtgattaccagacgttgggggaaggaagaaatggagggttattgttaatgaacacagagtgttagtgtgggacaatggaaagttctagacacgatagtaatgatagttgtacaacaatgtgaatgtacttaatgccacttacttgtacactttaaagggttaaaatggtaaatttaatgttatacatcaatgttatacatattttaccataattttaagaaaattatggctttcaccatcaccaacattttttaacctgactaaaaagtttgctctgaacgaagactaaatccgtagtaaatcatttagctcaggctaacatccctcagggataataattaagttgggattttaactaagcatactcttttccatatctgaaagccttctagagttctatggaatcacaatctaaaagtcattttctcatatcacaacaataaaatctgaagcctaacagtatttaagctgctggtttgctgaaaatgtctcaggacttgaggtgtcctgaagagaaatcattatggatggcaattattcccatataaatgctgtattgcaaaaacccagatcaaaacatagatgttttcctaggaacagaagaggcaaggaggggcagtggccactccagaattttctggtggctgaggcctgagcacggtgagctggctggaggagggcatggtcttggtaagggaagctcatgagtagattatgtttacttgctgcatctcagagacatgagtaaagacatgaaaattttagtggagataatacatttttacagattattattttatttcactgaattatcacagcaacctttcaagttaacaagaggagaaacaaggagggcctggtcaacttgggcctcatgctcctcacctgtataatgggtacaacaatactgtatccaccataatgattattaggaccctagagaggtcaagtaaaatggcaaaaaaaaaaaaaaaaaaacaagtctgtagtgactttgataagagtagtttgagtatggaaccaggcctggaggccaggccatggtaaatatatttaaaagttaatagaaatggtcttttattttttttcttgatcaatctaaatgaaggtttatcaattttattaattttctcaaaatattaacttttgggttttggtttgatttctattgttatatttctgctacttcattgatttctgctttcatctttactattacctttcttctgcttagtttaatttgttctgttagtttcttaagatagaaatcaaagtcactgatttgagaactttcttctgctataatattgtttagtgccataaatttccctctgatatgttttaattttcattcatttcaaaatgcttgctaatttcctttttatgtctcctttcatctctggcttatttagaagtatcttgtttggtttccaaaatttaggaaatttccagatgtctgttattgatttctaattaaaatccactgtggccagagaacacactttatgtgacctgaatccttttgaatttattcagactggttttatggcccagggtatagtctctgtcttggcaaacactgcatatgcacatatgagagtgtgttccatgctgggtggagtgttctacaaatgtcaatgaggtctggtaggttggtagtgttgttaaagtctgctgtatcctttttggtctatgtgttctgtccgttattgagaggggtactgaaatcgttgactattaactgtgaatttatctattctccttaaagttctattagtttttgctgcacgtattttacaagcactgttattaggagcatgaatgtttacatctattatgtcttatttattgaccatggttcattgaatgcttaatacctaattgctacacgacattctgactccacattgtgagctctagaacacagctctcaagggaggtaaaggtcaggaatagtcttacaagtgggcaaaaaatagggtgagcccagcaggctgttggctgagggctgctgcccaaaaggcatcttgtggctccccaaccatttccccatctcttggggacccagtgcctgaaatttcacctccagagatcttttcggttcattagtccctgtctagataattttgcaaatgcctgcaagagaggaaacacagcagcacacatgcttccctgatgaaagagaaggcgctgtgtgtgagcactagggcccagagtggaacccgaaactgggagagt

SEQ ID NO: 1788 - DNA, 226054 bp, Homo sapiens
  PCSK6 gene - 99661657 - 99847710 of chr15; NCBI Entrez Gene ID: 5046; Build 35; sequence includes 20,000 bases upstream of initiation codon and 20,000 bases downstream of termination codon of the gene
ttatagggatggttttatgggaatatataaatatacatatatataatatgtcaaaacttagcaaagttttgtggggagttaaatgtggagagtaacatattagtatacatcagtgaggctgaaaaggggagtattgttgtagaaagggacatttagaaaacaaaaatgattttggaattttaaaatccaaaagcagaaaagaaaaatttagtagaaacatagaaacttgaggaaatttccaagtaataaaaatgattacaacaaagaaatggaaaatataagctaaaaagcaagaaaattagactaaacaggaaatacatcttaaataacagggctttcaaacacagagaaaaaaaatggaagggagcaattcaccaaagaaacaattcaagaaaaagttcctggatcccaaagacatcaatttctaggctgagaggttcaccaagtgctcagcacaatgaatgaaaacaaagccacacaaagcacattcacacgaagtttcgaaacattgggaacaaagagaaggtactaatgctctttgaaagaaagaacaagtcgcatacaaaggtctagaattagttctgcgttaggcatctctacggcaatggtgaacactaaataatagagcaaggccttcaacattcttattgaaaatgatttccaaattagaattctatatcctcagccaaagtagtaacgtgctcttgggctagaataaagactactgggcgttttcagaatgcaatgtctcaacttttaaaaattgttcctgcttttttttttttctcaggaaggagacttttttctgttgaggaatttggagatggatttgtgataggtacatagtgaaaccaaacaaatgggataaaggttgactccagtgaaaacgaaaaccatatcagaaaataaaggaaattagaatgcatatagctacagcctcaaatcgtatttccatgggcctaataaaataaatgctaaatatgatttgccctataattgtgccactctattagaggaatgggatggaaaagaaatatatttaagggtgtgggagtagagtagaaagctaaacccttattgtccattgcctgaagtaagcatactatatttaaaactaaaaatattaataaacaggaatttaaacctgctatttagaaatttggaggcaaatacaacaaaactaaaagcattgaaagtcatggcttccagagagtgggaggagaactgctaatatcacttgcagatttatagaactgtttaattttttaaattatataaatgtacactttattaaaattaaaagaatagagacatgatagaacaaagttttccagaaatgaagaaagataattatctctagactaaaagatgctccaagttccaagtagaataaagaacaaaagacttatgccctgacacagactcaagatattttagaacgttgaacataaagagaaattcctaaaagcttccaggaaacaagaaaagtcattctcaaaagaccaaaaataatactgacctcagacatcttgtcaggaacattgaatactaagaagaaaaaaaattctgggaaatatgatttaaaacccagaattccatacgtagaaaatcgttaagcacgtgagcaggagttttagttttacaagtactcagagaatttgcctccaaagcaccctttcctttctattactgcaaaatatagtccagcaaaaagcttcaagaaacagtatgattaagaggtttggtaattctgaggatctgacaaaaacacaagtagtgcaacttaaaatcccaagaaaaacaaaaagctatttaggagatttatgtctgtgtctaaatataaaggaaataaagatgtgacatgaatttaataattaacctttcatgtcacttatggttaatgatactggacctagagaaaaataaataaaatcctaacatactgattgactttgaaggaacaatatttacaaagtcataattatgtacacagtgtttatttttttaatatatttttagaatcaactggtggacaaaacatgaaaaccttatgtttataagacagtatataaaatgatcaactctgacagtataaaagttaaggtatggctaagagaaactgatctattatctgaaaacaatagaacaagaagtgatagataagagattgcaagttggaaaggcaaacaacagaaaactaaaaataacaatgtaactgtgaaaatttaggggaagatgtagtgtaagtcagctaaagccttgtgtttcatggcaaggcgtcaacagagcctgagttgaatatagacatagagatgtcaggatgccatgtagactgaggatgctagccactaggaacacaaaatgcagaaacgctgaaaggtggtggtctctgggactatgggtaggacaagggaatggagtggatgatttttgctttaataatatgcccttctcgaccatgcatactctgagaaacatttttaatgctttaaatgaataaactaaaatgttgaattgtgaatacatttatgttctgaaaaccagatatgaaaacatgctgatagtgaaaagcaagtctttaggcaatcaagacaggaggatattcagcatctgtcatgcatttgtcatcaggttccagaatggtggccttgccagagggtgggaacagtcccttcctcattagtacttccagccccaaaattcagccccaaaattaaagataagcttacagtggatatgaagtattagtttgatggcagtgtgcgtgtgtgtgtgtgtgttgtattagtgtgatggcagtgtgcgtgtgtgtgtgtgaagtattagtttgatggctgtgtatgtgtgtgtgtgtgcaggaaaattacaagaaaaataaagcatctgaattttgaatcaaaattgctaagttgtttttgtaaaatgtgattcagaagatctaaaaaatatcaggtataagagatgttctattattatgacctttagccatagagccaactggcaggtgtgagcctccattctgatggaattctgcagaagcctctggtcaagagaggccctggtgagctgtgctgggcttatgagagagtcgtgtgatggggcccagtttcattcaagagacttagtatcctttttctttctcttttacataaccagttcgacaccgctgggtgccaacagacagaccctctgttgagttgtccacctgctttccacctggcaggtgccaatagcctcttgttctcccagttctcccggccctacccttgcgggagaaggatactattttgtattacttcttatgaacattgtgagcaaaacgttccacggaccacccaagcagtgcagaccacaggccatgtcccagggacctggaagcagcaaggacgcaggtgcaaacacccagggtgagcctaccccatccttcacacccagggtgagcctaccccacgccttcacacccagggtgagcctaccccatccttcacacccagggtgagcctaccccatccttcacatccagggtgagcctaccccatccttcacacccagggtgagcctaccccatgccttcacacccagggtgagcctaccccatccttcacactccgagtgagcctaccccatccttcacatccagggtgagcctaccccatccttcacaccgactaccctggcagccatgttgcaagaacgatgagggcagcctggggaaccccccaaatttcagcatcagtgagtgctctgacctcactgatgacaaggtcccacaggtcacttacacgtgtcacatagaaaacgttctcctgtgaccaaaaatgcaagccatctgacaaagagtttcaggctattttcagtatcattatcttctccgccaacactgacaaatttaccatggtcgtggttttcttcgttttaatgactgtttggttgtgttttcctttggggatgggggctggtggcgctgctggcatctgtggcaaggcctcgagggaagtggatttctgcggtggtcactgtgccttgctgccttgtttaaaatgagacttcatgggacacacacagcaaagatgaaagagcagaaccgtggcatgtgagggacgattagggccaggctgggccattaaggcctggtctaaaaggtgcccagacacctattgacatgacacgtcctaactgctccccagacaccaggattaatccactgtgtcagtttgcttcgtgtccctaatgtctgtcagcaggagcctcttcgtgcctgatggagctggggaggggaggatgtcaaggtggatgctctcggctggaaaagctctccaatgatgggctgtaacgaaagtttgtgacatttcgatagctctttgccttttaatgtgcgcatctggggacagcccgttacctgcttttctgccttgatccatcatttttctctggaccaaatctcaaaataatacagcacagaaagaactctgggttcgagatggcaagtgcagcctgctctctgctaacccgacaaagtgttgatgagtcagaacttctgggtagcacacaacactgctgtgtatggctgacaaaaatgtccagcttgtaaacaattaggaaacagttcaataaaatattcatgggcaccatttaacccatgactcaggcagactccttacaatcttgacactgatagtctgaacattgtcattcttctacatgtcttcagaagggctggtaaatattgaactacagttaataggttcttggataagccagattcgcaggcccttaacctcacgccttctccctttacctccatgacatgatgtttgaacctagaagacagggttgtcgacatcttctccaccgtgcggagccctcggtgccaagagtggtgggtgtccccgtggcctcccgcctggggtctgagctgccgcacgatccatttgtcacctctgaagtgtatctcaccgtgggcactgggagcagcaaatggttgttctgttcttacctgctcgatccacacaaagctgggaaggttcatgggtgcctaatctcacaggacagacatgacgacactgtgaattcacactgggtctcatcagggatttcactgttcttccagagagagcaagtgtcttactgaccaccagaaaacatttttgggggagggggaaaataactagaaagtggaggaaaggtaaaatagaaaattcaaggacaaataagatgctaaagaaaatgatgaagtagaatgaatgagaattgcttggagggggtgcctctggcttggatggctgtccattttgctgaggtgtctggggttgaccacgggaggagggaagaaagctgagcggggaagaccaggcatacctaactaatggtgtgggtgatgtgatattcctgctagccctcatcggtcctggggcgtggctccttctcgcctttgctcttcctgtcttggagcggattgaggctgggacgagaagagagatgggccagcagaagggctcttcccccattcccccaaacccttcctgaaataccagctggcaaaacttctcgaatgtgcagtttcggaactatcacagcttccatgaatatcagatgttccatttagttcttgatctctctcccctctgtctcttttgtcacttttatttattttgttgttttaatcttcctggaggcctaatgggctgtatttgagatcagtaggatacttttaatggtttaagttgccatgattccaggccccaagagaaaatgttctgtattttttcaaccaaaacctgtgcctgccacttctttttaaaatattaaggatgcatttccctagccagtcccagcttgagcatttgaccctcctgcccacccagagttgccagatttagcaaataataatacaggacagacactcaggtaaatttgaatttcagataaataaaaaataattttatgagtgcaagtgtatcccaacttttgtgtgaggtacgcttaaaccaaaagtgttttcattgtttatctgaaattcaaatttaactgggcatctagtatttatttggcaatcataccagctgattcctcaaccattctttggaaacatttaatcccaagttcttacacagcagacacatttaatcatacttactgcctagcaagtatacatacttttttttttttttttgagacggagtcttgctctgtcacccaggctggagtgcagtggcgcgatctcagctcactgagaactgggtgagtctcactgggaactccgcctcccaggttcacgccattctcctgcctcagcctcccgagtagctgggactacaggcgcccgccaccacgcccgactaatttttttgtatttttagtagagacggggtttcactgtgttagccaggatggtctcgatctcctgacctcatgatctgcccgtctcagcctcccaaagtgctgtgattacaggcatgagccaccgtgcccggcccgtattctttgttcatgatgtctctacctggatgcatgcaggatgtctccgacagtgagcttccaaaggaagtccctctgagtggcttagagggctgtactcacagtaggggctgatggcacagatcgctttaggaaggtggtgagtgggaggtggtggtggggaaaacaagacttaccggtttaccagaggcagggatcagggtgggatcgggagggaataggatttggcgctgttttcactgaattctggaattgtggtctggctctgggaatcacctgggaggtcagcccctggaggggaaaggcagcccctcctcaacgtctgcgacaggtgccctcctacgcttcccaacccctcccagtgtgggcagttccccagctcacaggcagcacacgcaggtggaaacagctctacctgtcggctcaccctctggcgaaattctactttcagaccaggaaagctgagaggggtggagggtgcctcgctgaagtcacagtgctcgggccaggccttcccatgcctcacctttctccactggaccccgcttgttcttttcggcctgtgagaaggccacaaacagttgttactttttcaagtcaaagagggtatgcgtcctgaagacatgatcagagatgtcattaagtgtgcgcgtgtatagggcggagtgaggcccaggaggtggagtggtgcggctctcaggtcacggacatggaattcctgactctgcctgctcccggcggcctgctggcctgtcaaggggagagcacagtgagtgacaagaggatttatttccaccagccagagaatggctcataatttacagcccgctgagccagcctctaccacggcattagagccttccttttgtagacagtaataaattgtcttatccccggtgctgacataacatgctcctttttaagtgcgccataattttcatttttaagggaatattcatattggatggcagagctcatgggcatctgaatacttctctggagagaagcctttttttttcttttttaaaagaagatataattcagctcctaaatgccactagcagggataggcttgacttctaaagcgacattaggggcagaatttggggacattgtagacccttcatagacagtgacttgcccctcatcagtaggcatcaaaaggatcaagcccctgcaggatgcacgtcctttgactgtccgccttgctgcctttgcacgatggtggccagggagctggggcggcctcgggcttttccatcccaaaggacgggcttccccgccaccagggggactcactcccttgagctccccctggcaggaggggcctgggggtgacaggcagacagtaaaggagtctgaagcctgcccggggggttcccagcttgggatcatggggctgccgagtccgggcaccgtgtctctctccttctgcatcctccagggggcaacagtgcagcctgctgatccccagtgagcggttctccccggggcacagtcctggagggggatgccacagatggtccctggtcaccagggagtcctcgggcctgtctcctgtttctaccgacccgtggggatgggccagccggggtgtccttctcccctcccgtcaaggttcttgtgcctgggtccttatctgaggatgccctcacggcgtggcaggaagagatggggccgggtggctgcccaggctcctccctctgcctttgccttgtgccttcacagccacccattccagaaccctaactgttcacctgacaagacctcaggcaaagccctggctccctcggaggatcggggctttcttgtttgtaaaacaggacacggactttaggagctcagacacgaatgcatgcaaaagccttacagagggttcaggagaggtgagtttttgtctcctcctctgctccttctttcttcactgcctgtttccctcctttcaccaggcacgtaggggaaggagctgaggtccccaggctgtgcagtccttctaggtctgggctgtggagggagaggagaggctggcctgggggtctctgctgggggagatacaagtccggcctgtggggttggccagcctggggcatgtctgtgttaactcagacacacccacacagacacttccagaaccaggcatgtttacaagtagcaatgaggtattgctaaacctctggcctgatgagaacagctctcacataatgctgtctgagtgccaggcccaggtccaggcactgtacactaattcatttaaggtggacacaaatatgcccattttatgctcagctgggaaaactgaggcccagagaggtcaatggactcatctgaggtcaggcagctgggaggtggccgagctgggatgagaacccaggtggtcagggctggagcctcttccctagccacagtgcccctctgcctcttctcctcctgcctgagcaatcccacttcacttggaccatcccctgcctattccaggagacaggacttgagtgtcacttcccctcctgctgtcttgtggccctgccatgcactgtggcaagtcttctgttatcttctgcctgagaggccgtgactaagaaggttccagacttcccgtctatcaaaggtgaggactgaattagactttcttcttgacagtggtgatcacctgtgacctgtgactggtacatgctcaggagggagtatactgttccactttgctgatttctaatgaaagattacttttacaggatggagggagaaagggctccgaaggagaaggaagaagaataagggcattggcctcagtccagatgaaaagacccagatgcaaaattatttgggccacatatgtgttgtttgcttatcaaattttcaacctttgaaaaatcacaatattggatggtgggaatcagtagcattgctggagttcctgtgggtggcaggagttggacattgtggcaggtgaccctgcaaaggataaacacagaacctgcagagggtaaaggatttcccaagtctcactcctggagggaggggcacaggcatgagcagcctatcgggccccatgtcatgcagctatgttctctgctgctggtgagcttggcatcgaaagaaaacatagcaggaatgattttgtctgggttggggatttgggggagtttagactataaatagtgaggaggatataaaaagccttaagaggatttttggaagccctaaatccaccacatagaccaaagcaagttaacaggaaccacttcggttttagtgaggtctaaatgtgactcagcatagtgccctcccctccactgttcccttccagctgtcgtggttcacgtgtccgctgtcaccacaacccttgccagcatctgccaaaccaagggcacgtgtgtcaggaggtctgctgccagcatgccagctgccaggtgctgcctagccttgaattacggcctggctcactccctaagggaaggcatcattggcagcctcttctgcagcagagaaaacggaagcataggagggtaggtgcctggtccagggtcacacagccagcaagtagtgggctggattccacactcagccgaggcccactctgctgattctagcataatttcttcaggatcaccttttgagtggacctcagctgcgtgtgggaaggaacctgcttgcctctgtgccttgcttcttggacacctgcggtcccagccttctcttttctgtgggcccttatttcatttaatacatggactcatcataaaacccctttgcactcctgtagccccagctcaggaagcctgaagcccaccccggtcaccgaggtgctcagaatcgatggagatccagagttgaaacctccctacgtttggtcctgtgtccccagggtctgctgccggctcctagatacctacaaacaggtctttactgttgactcttttaggaacatcactgtggcctaatagtgagggagtgacatttaggatgatggccgaccatctcatttataggaaaaacccagggctctaacacatattttaaaaatcactgcactgctggcacagccctgccacccagcattgtattagccaactccttcccaaggctctgggagaggctgcagtgggaacattccagatcagaggttctgccttgtttaaataggggtggagcgagattgccaggtctgaggcttcatcttgccagtgagaaatgggggtgcagggagctgttttagatgggggtgcagggaacagctgctgaggcctcaccgtgagtcacacacagggctggcagtgaggccacaaatcacagttgggcccccaaacataaggtcctacagccagggagagccattctgcctggagaccgagaagaatccagtcaggaagaaatagtggaagctaaggtgcccgggcctgaagggccagtccgtctgggagcagcaactggccctatggtgggacaggaagagcaagaaaaacagtgccagcttgctaaaggccgtgcccctgagtttgatctccaccctgctggctgagaagactcactgatggtctaagtcgtctcatgggagtgcctgggaaccaagactctggagacggcagggagggtgatgaggggcagcggctggagctagagagaccacctgggaagtgaacaccacagacagtgcgacagggccctcggctagggtgggaagcctggggacgggtgagggaactggtgagaggtgggagtcaggccgagcccacactgggtcagggcatgaaggccacagcatgcccttgaggccagggtctggtccgggtgggggtgaggaggttagaacaggctgctctggatttcagaggccacagagagtggagatattgagtaaggaggtgaagatgtgggacccaaggttcccggcctcttgaagacagcgtggggctgcgggtgcaggtcagaaggccttggaggccaggtgggttggagctgtgggagtgcccctcctccgctttccacccttcttgggatggagtccaaattcttgccaaggctgatgaagctgtcacagcctggcctctggccgtgcctctcatcccctctcccactaccctcctgtcactgccaatgcccctgctgccctgcctgccctctagctcctccaccacaccaggcttcctcctgcaccagggcctttgcacgtgctgatctcaagtgggccctctgcctggagctgggggagggaggcctgcacccaggggtgggagaaactgtgctccttcatccctgagtcaccaactccctgcattgcaaatcctcagtgtgatctctgttttcttgcttagtcctgactgatggtccacccgtctggctatctcctgtttatatcttcaaattcaggttaaaagtcacttcttccaggaagccctaaccatctcgttcaatgctcttctcgtatctgacagcctccactgtgtgcttgggggagggtagagaaaaatcttggatttttctctgcgtgaggttggaagccatggaggaatttagagctgaggaacggcctgatctgacttctattttcacacatcctctgtgttgaggattgatggcaggaggcatggccagaacagggaaggcatttagaaggctgttgagtttcaccaggtgacaggtgggggtggctcggcccagggacgtagcagggggcgtggtgagaagtggccggactctgaacggatttcaaagtagaaacaaccagactcaatgacagtctagacacgggtgtgctggggtgaagggaggggttaaccatgacctcaggctttagcctgagcagtggaaatgtggagttggcatttgccgtaatggagaaagctggggacagggcagggcggcgggggcgttttgtggtggggacggggaggaccaggagctcagcttgtaaagtgctttagacatccaaggagagaagctgccggccgcctggagtttaggagtccaagccagcgacgggctccgagagtcacccacacgtaacgtgcacctaaagttagagaatgactgagagcgtcgcgggagtgagggtgggtacaaaaaagaagccacccaagagtcggggctcggggcaccccgatgctaagaatgaaccagcgatggagactgaggagaggcggccacacaggtgagaggagaactaggatagcaggggccgcttggcagccacaagcggaatgtgcttccaggacaaggggtgtcagccgtgtcaaaggtgcaggaaggcctccaacaggaggtcagagaacggccccctggagttagcagcggacaggctgcgggggatggtgatgacagcgtgggtgggcttgagtgcaggagagactgaaatagtgggtggggagacttgcttgaggagttttgtgttgctaaaacgggaagaatgggagagtagctggcgagagtcctgtgggtttttaaagatagatggtataaccacatgcttgtacgtgcatggaggtaactcagcaggagaaagggtgatactgtgaagcggcggctctggggagctggggtagcttgggatccagcaggtgagggaggggaggtcctcagtgggccccaccacctgcggcagtgctgtgaggcagagcccggcgcaggtgtgggtggaggaggaagatctcttccgagaaaggaggtaagaaggaagcaaggctgtcagctgagggtgagtatggaggacgccagttggacaggaggggtgggcgtttcgagagactgccagaggtgtgtaatgatggctgccaggcgacagcagccggggtggctgtgtttcttctccacctgcatccagccgagtggagggagagggagaggacggcatggagaggcccgagagtgaagagcggcgtcatgtgacctttcctggaaccccggggaagtgaaggcaggaggtcagaggtgatgtgaaggggcggcaggggcaggaaggcgtaagaagccttctcagagccgggtgggggagctctggcacacgtgcaactaaggggaaggatctggggacaggaaaagattagagggttaggagtttggggaactgccagagcatgaccctgcagagggcaggattccctggggaccagggcaccaagggaggggcagctttggagagggacagggcagggggtgcagaagcaatggtgtttgtgccttctgtgctcttgaggaaagagagcagctaaagggcgaggacttcagctgcaattcctcagccccacccagcccggccacttcgtgtacaccacagcccagcaggtcccccgcaatgcctattttcccatgatgtatttctgcgctcagcttctcaaaaccagacttttgtagagagggataacctgccagctcttctcctctgcttgtcgccgcgaggaccccactcccatcctgtcttctgctctgctctctttgccgggactagggagggagccccagctcccaattcactctcactcgggaagaacacttaggccacaaacccgaaacccaccctggagccaaggggtgtcttcacacaggaaaaaggcacaccccactgctgggcttgtggacagtgcaacgccatccttgcgctgccgggcgtggggacagggaaggtggggaaagtcagagtcaccgctgcttaggctgatttgtgttgtatttaatttgtggaacacattaattctaaataatacttgagccttccttccccttccctcttgttcttcccctcctcccttcccttccccccctttccctccttccctacctcccttcctttccacttttcgataaatatttgcttggagtctgctgtgtgcctgagaaaatctatatgaaggtgatccaacagaaacagagagcaagaggtagacccccaaggaactcgcccagcagcctccacagtgccgcccctcgctaacagcatcctggttttgctcaatctggggcagcaatgtgctcagggagcgttccccaggagaagagcaaagactgatcgaaagcaacctgagccgccctgctcaccttgtctacgattacctggcagcagagggtgggcctgtgacccagatctggtaggtggggcctgagaggaagtggactggagggttaggtgcttcctccccagggagatgaagacattcaagagatggaaagtcgctcctgcgcttcttccctggaggctgtcttgagaggatatgatcctcccatctgtggcagtcatataagaataggagaaaggcaggtaaagtatagaaaagctaccttgagtcccagcatcactgagctgctgaattaacaaccctgggtccactaataccagtttcttgtttgcaaaataatgaattgtccttattgtctgcactcatttcagttgggcactctcatattttgtaaccaaaggcatcttacctattgcaacaaagaagaaataaagaactacaatttttctatcacatgtggctctgagcctcctggatgctgaggtgaaaagggaaacgagatgaattgccaagctctcattcttagtcaggaagagcttctcagggagtttcagcttttttgcccctaaattccctgtttgacactaaatttccacatgggagtttaggaaaggaacactgggatacataactgctagacccacggtaatcgtttcacaggagaagcagttttcaagggctctttcttaagaaaactaggatctagatataaagagagtttaagcagagaggagagtagagtgggagctgctccatgccctccccacccccgatagtcacatgtccccccaccccagcagggagtagagctcagtatgaatgagcagatactgaagagaccgctgaaaaactgtgtacaccgagcagaaggcagagcccagaaggacgcagagcctgaagctgcaggggagcaaaggcccctgacccaccactgctatgggcagcagctgtgagtgggatttggagtgagtaaaaaggagagaaaagaaaagcgtgaaagggagagaagaggacctggctggggaaatccccggtttgtagaaacctgggcttgggtaaaggtttgttggggacggtgggaggggctggtgggaggcagaggtgtagtctgccccggattctccatgtctcaggcccactggctgtgtgcgacctgcatcacacctcctgttcctggggaccttgggtgtttatctgggctcaagaagcactgtcaggtctaaggaatgactgtacgtcccaacagtatctcacctctgagtgctgtctggcccaaagtatccgaggattctcccgatagaaatgtatttgaaaattcaactgagccaggcaattactttgaaaaagcctttaccttgctgaggattcacaacagattttcatgaaaaatgctgtactctctgtaccttttctgtaggatatcaatagatgccacactcacacatacacagacacagcaaatatatttggaagaattcaacaagtttctttactgcaatatgtcttgaaggcattaatatcatatgtcatcaaatctaagatacaccctcaattggaagatgtgtcattatttaacatattactaagaaaaaaaaaacatccaagatggaaagtctcacaggagatgcctctctaaagatggaacaatgaaaggctcacaggagatgcctctctaaagatggaacaatgaaaggctctactgttggctgggcctggtggctcacgcctgtaatctcagcactttgggaggctgaggcaggtggatcacctgaggtcaggagttcgagaccagcctggctatcatggtgaaaccccatctctactaaaaatacaaaaattagccaggcatggtggcttgcacctgtaatcccagctactcgggaggttgagacaagagaatcacttgaacccggacgccagaggttgcagtgagccgagattgcaccattgcactccagcctgggtgacaagagtgaaactccatctcaggaaagaagaagaaaaagaaaaagaaagagaaaagaagggaagggaagggaagggaaaggagaaagagaaagaaagaaagagaaagaaaggagggaaggaagagagagaaggaggaggaggagaggagagagaggggaggggagggaaaataaagactctactgtcagtacaggggaaaatgagaaataaacccaccatggagaggaacagcaaggaatcatcaggtttctatcttggccctggcgaggggagggagaaatagggagatgccctgcactgatcattagaaccataagctggttctcacactggggtcacaccattcagcagatccccaaggagtttcaggagctgtgtccccagatcactggcagaagcaaaaacaaaccctctctggaagaactcaatttcagtccaggccagtgatgattgcaaaacaccaactgtgagatgtttcttgatttggggatgttaagatgtgagaaaatgtgcacccaggcatagatgaggacagtgagcccttatccagagaaggtcagagtattcagccctaactactctatcccactggagagcgcctggtcagcagtggtcactgttgccactatttatggagtgctgacttcatgccaggctctgggtgccaggctctgctcacatcagctcctgtcatcctcatagcccctctgtatggggacagcagcgttactattattttcagtagggcaaactgaagcaactttactgaggctgcacatgagtaaatgacaaagctgggctttgagtccacgctcatctccggtatcctgaaggtggtgtccatcagctatttttcaagggatgctagtctggcctgctgaacctagcatattgccaaaaatgtaattgttcaataaagtgtctattccctacacagaggcaatttctgcatcaaagtatgtcttatcacatcctagaaggctgtgcaaaggctcttgctgtcctgtggtcttggctgcgtgggtattcccggactctggccggataatcccatgcttgctgtaaagggatcagtggtgggcatgagaacacatcattcaatgtcttctcctcttttctgattttagaagatgtcagtataaatatcacaaaacttccgaaatatgaccaggctccaatcacctttctggtccatgtcctgtccctcctgaggctcgaagacctcaatctaggaaagcagcaccccctccctccccacagagctgtgtggacctcgggggccatgtggagagccagagcctgagtaataaatcccctccctgcaggacgactagccaagttttattacagatcctatcacaatgaaaagggctggtactcccgtgactgagctaatcccgtcaccgtgtgaatcaataggaaacccacaggaggcgattcgattcaggatgttcattttgggaagctggtcttcctacaacatcggagtcaagatattgccgggcacttccatgacaaatggaaagttcagcccaaaaggaccagacttgttagtaaaatacattcagatctctccaaataaaaattcagatgcattttagtctcccctcagtacagcaggctgaatcccttaatctaccacattattatggaaacacccttatctctgcctgtcaaaatcactgccgttgcgggggctccgtcttgggaggcaccagctgctttataatcatttagctgatgtgcagttacattatcttgaagcaggccacatatttgaagaacggcaccagatccaggatgaatctgagggacatccggccagcaggggaaggggaagagaggtaacacatgctgcccagacatactgctgctaggtgacaatgcaatgcctccaaccccgtccccttgactcaggccaatgtccctcttctgcaagccagttggctaggcagccagggccatgtcaggcagaggcagactgagagttctgggtactgtttctgtccaacaagtatggccggttctcctctagggctgccagtttgcatgagggcctcatgtctctccactggcaggggctggtgagcatccagtccatctgtaggagggacacacggtggctgtcttctgcagtgtgggcaggcctggagtgacggcccaagcagctgaccccacttgccaggggaacgcagggaggtgaagttacatctagtgtagcaaagcgaaggccatgtgggacgttgatctccaggttccaagatgggcccttggcaggagcccttgtgaacatggatgtggcctgttgggatggggcctcccaccacgcctcctgttctcccacctccattaggggtgactcacacctgaagaaatgatgaatcacgtgggttacaaaaccaaagggctcctgagagcgaggctggaaaggacctcggaaaccatctatgcagatcctgtcctcagcccatcccctctcgccccagcctctcacctccagctgccaagccacagactccaagtgaatcctgcacgctcaacaagagaccgctcctggaactgaccatcagagaagcagcttccttcccacctcaaggccttctcgacctttttgttttacttcctatattaagcaggttgatggcttgctttctggaagtgggccagtaggaccaatgggtcctgggagggatgacagaagagatccagcagcgatccttacccttcataattccttgattatggtgtgaacatttccatccatctccagggtgcttcaaatcattatccactggataccaggctgctccaggaagcaggggtgaggatgattcagctgactttctactgctggtcccagctcagtgggtgcttttaagagtgtacatcgtctagtgaacacctaccacacggcaggccctgggctcataaaaacgaacgtttacggacagcttattgtacagcaaaagctgacctcatcctcaaatcagcccgacggggtagatgccactgttccccgcattttgcaggtggggcgcctgccctcagccaccacagtcatttgcccaagatcgcagcgaggctaagcggacggcctgggggttcacctgcacggcctgggggttcacctgcgcggcctgggggttcacctgcacggcctgggggttcacctgcgcggcctgggggttcacctgcgcggcctgggggttcacctgcacggcctgcctcccagcatgggccgcggcctccgccatgggctccgtgcggtggtttctcgggtacacgctcgtgagcccggctgatgcgccacatgcctttgccccgctcaatgtgtcccttcagccaggcttggtcccgggcgacccactgtcttccccgcagcttcttctccctgggaccccgcacacgggcgagccctccgtctagggaggcgggcgaggccgccaggcgtctgaggcccccgccaggtgagtgcggccttcgggtgtccggccggtctagggaaccggggactcacctgagacgccggggcctccccgctcccagcagaactcgcgggccgaggacgcctctggggcggcaccgcgtcccgagagccccagaagtcggcggggaagttcccccggtggggggcgtttcgggcctcccggacggctctcggccccggagcccggtcgcaggagcgcgggcccgggggcgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcccccgccgcgccccgtctacaccaaccactgggcggtgcaagtgctgggcggcccggccgaggcggaccgcgtggcggcggcgcacgggtacctcaacttgggccaggtgagtgcggccggccccgcgcgcccaaaactttcccggcggcctccggcgcgcgcgaggggggcgcctccgcagtcctgtccgcccggccccggccccgcgcgcgcgtgggaaggctccgggaccgcttggggacggcgggcggccggggcgccctgcgggggggggtgtcgcccgggggggcgcgcgcgggacactcggcggggtgggggggactggggtcccgcgtgggcgcccacgcaggtccggcgcgccgaccgcaagtcccccggcagtgccgcccaaccccgcgctcggaagtgtggcctcagaagccggggcggcgcggacacctgccgggctccgggggagtctgggctgcctcaggcgtcgcgcgccgtccgccgctgggtcctgggcgcccacccggctctcccccgcgggggagcggcccctctgccctcgacgggcggcgcgagctccggacccggtgcgcgcgccaaggcggccgcggccgctgcttgggtgacatgagcgtggcccggcgtctcggggactcgcgctccctcggtgtccgcggctcccgggggtagatggccgggagcctgcaccctggagcccggccgccgtcggagaggccttgggacagcgcagggccgggggtcctgggtttaaaacctctccaggagcggagggagggcgctttgtgtgggggcttctgccgcggttctgatggccgagcggtgtgacctttggcaagtcgctcccctgacaagctcctttgcagtcagtggcaatgtctacaccgctgggttgtcggaaagatctaatgctgcgttgccacagagcctggaccggggcctgaccctcaccggcccccacggggccctcccagccccgcagccctcggctgtcccctcttctgtcagtgagcaagcaggccacgccctgggcacaaaggcggcattaccctcaaaggacctcccggcgggtccctttttcctctctcaaccagctaccgggctgaggggcggtgagttggggttgatccatgtttatggctcctggagaggccgttattttgaggtcacaccaggggacctctcagtgcagttaacaaatctacaaactacacactcagagggttaagtgaagtgacagggaagcaccgactcataactctaaaccttagtgccaggcagtgttaaatgtagtttcatcgttatccgtggcagaagccagcaaggtgtggtggcgtccctgattgatagaaatgacattagttctgcatcccaagccccacgttgatgtactattaggtgtgtggctggaggggtggattccaccattcgaatgaaggaatcttcacaaggcaggttcgagtttactgaaagaatgctagcacatctttggagaccttttaaatatatgcatatatatatataaaatgttacatatatacacatatacacacatacatatacgcacatgtatatccatatagatatttagtttttttaaccactcaaggccctccaaacatcctgtgatttcagattttgccgtcgggtagcactgacttcgtttgtctctgtagttcttgactctccctggctgattgtccaggctgaagaaggtgttcctcatgtttgcgtagtgcccctggctcctgccacacttcgctgctgtgcccaggtggcccagcaatttgtcttcagctaaaagtgactcttaaactacgcgataaattacaaagtgcctgggttttgggattctaaaattaaatgagcagaatggagctgaaattgagctgtgagctcacactgcaagagagaggcagagaggcacaggtaactctccccggaaatttctatctgtgggaataaaaatgcctaacccttggccatgccgcccctttgagacaacctctgtcaggctcactgagttcttagtgcagtctgctctcctggttttgcggatgggagagaagattcgccccgatgcacactccgtacccaggatattctggggagttaatcggggtctccccagctctgtctagtgcagccagcatgaatgccacgcagcccggtcactcaggcatggtgctggcagtggcactgcggtgacattcactaacagagattagctggttggggataggagctgtctcagaggcttgtgtgtgattactcacggagggcctattactctttattccaaaacgagcttttctttcccccctctaagtgcactgctaatgtggaaaaggcctggagcatttgagcctctacccactcaataagaactctttgaaaaccttatttgcctttttttcagccaggagaatttgtgactcataaataagatgtagatattattagctttgacttacagatgagtaaatgggggtgaagtaagggaaggaagctgtttgtgttcacatggtacgcatatgtcacctctgacagttccatccctgctcatttgcttctgccgtattctctgttctgaggtctcctttgtgaaactctttctccaagcccttaatgggcaattagtgttatgttctgtacttgcctgaatcgcagccctggttttctcccagatagtcgctgtgctcaaggttcttgcttgttttactttcttccatacaactaataactggattcagtttatttcacatggcccagaggtaatttagactggtggttattcacctttcttgtgtcatggctccctttcagcacctgataaaggctgtggatcctctccattgtaaaatatgcatcaccagggacaagacaagacagcctctctttgtccctctactcatcagtccaggtaacaccacaggatttcaaagggaataaaaatgtggaagtgtccaatgtcattatcggcagatgacataactacatggataatccaaaagagcctggagattaacccctggagctaataagggagttgatcagcaacagccacctgcatggcagcacatctgagaagacgaaagaaaccattcttcattcttgcataaaagctgttagatacgttgaaataggtcttttaaaaaggtgagacttttatagagaaacataaaatatttagaagaaggactgagaaaagaaagtttaggctgggcatggtggctcatcccagcactttgggaggctgaggcaggcggatcacctgaggtcaggagttcgagaccagccagaccaacatggagaaaccctgtctctactaaaaatacaaaaattagctgggcttggtgacacatgccggtaatcccagctacttgggaggttgaggcaggaaaatagcttgaacctgggaggcggaggttgcagtgaaccgagaccgcaccattgcactccagcctgggcgacaagagtgaaactccgtctcaaaaaaaaaaaaaaaaaaaaaaatttaaataaatggagagatgcgttgtgttcatgcatgggagggctggctctcatagttgccccaatttaatctgcaaattcaatgtaatctagtttaagctgtgacaagatttaatgtggaatatgaaatcacacaaatgaattataaaattcatatggaagagtaaggtccaggaatacctcagacaactctgggaaagaagaggaggaggggagttgtggtaacgacagtccagcagtagagtcaactcaaacccaagcatgtgtgggaacttgtatgtgtgagctgaagagttacaaatagatggggaaggatgggctatttactaaatggtgctgggagaacaggctctccccatggaaaaacaattagatcctcacattacacaacagtacattccagatgggattaaagactgtatataaaactttagaaagagctgcagtggaatacctttgtcacaccgggaaaggagtccctacacaagttatgaaaataaatttcaaaatgaagagactgatacattaagataaaaattctatgtaaacaaaggcatcctaacagagttaaaaagcaagaatagaccaggaaagtatttacaatatataacaaatacattagtacacagattattttgaaaactataaatcactaagaaaaaaagatacacgccaggtagaaaaatggggaagtttatgaatggagaagtcaatgaagagaaatccaaatgaccagtaaacataagaaatgatgcccagcttcactcaagttcgctgggggttattggagcactgcaatttaggcaacgatgagataccatttcacacctattggatttcccgacacggaagagtgttagcatcacgtgctggcaaggatatagagcaatgggaactttcagatgctgctggtggagattggtatcgtttggagagcaatttggcgatacacggtgaggctggacttgctagtccacagccagacatatcctggaagaactctcccacgtgtgcacaaagagacttgtataagaatgtccatgcaggcgtttttttaaatgaaggaaaacccaccttccctgaagtagaatagagaactaaatcaaaatagtcacaccatgcaagactctacagtggttagaaatgaataaaccagatctatatctacacagatacatctctcaaatagtgttgagagagaaaaaaggcaaattgtaggtgtccaatgtgatcatattcatgtaaacgttaagaaacacacaaagcaggccgggcgtggtggctcacgcctgtaatcccagcactttgggaggcagaggcgggtggatcatctgaggtcaggagttcgagaccagcctggccaacatggtgaaaccctgtctctactaaaaaaatatgaaaattagctgggcgtggtggtgcacgcctgtaatgccagctactcaggaggctgaggcaggagaatggcttgaacctgggaggtggaggttgcagtgagctgagatgaacaggactgcactccagtctggccgacgagtagagtgaaactctgtctcaaaacaaaaacaaaaacaagcaaaaacaaagcacaaagcaatactgtattaattatggatgcttatagatgtagtaaaagtataaaagtgtgggctgtaaggatctgcatcaaattctagttagcaatgacctccaagaagggagggaggggagaggaacttcaaactttatctgcagtgtactgctttacaacacacgcttatgtgtgtgggtgtgtgtatgtataaacatacgtggattatatacaaaattgtgcctagacattttgtactttttttctttgtatcagggtatattacatgtggtgatgtgtacaagtgtgtatatatacacacgtataatatataaacacacgtatattgacgcatatacctatatacatagacatatacacagatacacataaaacattgaagagagaaaaaagaaaagggagatgcacatggtacacctaccgcatggtgcttctggaccatctgaagcccaccgctggaggcaggtgcctgcaggcccatgttaagaagtccctactttagatgtccagactgggccgatccacttgtcaaggaaatggtgacagagaaacagaatgtctggctgcaggtcgcatgggcgtttggacagagctggacacggagcccaggaacccttcccttctcccctgcttctttctccttccagtcaccctcgctctaacctgtgtgcattgtcacctttgacattgtgactcagaaaagacaagttgcttgtgtggagaggatggcagcaaggtattctccacataccaaatcacaacagctcagcgtctgctgctcttggaaatgatgtttatcttaagggtggttcttggatgccatgctttcccttgggtttttgctttgcctggggtattgagctaatttgttgcttctgagtctgaacataaaaaggcaggctggctgccagggccctaaaagatctaagagccttaaatgatcttgaacttgccttaaatagttttacttaaaatagctactgagcaggacatacctggcccagaatttcaggtgagcctgcacgattcatttgtcagcagaggaaaattgtcatgctgcagacaacttgttcttgcaatgaaaaacaagccgaagccttaaccaggtgttaaaatgatgggccagaacttgttccagccacagcgtcaggggtttggtagggacaaggggagacccggaagagcagtcacctgtgacctagttctctgggattggttttcggtctaaggctgtcttggttttatgctctgagccaagctggactggctgtgcgcggctggcctgcgagaggttctgggtgtgaactgagggacagaggcaagatgagggttgtgaagctcattgtcttaaccctcctatctgacgtcttcacccggatggtgatgcctttaagtgggcaggagtttaattgaccggactgccctcctgagtcattggagctggtgcggggagtggtgatcaaagccgagccagctgccatctctggagccagaaaagctccagaaggcagcatccagggcagactcagaatcaggactgagcaggtgcaggggcagactcagaatcaggagcagactcagaatcaggactgagcaggtggctcagctgactggaccattagaaaggcttgagtttctctgggcggaaaccagggaagcaaatgagaaacacggagctgtcgatgggctgggggaggctgggacaccgcctgatactcctgccggctttgagctttgggtggtgacagggacactcagggctgtccagaccctgttctccagtgtccgccaactgcatgccggctgggaacgtcctgagcttttttggatctctgagcctctacacagattgtggcatctagaaagtagttcctctgatcttctgcagctcagccaggctgccgacacctctcctcctcctttcaccctgccctgggagggcttccgggttgtacttgccctgggtggctggcctcctcctggctcctgggactgggtcttggccttgccaccgaccagaagccctggtcttgctcccaccagctgatgtttctcctgactattgctccgaaggccctcaccagccctgcagggaggtgtcaccaggcctggttaatggtgatgaggccttagacccaggtaccttctgacaaaccagtgactgacaggccagggccggaccccacaccctctgactcaccttctactgctgtcacctcgtacctgcttcccagacaaaggtaaatcatcagacagaaaagcctttcggcttctgccagaatgaacagacaagaggcatagcaacctccggagaccccaccagccgccgtttctccctctgtccaccgggtgcgtgcacatgcgtgtgcgtgaacgcgcacagactcaaagggctgcacaccagcatggctctgtctcggggaatctgtactggctcctgctcatcagcattggaaccactcacacctctctctattggagggaaaaagaaaagccctccagtccttctaggaagccactcaaactacacatttgagtcactcacatttcagtcactcaagctgcacatttatcagctggactaatcatcttttgctgaaacctcctcctcgtgtgggtccctgtctacaagaagagacccctgtctaccttagtggcagagctggaggcctagaggtcaccatcgcctcctcctgctcccgtgctcccccaagcctgtctcactgtctcctgaatggctctcaggctccctgcattgcccctgccaccgcccagcacaggctgtggcctctgtggcctctacctgcctcagggcctcctcctgccccaccccaccgcctcgagccctggctgtagctgcagctctgcccatcccccatcttcatgcttttgcttcctttcaggctttgcttctgttgttcttcctgcccagaacggctttacctgtcaccaggttcgcccctcagccttcccacccgtcaccaggttcgcccctcagccttcccacccgtcaccaggttcgcccctcagccttcccacccgtcaccagattcgcccctcagccttccaagttctgctgcactgtcagttccatcagccgactcaccccgatttccccagcccgccggatgtacccttcgtctgggcccccaggccccctgccacctggacgttgcctgctggcttgcctgtttctgacactgggctctgggcttcctgggtgagtcagcccaaagttaggcctctggctgctctctaaggttagttccgattctgccacctctgtggtggccggcagacgtgcgttcatttattcagcgagtattgctgtgtgctctcactggcctgggcacttagagataagaaaatgtggcccctgccttgcaagagtcttaagagactcttggttatgagtctttgtgagggaccaaggccaggcacctgcgctttgtttaagtgtcatttattgaaccacccccaccatcgctttctcatcccaatcgtttgctttttggagtcactcgataggccctgccacgtacgtacttgtacatgaggacaccctctttgtgatgctgtagtttgcctcttggccaggtcagctccacactgatctgagagccctgtgtcccctgaaggccccactagtgccctggaggccccactggtgccctggagctcactgtggatgcttcacaccctgcgggtcccatcatcccatcaagctgtggtttttcctgatgtccttgtgcctctgccctttgagcatctggaggacccagcagcaggcgcaaggccccctgtctagtcctgcaaggaagggggatgaatagccatcagctgtcaggagcctcacgctccatgggatgggatcagcagcctagggttcccatggcaaccagcccatcaatgccctcagtgtcaagacaggggcaccgtggaaaggaagaaagtctcattgtcttgccttggctgcttgggcataaacaagctgcgctccacagggccccgcagccacgcccgacctgtggctctgcccagccgcacatggacccatttactgaattgggctgggaagaggctgtcactgttagttctctaatcttcctcgggggctcttgtatttctgccaccggccagcatccatcacttctagagtccttgttgggaaaatccatcttctcagtgagagtgggcagaaacagcccaaatggagcagactaccgaagctctgagtgatcagccagaccgccctggggggaatccatcagtgggtaatggcatcactcacgttcctgcaaggaacctggacttccagactttcccgctttggtttcaaacaccctgatgacaactctcagacatatctcctgtgatcatttaagcagatcaccttgagatgaccactgctgggcttgccacaggcggacagtctaagaaggtcctgtcccccttcctggactgtccccctgggaggaccccagcagtggtcacttacaagagcttccttcttgccttcaaaaggcccaagttcacctccctgatcattgccggactcttccctgggtggagatctgggaaggtggtggaggggaagggaggggctgcctcgtgttggataagggccctcccaccagaggtcaggcctgctgttccctgtctagtagaaggctgcatggaggtgctcctgtgccccacaccgttctgctcacctatcttgtaccccgtcctccagatgggaaaccagatgtctctctggattcctcccaccagcctctgcatgcaccgaccacagccctgtccgaccagcctctgggtctttctcccctgccacccagcccatggccacagccgaggccgggcctgctcactcatactctcactggtggtgagtgtcctggtgactgcctcactggcttccctgcctcccttccaggccatttcccacacggccatccgtaggattcttcagagccccactgctctgtgctcacccagaacccttcacttttaccacacgcatcttcatgaagtccgggcctttgacattcaggacactttccatatgctttttctttcttctgcacctatctgttgctgtcgttttaacctgggggccccttccttgtgtggtctacccgggccctgcccttctttggcattagccaaagtgctgcttcctgacctgcctgcagccctgtcctctccgagctccacggaggggctcggccatggcgtgcggggtgtctctctccccgctagaccctctggaccacagcgtctcatagtctgcgtctttacgtgactcattttgcttcctgaggccctagtgcagttcctggcactgagaaggtttagtgaatgagaaattgttagaattttttatatcaggacctgtgatgtcctgattccattcaccaaaggcaaatcatccttaagcgtgagtatggagaaaatgctgaccttgttatcttcacttctgctgagctctagcaggtttgtgagcagcaaatatttgtgatgtttctgtatagtcaaatatcgcttatgctttccaccctttgacatctcttggtaccttgcttttgggttctgtgtttcctgggactgagtcttgctgagtgattccagtgtcacctgcagggactctgctctcaaggccaaggcagatgttcagtcatctgtgccacgtggctactccgaggcagaaccggcaagtctggacacacctagcatcctagcctggtgttctctgaagctcagaacgagcatcttgctccttggtgggcagaagaacaagaggaaaggaagccagaaaaagaggaccggggaagccacagaagagggagggagggaaagtgggaaggaggactgaggacaggaggcatgggtgtgtcctgcggccttggtggagcctgtcctgtggaaggtttattttctgtaaagaagcagtctggctcgtgcctgtactcagcctctctgtccccacacgtgactgtccttagaatagcaactgggtcctcggattccagtaccccaccatgactgccgccagccactcctatgtcagtcttggctgtctgccaggcactgctgatgattgcccccagaaccgtactattaatcccattacacagatgagcaaactgagacccacagaggctgagtaacctgctatagtagtaagggtcagagcaaggctttcaacctgggcaacttgcattccaggccttcctcatagacagagtctgtgtctattaggaaaggctacaaggagcaggtggcatgtgagccgccacggagcttggcttggggctttctaagtggctagggcagaggggtgcagtccaggcagatggagggttggggcagaagggacctgtgaagaagtcctcctgtactatgggatcctcccctccttatcagggctctggcctggagctcagttcaaaggcttatctatgcaggaatgaaggcaacattcttgatgtagagtctaagagtctgaaggtcagggaacctttcttggataccctcctttctgcctaccagaaccctgtgtttcctgcctgctgggaggcaagtggaacacagtagaaccagatcccaagaggagagaagaggctggagggggacccacagttgcatagagggtagcatggcctggttataagactgtttacactacttgattcctctcagtataatacagaaaggatatgtggatacagaatatttttgcaatacagaaaagaacaagaaaaccataaaaatcacccatagtcccaccaccccaaaataatcactgttgacactttgggccatgactttttgttttgtgattctgtgtctgagtgtgtgcgtgcacactcatatgcaggttgaatatcctgtatctgagatgcttgggaaaagaaatgttttggagttccaattattttagattttgaaatatttgtgttatgttcacttgttgagcatctctaacctgaaaatctgaaattggaaatgctttgagtgtcctgttggattttggagtattttagattttcaggttagggatattcaacctgtgtaggtatgcatgcacacacacacagacacacagacacacacacacacgcacacacatatattcaccaatgtcttatacaaataggattgtctacttttgcaacttgtacctcccacgtcaataagtcttctatggcgtaacttgtaatggctgctcagtgtaccttggcgtagctggcccatcatttgtgtcattctttcctgacgtttaggtcagtgagttctttatcactgcgtggggaggtggatagtgctgcagctgctgtggaaggtcaggaccgtgcagggaggtggaagaggctctgccactgcgctgcttccccgccccacatgccctgggtccctggttatggcgtctcatcccacctacctgcatctcccgtccggcatcaccagccttgcagagggtccacacttggtaacatctgttcagttcaactcattaggattttatcgagcatttttatttaaaaaattatacattgcatataaatttataaatttagagtattatataaatgctcccccattgtaaagaattcacacagtgcaggtgtacaaagcaaaatccaaaatctccttcctcccctcatccgatccctgatttactccttccctgagatgtcaccactgttcacacattagtatatgtgtcctgtttctgtgccttaacagacagatacgtgcgcatatacacacaaaaagaatttttgttgttttttttttttttaatataaatggaatcacactaaacatgtttttttttttggacctacctaggttttcttcactaacagtgggacgtcttgggaatcttcccatgctcgtacatagagacctacctcattctttttaaatagttttatggcattttagagatgcaacatgttttgttataccacacctgtgaatgttcctttgatttgcctccagtttttttctgttataagcagtgttgcagtggttatccttattcatgactctgcacttgtgagaatttctgtaggatccataagaacaaaacaaatactagttataataataaatggtgattgctggcccttactgtgtaccaagtaacttttcatgtgctttccttgtattgactcatttaatcttagaaactctatggggtaggtgttattattaccctcattttacagatgtggaaacaaaagcacagagaggttaagtaactttttcccagttacacaacttgtaggtgccagagccaagatttgaacccgaatagtctgactccagagaggggacctgctgagtcaatgtatgtgtgcaagttacattgtgttagatgttggccatggctctcccaacagatagtgccagttgacactgcccccagaagtgtgtgtgggccccaccgattttgtgtagtgatgaccaattgtcatatttgccagttcttataggtgacaaatgagatctggtggttgttttaatatgcttcttttccctcattgttattcaagttaaatgttgcttggccagcacagtggctcacacttgtagtcccagcactttgggaggctgaggctggaggatcatttcagcccaggagttcgagaccagcctgggcaagatggcaagttcctgactctacaaaaaaaaaaaaaaaaaaattagccaagtgtggtggtgtacgcctgtggtcccagctactggggaggatgaggtgggagaattccttgagcccaggaggttgaggagtcagtgagccaagaccacatcaccgcactccagcctggacgacagagcgagaccctgtctcaaaataaatgagtaaataaagttaagtgtctctttatttattaggcattttaatccttctctgaattgcttatttatattctttgcccattttttcagtggggctgtttgtcttttaatgattgctttctctgtgttgtagatattcatcccttgtttttaagtacgttgcttttcattgaacactgttcagagtgtttgttggctttgcctgttgttgtttgaagtaaaatctgcagcaccatttgtttgccaggctttgggctcgtcactcagtgtaattcagagatgagtaagacaaagtccccacctaaaatagacagcacgtaactcttgcgagaggagtagtgaacggaatataggggcggagtccaaatgttttaggataagtgaggagaatggggcagcctctcaactggggattcagggaagcctttgtgaccagtggcgctagggccagacctggaggggtccatagaatgttcacagaggaatgggaagtgggggtgtgtttgggcagatggatcgtgagtgctttaatctgcatcccatccgaaaacaactcaccttcaatgacccactggaaaagagtctcatgaagaggctacttacagggtgtgcatggggacaagggaaccaacagagggtgttgaggtacccggggactgggtaggcagtggtggggagctgctgcagggatggaggcaaaacagtgttagcagatcctgtgggagctggagctgagtagggtgcagcctccttctggtgcctccattggcctgggcagtattgcctggagggcttagtcttctgcagcactgagcagggcagagaatggtggagagtgggtcagaggtgtcaggggaggtggagggagaaaaatcagctcagtaaggataaaagcagagatagaagttccagatgtgtgaaggcctcagcaatcctcgatgccattagagggtaggggggttcatttgctgctggttttacttagcaaacatttattggatgctggctcaaagcctggccccggacgaggtgctaagttataaagatgggtcaggcaggctgcgcaccccagtgatcaccgccgtggcgccagttttagctttccacgtgtcctctccgagggtcacagcagaggcctgtggttttatgtctgttagaccccatgtacctggatctgtgcctccttgtcccagttggagtttatttaggtgtgtctgtctgaggacagattttaacatggaaaaataagtccatttttggccgccattgaattcagtctaacatacatcttgatcttctgctgtttttttccaacttaaacaaacaaacagaaatcccaatttgtgttcctcttgataaagcccaatttctatagaaagaaaagaaaccttattgctgtcctatcaaagtaaccatttatgactgagctcattaacagtcttatacacggttctgtttctcatttgcaggaatatgatgccgttagccaagaacaagaagttagatttgtttcagaggcttagacaactttatgtatcatgactttgataatctaagaccctcacaaccattcattcattcattcattcattatttatttatttatttacttatttatttgagacatgagtctcactctgtcactcagggtggagtgcaatggtgcgatctcagcttaccgcaacctctgcctcccaggttcaaggaattctgcctcagcctctctattagctaggattacaggcgcacgccaccacctccagctaatttttatatttttaatagagatggggtttcaccatgttggccaggctggtcttgaactcctgacctcaggtgatccacccacctcggcctacaaccattcattttagcacaagatgcaaaagcctgtctgtgggaatagatgctttctcttccccatggagttctgtgaactcattagtactttctaggatttttgtttgcttgcctgctttttcaaggaatttgctattctaccttgttctgatatttggtcaaatcagaaaacgttagaaaaccaaattgattctttcttacactaaataatcttaaaatccaaatgaaggctaggcatggtggcttatgcttgtaatcccaacactttgggaggccgaggtgggaggatcctctgagcccagaagttcgaggctgtagtgagctatgatcatgccactgtactccagcctggatgacagagtgagacactgtctctacaaaaaataaaaaaattagccagtcatggtggcatgtgcctatagtcccagctactcaggaggctgaggccagaggattgcttgagcctgggaggtcagggctatgcagtgagctatgatcatgccactgcactccagcctgggtgacagagcgagactctgtctctagaaaagaaaagaaaacaaaacaaaaaccaatccaaatgaaacctcagaggtaggtatggacacattagctctgggagactgtcaatacaaggctcacattgagggaccagaactaacagacccacactatcacaagccaggtcttaacagccttccttttccaaccagggaagggcagctctcaaacctaaccagaggatctttccactttctcttttgattgttactcataaagagccctggatgtattttctattttcttctgtcaaaagttcaatggctacagagaactatagaaaatcctgtcttaacccaatttattttcttattccaagttggttctactttccagcaattggttcctttcctggaggtagttgctttgtgcttggtgtgtgctgatggctgtgccagcctgggcatctcatcatgccagggagctgctcagcctcctccctggtctctcctgaaaactgacctcctcagtggagtctcagtgaccaggcgccaccattgagagatccttttgtctctccaaggttgagggaacctgtttgtgcacttgccactgtcattctccccacagcgtcagttttgtttgaatcgtgctgtcaggttgcatgaattagattgcaagtctcgagcttgggccatgtttctgcatgcaccgtgggtgtgaaactgatgcctggcagattgtcccatcgttagaaacactggacagagccggaagggagcagccatgctgcccaacccgttttcaatgccatgactttgtcctgaggcctcttcagggagctgtgttaacgttgagcccagtttgatttctgcgtcggccccttcatagcagaagacgacctgctgactgctgtggccaggccacctggccgtggggctttgaggagagactcaagccaacaagtgccgtcagtcagagcatgtctctggtctgcctgtgtccccttgctgggttctcagcaatctggggcgatgcctccgttcgatttttttttcctcagaggattatggagttttctgggtcatttagcttttttttatcacaatttcgtgtttcttaggtccatccataggagaatggaaaaacaaatgtgatacattcattcagtgagcactcttttattcagcaatagaaaggaacagacaaccagcatgcataacaacgtgcatgtgtctcatagacaggccaagtgaaagaaaccttacatgagggtgcctgactccattcagaggaggttctagaactggcaaaaccaaatgtgggggcatgaaagctggaggttgaccgggaaggcacatgcgagactttctggagtgatggctgtcttctgaatctcagtaggggtttgagttatacaagtgtgtacatttatccaaactcaacaaatgtgtaatttacttttgcttgtttcatcatatctaaattttatctcaaaagaaataaatctataagcaaataatgatgtgtatgttgaagtctttagggagatgtatgttgtgtactgatactgcagtttactttggaatgcaccaaaaataagatgtgttgacaaatggatagaaggatggatggatggagagaagtttgatcaagtgattttagtgaatatgttaatggtagaatcaaggtaatgggcatatggatgtctgccatacaattcattcaacattggtgcatgtttgaaaaatttcatagcaagatgttgggagaaaggtatttttgtggacgtgggagagaccccatgttgtctttgaagacataatcataaatttatgtttagagatgaggattagaagcctttctagggatttagtagggcaaatgatgtcatcaaagaaatctcctggaatctgggttcaggggcatttgcttttgtagaggatgttctggggctacactggcatctgaaaggattactgtggctctctgagccactaacttgctaggctttccccaggcagagtttcagccccagggagaagcttcccagtaaatgtaaatgagcagagtccgtggtttaaggaccttcctgcggaggagagagaaggaggagagataagccgcagacacccctggcacggcaaggtaggctgggttgcttgcctgctaattatcttctcggtcttgctccgcagtgtttctctagtttcagaatttgaattgctgactttgtgtagaattttcagcctctcgagttgttgaattgaagggcagcaccacagccattccctacagagtcctaacggacaggcgtcctatgtcggaatcctgatcctgtgtaaccccggggatgtaccagggcaaatgcagcaaagacacagcggtcagactccttgtgggagaaccccggcctaggagaagctgctggtaaatttagggcacgttggagaagtgggggtggggagagaagagaagaatgaaagcattattctaaggagctacttttatttatagattctcctaattctattaaaatgaatgccggagggatgtaaaacttggaacacataacacataatagaaatgaaaggacattaaactaaaatagggaaaaatggtaaaatgagaagagaatcttagtaccaagaggaagatgtgacatttttctgaaataaaataatcttacagcacagtgtatggggaaagtgaattaaataaagtaaggacttggttagcagaaaacttggaaggaaacaaaatatttcataatgaaaaggagaaagtgttaagctgactcaaggggaaaacacatacagatattacactaattacattataaagacagataaataagatgtcattgttgtaaaaggaaataaaactaattaaatgtttaatgtgctttaagagacattggtgaaataaaatatattaactatggtaaaatatgtgaacaggcataattcgcctgccttgttctggcagccagcacagtacctcacctcctgtgtacaaaacaagggacgtttgatccctgagttggaatggttcagctctttcttcaaaaaaaatggcagttagaagcacctccaacaactgaatgtttgcaataatgccagtcccgaagtgagcactcagcgcgtgttgttgccagtcatattgatatcatcacggcgattatcattagcactggatgagagagaaacagcacgtccttccagcgtcaggccttggagtcagactaggaaagcactatttttaaagtaggaatttaaagctagtaaaaagtgtcacggagaagatttcagatccactgtttcttttaccttttgtgttggccgatttgaaaagcttaggatggaaaaggcagaagttaagccaaactaggagacaaactgctgagccatgattcagcagctgggacatttccagcctgcacaccgtcctcaccggctcccagcgaggcacccggctctagccgctccattcagcagcgtgtggacacccctgctcagtccttcgcctgcctggcatgttcttcggggctcgtgcccaccaccactgacgcaaaagaggaccctcttgcctgaaattaattaactaaggattctctcttaaagatgaaagaaaataaaacttggggttaagatgacagacggagggtctctcggcacttcacccatgtcggcatcttggagccagcgtagaagcttatgaaggaatggtttctcgcctgcacacagtcacgcagggcatgtagcagctctctacacacgtgcatttgcctgtaaactacaaatgctcactgtcttcattcccaagagactgaagtgcctggagaggctggattattatcctctcccccagcttttcttgctctgggcatcacttgggatggattgtacagaaaactgaccatcttaattaaatgagcaggagttgtaaggctcttctagaatgggagggcaaaggtgggagtgttttttctccctgtaatagtcaaatttccccagaatgcctaaaaaaacacgtgtttctcatagcgctattttgatctagtagttcttgcaaaaagagctagtgacaaaatgagaactttgagatcagaagagctgggtacgaatcccagcactttcgacgacaccttgatcaacagctggggacctctgacatccttgaatgtcaaatcattcacctgtaaaatatgattgcaacaatcattgccaaaatagaattctatatccagctgttgtgaggattgcagcataaacttaaacctccgtgagacgagctgtcatcactagtgcagatgtgaggtctgtctccttgcctgacgggcacactccatgctgatcctagagagagctgtgccttcctgtgtggatacctaacagcagtccatactgtgaccactggcccagcatcaaggacgtggatggccactcccagttattagtaccaactgctgtctccttcatggacattttgcctgggatggttctttattggattttggaggagccatacaattctgggtgtttgtggagtcctggagtcatggcccaccttctgacacgagagctgaaatttggaagcatcagatttctgtgattttatttaaccagtaatctaaaagctcctgctggaaatggagagtttgcatcctgctaaggaataatatgctggatgtcacccaattccagagcatcatcaaacagtagctaggaatgtattcagatgcaaaaagtagatgatagtggcttaaacaaagtggggctcactgttttcacacagtgaatatgaagatggaccatccagggctggtgctgtgacgatgatgatgatggtgacaatgacaaggatgacaaactcttactgggcaagaaactgctctgagggcttgatctcatttactacttactgctaacccacaaactaggtactttccctgtctccacatcacagatgaggaaactgaggcacagagcattcagatgacttaacccaattagaaatggcagagccagagctgacaccacacttttttctcctttgttatttttgaaacatgtttaacatttaaaatctattatttgacacatataaaatatttcccacaatatatttgttggttatacaaagtataacaatagaacctgtgaagccaccacccgtccagtgactaggctattaccagtattacctacgcgttccttgcaccctaccacctgccagacacctccggctcccgcaggaagccactgtccgcgtggcttgcgtatctccggcgtagatgtgcttagacaacgtgttgcttagctttggttttgagcactgtgggaatgatgtactgtgtggggtattctgagacttgcttttctccccccagtttaacatcgtgtttctaaggtttagccacagtgtggctatggccccagcttagctgtggttctcttactttcactgctgtgaacactaccgtgttttttggccagcacatctcaatgtatctgtccattctcctggcatgtttgtaattcttttttaagaattgttgttggccagtcgtggtggctcatgcctgtaattccagcactttgggaggctgaggcaggtggatcacctgaggtcaggagatcgagaccagcctggccaacatggtgaaaccctgtctctactaaaaatacaaaaaattagctgggtgtggtggtgggcactcgtagtcccagctactcgggaggctgaggcaggagaattgcttgaactgggaggcagaggtggcagtgagccgtgatcgtgccattgcactccagcctgggcgacagagcgagactctgtcttgaaaaaaaaaaaaaaagaattgttgctaagaacagccttatacaagaccgctagtacacaaatgccagagtttctttggggtgtgtgcctagaattgggattactgggtgtacatatacggcatatgaatcctttgtcagttaacaggagtgggaaaccgtgtttcccagtttatgaattttttttacctgtatggggtgtcttctgattaaactggagagttaacttttacataattgtatataaaaatttattctcttttaataacaattctgttaagttataattcacataggatgcacctatctagagcatgcagctcagtgggttttggtacattcagagagttgtacaactgtccccgcaccccatctgataacattttcatcaccccagaaagaaatgctatccccgtcttagcagtcagtccccatctaccccactcccttaaccctaagcagccactcatctactctccgtctctctagatttgcctattctggacatttcatataatggaatcatacagtaataatagggtctttttgtatctggcttctttgacttagcatgttttcaaggttcatccattttataacatgtattaatatgtcatgatttttatcaccagataacattccactgtaatgaattgcccacattgtgtttgctcatttatcaaccgatggacatttaggttgttcccaggttttttgctgttgtgaataacgctgctgtggatattcacgtgcaagttgtatgtggacgtatgtttttacctttctagggagcttatctagctgtggagtggctgagtcatatggcagctctatgtttacatttctgagaaactgccaggctgtggacccacccttcacggtctcaccagccatgtctgagggttccagtgtcaccacatcctcatcagcacttgtgatgatgcgtctttttttctgcacccatctcatagatggagtggtttgcatttcccttacggctaatgacgttgaacgtatgttcctgtgctttttggtcatttgtgtctcttttttagagaaccgtctgctcagatttttgttcatgtttagtgggtttatgtggcttttattgttgtatattctagatacgagtcctttatcagacacgtgacttgcagtcattgtcatccttctctgggttgtcttttcactttcttgatggtgtcctttggagcacggacattgtttttttaatccactctgacattctctgtcttttgattggtgtgttgagaccattcacatttaaagtccttgctggcgttgttggatcagtatctaccgtgtttgtaacttttctgtttgttacatttgttctccgcacccctgcccctccccaaccccactcctttctgccttctctggttttcattgagccttttagataattccattttgtctccttgcttaatgtgtcgattatacttctcttaaaatttttttagtggtttccttaaagattacaatacagttcatacttaactgatttaagtccaccttgaagtaataccgtgcggcatcacgtgtagttcaggtgccttagatcattaccaatgtccccctcacggccccatctcttaggacaccattgtcttccttcagttagcgcttcctctgttcttgtttaagaaatccttcctaccccacagtcagaaagatctcctctagtgctagtcagtgtctcagaaggcaacaggtggcccctctgtcctcttctaatagccctcatcccgccagctcagagccagagtggagcctcagccgttcctgggtgtgtccgcacactctgctctggagctggggaatgacctcaggaggggctgagctgcactggacgtaccatcagatggtcctgtttccatgagcagaacaagacgtgctgtttccacccagctcaggacctgtgcgtctcagtagcacatcagggctgtagaatcagtgcgggtttagggcctgtgtttagtagccagtgggaggtcagcgtgtgtccctgtccccagcacacagccgcctggcaacaagtggccatgcgagtctggggaacgtgtgaggacaggctgaggacaggctcaccacacacgctgattgcccctcgcagggccctttcttaaagggtcccagcctccccgtcattggtctggacactggatgatgttgcaaatccccactatggttctgctcagcagacccagtaggtcccagcttctgtgtgtcaagcggcatctgatcaggcttgccctctttttcatcttggagcctctccccaggtcctgcgagtcaagtacactgagtagcctctgtccccttgcttaggtgatcactctggtatgcccgccgctggcccctactacccaggatcccgcagttcccgtggagagtgggaacctggtgctgtgggagcatcccttgtcaccggcgggatagagcggacagcctccatggacttctttaggaggacgctgaccctcccccaggcattttcctaaccccttggtgaggagaccagctccaggcctccccagggagtataggccaggtggcttaacagggtgtcacgcagtagatccctccagcctcccatttccctgcattcccagcagaccagcagcagctacatttgggaccttgttagaaatgaaaatccttggaccccaccacagcctgctcgatcacagactccgggagagggcccaacaatctggctttaataaaccgtctggggctggagaaccacagctctgcaggatgtcccggaggtccagcatactgacctcatcagcgattggtttttattaattctagacttggattagccaatcttgtagactatacacacccctcgatgttcaaggttcacattaaatgaccaaattgtgagggaaccaccttgtccacacgtgtgggtacatatgacctacttgcatttcgtcccgcttggagcccacctcccaggctcctgcccccacacagtggacatctccttctgacgcagttcctgtgccttggggtctgccttgttttatgggcccaggtggcgcaggatgtgggtgagtctgtggagaaagggcaccagcttgcaaggcagcagccccaggagcagcctgggaaggctttgtgcagaggaggcctgtttcctcctacgtgttgggagagttgtctctgcagatggtgggtgagagttcgctgccaaaaccactgtcttccctgccctgcggacacttcttcctcaccttcctaaaactgtaagagacctggagccgttgagcatcaatgactctttgactcaggaatcttaaaaaatcacaccctggggctaccatgggggccttctggttctccttgtgtattactagttgaatgtttatagctttcaatttctttttccccttctatatgctctctaaggacataggaagaatctacctgacctcacagctttggtaggcactgttattgccacaccctcttctcccagtgggcaccccacaccccaactccccggcacgttgttcagtgggactgccagtatcatgtataatcatgaatgctgtggattatccttattcacacacacagactcacaccctcacacccagaaaggcaactatcccagtgctcccagaatagatgaacaaccgaatcccagattcccttcgtgaggatttatttgaagaccactttcagtaacaattactttatcagtggaggtctcagcaggaaagatacggcacatagtagagcactttgaggaaggtcactagaccggttcccaaggcatgggcggagttcagagaaaccaccaggaactggtagcagcagaattgttgcaacgcttggccccaaaggaagaggggagggaatgttgatggcacctggaaggagaggttgtattgacaagtctccttggtagagcagtgatattcggggagaaacacggccagccagaagttaccctgtagaagggggcagaggagaaaacaagccaattcgaccctcctcccaacctgcctctctcgtctctcccattttctgtttccaaaaccgacccacagtcagagggcaaaggagccaaccagaaggcccctgtgtgtgatttttaagattcctgagtcaaagagtcattgatgctcaacggctccaggtctcttacagttttaggaaggtgaggaagaagtgtccgcagggcagggaagacagtggttttggcagcgaactctcacccaccatctgcagagacaactctcccaacacggaggaggaaacggccctcctctgcacaaagccttcccaggctgctcctggggctgctgccttgcaagctggtgacctttctccacagacttgggcccccatagccatgtgcctggggctgaaagcacggtagaggaaaccggaaagtggatttagagggacaaacagaagatatccaacccactctcagacgtcctcctacaagttttagttttacttctcacacttaagtatttaatctagctcaaattggttttgtgtttgatgtgaagtagggattttattttatttttttctcatatgaataaccaccttttcccagcatcatcagtggattagttcctcctttcaacactgatattctatcagtaaatcaagttctgtatttgcatacagattgtctcccttttctgttccacgagttaaacttgtctgtctctgacccagtgcctcacagacttcagtactgtatcttcataataaggcttgatatgtggtggggcaagtcttattctttttcaggagttttaggctattcttggccctttgttgtttcatattaactttgaatcaacttgacaagttccacaaaacaaaagctgttgggattttgactgaaattttatttaatatatacatctatctatctaatgtatctttatgatatgggaccttcctatccatgagcatggtatctctttatttaggtctcctttaagtattagtaaagtttgtaaattcttatatacacaacttacacatctctgataaaggcataggtaccttaagtgtctaacagttgttgctagtatatagacgtgcagttgattttttagattggtctcacatctagccacctttcaataaagtcccttatttcttccaataatttgtctattttttatgtaaaccataggaaaccatagatttgatatggttatctatgtagatagtcatatcatctgtgaataattgtagttttgtctctccctaatcaatctttaagctaattatttatttatcatggctgttgttgactagaactttcagtataatgatgaataaaagcattgattttgggcagtcttatcttgttcttgattttaaagggagtgctttcagggtttccacattaagattgatatttgctgtttgttttttgtaaatgcctttttaacaggttaagaaagcttccttcttgttttaatttgctaagagtttttaatcatatgggttttgaattttatctaatgcttttcctgtatcttctttattctgctactgtaaaaattacagttattgactttctaatgctaaaatacccttgcatttttggaataaactcaccatggtcatggcagactatctttcttcctcgttgctgaatttggctttctaatattttagttaggagttttgcttctatattctgggtaaagtggacctagagtttccctttcttatactgttcttgtctgtttttaggattaaagtattctggcctgataaatttttactttttctgttctctggaagagcttgtttaagactgggatgatctataccttgaaattttggtacagcttacctgtgaaactgtctaggcctgttctgtgtgagagagatgggtgtttaagcactgtttcagtttctttagtggaaagtttgacaagtcctgtatttgttttttagttagtggtttcataaattacaattttctaggaattttttaatgtggtctgtgttttcagaattatgagtgtaacggcattggtagtgtttccttattgtttttaaacctctgcttgatctgcggttacatcctttttccacttatcatgttatttattcgtttgcgccttaatttttttctttatcagtggtgccatgggtttggctatattgccagatttttaaagaactgcatttggccttttaaattctattgtaaatttgttttctacttttacagagttctggtcctaattgtattaccttcttctcatttttttttcttttaactttttagtttgatgcttaatcccatgaattttcagcatttctcttaccacgaacacctcaggttacacacatctttcccggggtcatgtccacagttcccatgagttgtcctaaatagtattttcattatcattccattctaagtatttttttatcccaattatgatgttttcttttaccatgagttatataaacatgtgtttgtgaatttccaaatgtgtgacatgtttagtctttctttgccctgttgacctccagcttaattgcattacagccaaagactatgctttcttggaaatcagttcttagacatttggggggtgtgcttgaagtcctggtactgggctcagtctttgaaaacgttgtgtgtctctagagagaaatgttattctctgttgttgggcgtggagttctaagtctgctggattacacctcttgacagagtggctcagaccctttccactgccattggctttttgtctaggtgaccctctgctacccctgtcccttatggcccctggaatcagggagcttatgtaggaggagcaggtgtttgggctggccctggagggtgaggaagatttggcttgatggaggtaggcagggggcctgggtagaggggacagcataatactggtgaaggaaggccagggaatggtgtggcatctcgaaagagggccagagggcaggaaaaggctggggcagggaccagaggccctgggaaagacccctctttagaagaggggcaggagagagtcttctgaggggagatgagagagagcccacagagaggaggacacggaggggtggggttgggtaggcccaggccatcgtggggggtcttcctgggcaggagagggacctgtgtgacggttcataggggcatagtggtggccatgtggctgtgtggggaggaggccctcagttcagtgtggggcctgggatagtgggtggcaaacatcagatggaatttcacagaacctaacgcacatctctctccctcgaggtgaatttttctttacagacctgtgaatctaagagatgatgtaacgcctgaactcattttataacatcagaagtttgcgacttaaaaatgtttcagaaggtgggggcgtgggctgtctagggttctaaggagaacgtggttgaaacagctgcctaaagggactgagggtgttggaggacccggtggcaggcgcatggatggaggaccaggaaccaccaaggtcaccatgggtgggaggcatcagggtgagggaggggtgttggtgaggggcccagctggagctgtgttcatagttgctgggatggaggggacagggcaggattcagggtgtcagcagagtcagttacctgggaggcgtggcacaatggtgatggaggagggggagcccaatgatagtgcagtgaggaatggtgggggggacgggaatggtggcagctggtggtgtggacttagggtggggggacgggaacggtggcagcgggtggtgtggacttagggtggggggacgggaatggtggcagcaggtgatgtggacttagggagaggagacgcggagcaagccgggagaactgggtgggcctggatttgtcctttcctggtaggattactgtggccacagaatttattgtgcaaccaggatgtttctaggaagtaaaagggagagcctggacacttacagctgggcaacaggatggaggaagccagcacacacatgattccctgtgcaggcacgtaggggctttcagctaagccaagggtgtgtgaggaagcaccaaaggtgcagaggagtttctcccttgttttggcttcaaaatagatgtttgtatataatagggattcccaagggctcagtgggcggagctagcagtgaggctgggagaggagaggtggcctggagagggtttctcttctgtccggaagcctttctcccttggctgagagaagctacacacacgccacttctctctgaacacgtggctcgtgaaccacagtcctacagctgtcagtagtaaaatccaggcccatccagcatgcttgcgggatgtcggggtggttaaatgaaatggaaggcagtttgttttttccaagtgagatggatgtgaaggaattaggtagaagctgacagaggtatacccaaaactgctaaatttagcctggattcaagaaagaggttagagaggtggcattgtgagtaattagacgcgtcgcagagagcgtgaatgattgacagagtttgtgtctgtggttgccgctggggagaaacagagcagagtgggagtcttcggaaggagcgaggagccaatctgctgggtatgtggagcctttgggaccgtcagtcgcgcttcgggtgctggggtctgtttgcgctggagaagatacacatggtgaaagggagagtgaggcacagtccctggagacagacgatggtctgtaaatggtgagcaaacaacagtcaggagccttgctggagtctgtaccaagggccctcctaagaagccgggtcctgtgggggtccagtgactgtgtacagcccgggggtccagtgactgtgtatagcccgggccacattgcccagctcgggtctctacggcatttgggtttatgcctcagctcaaagccttgcggaaacccctttcaacatgtgcgctgtctgctgcagagactcaaacccactggggcaaagcgaacacacagcactggagttgggtttcacgtccctatcaccacgacctgtgcccaccaacctagaaatagttgggtgaacttgctggttgtttgctgagatagtgcacatggcagtcacataggtctttactgtgtcttgcctgatagcccagcatgagtagaacagccatggagacctctgagagagcaggacgaatgtgtctgaccatgttgttgcaagccacctaaaacgtggctggacccagctccacctctggagggacgtaccacgggcaaccatctgtgagggtattgcagacaccagatgtcagcgctggtagggggtaagcaaacatcagatggaatgtgagcataagagatgacataaggccagaatgtgttttacaaaatcagaagttttggacttaaaaaatgtttcagtctggaattggacagatagcgcaggctcattttatggataagaaataagttagtttcaagaaaatggattgccagacacgaatggtattgcacacccagaggggtggccagggctgcctgtgtgtgggctgtccccggcacagctcctcggctcccctctgccctgcaccctgtactgttcaccttggccctgtatggctccgtctaggtgggattatcttccccacaggggccactgataaagaagcactctatatatttttaagaattgaaatcaaagggcaaatgggatttctctaactttgcaactagctttattgcaatgcacttccccccacaaagggagctgcatccttgttcttttctttaagaaatactatgaaaaaacccagctgaccagcctgcgccctgggaggctggggctgctctctgtgtgccaggccgtgagccgagcattccatatgcatcacgcctcatttatccccctagaaaccttgggcaaggaaatgctgctaatcccaatgcatggaaagggaagctgaagagaaatttaggaacttgctcagagatccttttcacttaaacagaggagttgggattcagatctgggtagtccttggctccaaggcccaagacctcaactgctgagttgagatttttatttatttatttatttttatttatttatttatttttgagatggaatctcactctgttgctcaggctggagtgcggtggcacgatcttggctcactgcaacctccgcctcctggttcaagtgattctcctgcctcagcctcccaagtagctgggattacaggtgtgcaccaccacacccagctaattttttatatttttggtagagacggggtttcaccatgttggccaggctagtctcgaaatcccgaccccaggtgatctgcttggcctcccaaagtgctgggattacaggcatgagccactgtgcccagcccaagctgagatcttgatactccctctggagtgtccttggtcatgcaaggcaaggcctggggtcccttcattgctacctccttgcctccctttgaccctcaccttgtgtattccccctttctctccccggctccatcttgcctcgaaagacgagtagagaagatgttccctccactgctaggactccagcttctaagaatgtgggtccctgtttttatccaggggtgcatctggcagattgccgttccttgttatgccctctgagagcccggtaggcaaagcggtttcctatgtgcctccttcatcttgctgtgtcatgctcgctcctgtcagcctctcccctggatccaggccctgggcccatgtgggcccttctgggtccctcatgtctaaaatacctggctcgagcagctgcccagatatttgttgagggaaggaatgagggaatggacagacgcctctggagacctgcagtggcttgagaaaacaaggacaagggttccagacagaagaggaaggaacggttggagcagcccaggagtcagggtgggcgtcactattgataaacgcacagacggtgactgcacagagtctcgtcactgtgggtgggtcttcaccaagtccctgttgataagctgctgttacgtgaatcagcacgtggaggggaccatccgtccttccatccctggagtaggatgatctgtcttctcttaccctccttccaagcaattacttctcatctgtaaattagtgctgctgaagttttactttgagtatgcaagttctgttgaaatcatttattggcaaatattccataagccacagatgttagtgcaaatgggatggagagaaaaggcaatgtagtgcctccccgatagagtagaaactgtggccagcaagggtgcagagatgggctgggacctggtcccctgacttcttagcatacagcttgccggagaaatcccaaatgccatttttaaagagccatatgaaaattgcacaaagtctatttttagtttacaagccaagatatgctttgcaaccgggaaaggatgtccctcagttgtattttggtgaagtcatgacagctgcctcatcagtagcttcttcatttttaattaccagcgtggggttgagtcacagaagcagaatgacagtgcatgtttctctgtgcctggttttaattggtgtgattgagttggggcattgatgcagctggatgaaagctttctgtatcttcatgcactgggagctgccgacctcagcagggcaagctgtcacaaggccagcagcataggagcttggtcactgtgccacctggtcagcaggcctttgaagccatcatttgggataggctccaggataaaaggaagctgagcttgcatggtgtttggctgacactctcaccacccatgactgtcagtcccggtcaggtgactctggccgtccctgagatgattgccacctccttcctgtgtccttgttccctttaagggaaaccacacaatagagaggggccaaggatgggaagcgctttccggagctaagagctgttaataataacagctgggcagcactgccgtgcttggctgtgccttggggtcggctatgccttctccctctcaggcctccagatgctgctggtacactggagccatagtcccagcatcctgagtgacacaagagaggtgggaaaggtggggacagaatgcagaggagagttttttgtttgtttgtttgtttgctgtggtcaaatacacataatagaaaatatatcatcttacctgtttgtaagtgtatagtttggggcatttagtattttcacgttgttatgcaaccatcaccactgtccatctccagaacttttttattttctcagactgaaactctgtacccttttatttatttatttattcattcattcattcattcattcattcattcattttttgagatggagtctcactctgttgcccaggctggactgcagtggtgtgatcttggctcactgcaacctccgcctcctgggttcaagcgattctcctgcctcagcctcccaaatagctgggattacaggtgcacgccaccatacccggctaatttttgtatttttggtagaggcggggtttcacgctgttggccaggctggtctctaactcctgacctcatgtgatctgtccacctgcctcggcctcccaaagtgctggaattacaggcagaagccactgtgcctggcctgaaactctgtaccctttacacaccaactccccactcctccctcccccacagcccctggcaaccacattctgtctctatgaatttggccattccaggtaccgcatacagggagaatcgttcagtattcgtccttagtgcctggctcatttcactgagcacagcgtcctccaggctcatctgtgttgtagcatgcatcagagtttcctccctttttcaggctgagccatattccatcgtgtgtccctgccaggttttgtcgatccactcaaccagccacagacacctgggttgctcccaccccttggcttttgtggaaaatgctgctgtgaacacgggtatgcagatatttgttcagaaccccgttttcacatcttcgggtacaggaggtatatatttttaagtgaaaatttgaagattaatttttctagaattccttttgatttcccttgggataacttgctctcaagtgatggtgttttaggtattaaaatgtgaatttccaacatgtctttcataaagacaaaatcttatttttaaaaaccttgtagcctcctccaacatgacctcccttggccaagtagccatgagctgcagcccagcactgacccttctttctggggagtccaggagggggcctggcaggagccagacgggctccccctgactgccttgggtgctcagtgtagtttgttctctgatccatgatgtaagcagcgtgcccaggtgtgctgtgcacagcctttggtgctcaaggtcacagacacagtccactcttcacgagcagagctgccctatgctgagagtagacctggactcgtaccggagcctctctcccctggcaaattctctagatgagactttcttgaggataaggcaccccctacttctcgcatactcagaaagaaaaaagtaaacagtgggcctcctcaagttgggaaagtctcaaccaaatgtctcgatccccactttccaggcgacaggctgcctgtagcctgcaggcatgtgttaggcaggctacacagtggtggtaacatgtacaatgagttgccattattaaaaactcgggagagcgcatgtcggatccaaatgctggcttctctggaagagttcaggagatctcgcagttctgggttcctggagcctccgcaggctcacctcctccctgacatggggtcccaggctgggccctgtgggcatcgggggtacctcacccaactagagaggccaaacatggcacagggaagttagcgagcagcagggagatgtggctcaaatccattcccactaacacatcagctgcacaggggcagcctgcggggagcaggggcgtgtgctctgcctgggggtgaggtatgggccctgggcacatggggcagggccaggcctcaagcagcctccctaccccagaggtcacctgcccttgaaatacacctcattttctgtctcttttacaaaataattcctggatcccacgggccctcctttgatgggaggaaggaatggggcagctctgagaagcagtctgtcgccgcttctcagcatggggttagagaaagagttttgtcttcagtttagaccatacattctttaagctttatttgggaaaggggctaaaaggtctggttaccttgttttattacaattaaaaatttcttttacaattttttgaaacaatcacaaacttacagaaaaattgaatgcacagggcaaagctcaactgacccagcgcagagaacctggtgaccccggccccgccagccccagtgctccagtgtgtcctttgcataaacaaggactgtgtctgcagagccgtgcagcacagccatggacaccggggaattccaccggtctttatcagttgtaagggcccctaatgtagtaacatgttccatctgtgctctgtgggtaaccaatctgccatgtcctgtgtcttcactttccctgagtgggcagcctggttatctgcctggactgacatctggagtagcctgttcccacccgtagccccacgggctcgattccacgttcccccatgtgagcgccctcctcaccttctgagttgcagcagtgccttgttctgggccaccccggatcttcccaccccacacacaccatgttcttccccatatgatgactttagactggaatttttcaggaaaaagaagagttttacagcttatcttaaaattaaaacaaaacaaaacaaaaatgaatactcaagaggcattggatttaggaatccggtaaaacaactaattccagacagccgtaaagaaacctgcaaccaggaaatgatttaaaatggagatcttcaaagtcaggattgtagttttttcaggtagctttttgtagaccttgaaaatataggccgagaccacatgtagaaattaaacgttctcatccgaagccggaccatttggtttggcgacttaagggaagagaaaaatgaagtttgctaagtaagaattaatgatttctcaggaatttttaggatgttgaacagcttaattgcatagtttgggtggatatgtgttgaagaaagtaattttaggagactgggaaattgtgcaatcatcttaacttgggtcaggattgtaattattgcaataacagaatgttgctatgtgtatatgtgactgaaatgggaagcagtttttaaaaaatgctttaagaaataacaacaaaatgtccattctctctctctctttctggacttccttaattataaataccaggtaatccagtgctggctaaatataggtccagtggtcatctatatttataacgtttttttcaggcggaagtcactagagcaatacagaattaatttggtgtgtaggtttttatagagtctaattagttgtgtttttcttaagcaaaccaaccgggatcaataacattatataactgaactcggacgaccatgacttttagacatagactcttcccagaaagccaaggccctcggcagatgccggccctgaagacagacaagcggctccggaagcaggcacgctgcagctgcggagcggacggggtttggaacatctgtttccagccaagggcaggctttgggagtgataaagtacagtttttttttgcaaagtcagaagcctcatctgcagtccattcatcactgaggccttgaattgagacattctgtggctgcttatcagctgttcccgtgtggaagggtttggctgggctggcctggggaggtggggtggggattttgcagacttaccaaagtatgcgcttagccgacccacccccaccaacaacgcagcctgctcgagggctacgaactgcacctgtgtctgcagtcacgtccattggagagctgagtgggcgggtggacctttggaactatttgatgtcatttggggtagattcggcgtgcttctcggtgactttgctgcaaattaaacatgtaaagtagattgggctttcctcctccattcctcaggatcttcaaaaaacatttagtcttttctggcagagtgaacccgagctggcagcgcccactgagattttgtttgaagccagctacattcacatttaaagaaacgacatgatgggggaggccctttctgtaaaccccaagccaggcctttcccctcgtgagggttcctacccctcccttgtgtggccctgcaagccgcttctgcttgtccacacctgcgcccgagagttcttctcatggctggtgcgtgccatgaatgaagggcactggccagtggaagggagtgcccggccaggccttgcctgcctcaagtcctcagaccagagaggccagtgggggtcttgcccagaccatacagccgggaggtggtctgcctggctccatagcctcctcccgacctcacagctgtcctgggacggggactgagagagagctcaaagacaggacagcagagcccgggccagaaggcactgggggcatgctcaccccacctctggatgcggggcctcactggacagctggacacagatgggatggggggagacctgtgtatcctcccaatgtcatttggagacagaagtctgttcatttcatcaggcagatttcaagctcctctgtgttccagacacagccaggccctgagaattgacagacaacatagctcctgcccttgaaggcttatggtggagggagggaggacaaagggtgtcatagccatgtctgggcatacagggcctgggaggcctgagagggcttcctggagtcagtgacagccgaggggatggttaaaagcagagtaggagttgaggggacttgagcgagcacaggggtgtgaaacggtgtgtgagggcagggccccttacactggatgacagagggcagtgtgggcagggccaggcctgtggctggagaggggtcctggctggtcgtgtattctccgagacaaggaggagtcagggtgggagtgtcagtgcggtggtacgggagagactaagaggccagcgagggtccaagcagaggggtggggctgcctgcactagggctggtgcgatgaggggagcgggtttgggagccattaagagccccctttgggaaggtttggtggtggcttttaccaagacaaggaacgcctcaggaggagaggtttggggtgcaggatggcgagggtgcagtgttgttgatgctgctctggcgtggtggaagttatgtgctgacctaggggtcctgccaggagccagtggataaagatggtgcagatccggcccagcccctggaggactcagccattatggggccacgtgcttgggacccccttaggcgggagaggctccccagaggagatgatgctgagctgagcctggaaggacccaggattggttggcaggaaatgaagaaacagccttctgggcctgtcttctcggtatctcatgcagttcctggatacagctcagcttctcccgcagaggatttcagaacccacctccccagtggctgttcagacctctggaaccagaacgtccatctggggccaagcccccacccacatggggttgctcaagctactcaggtgaagctgacatgtacgaaggtggcgagccatagatctggagttctgagttagggcaacccagcagtggccccaggaggctcactcggatgtgagaactgtgggaaaaccaaggacctacctggtatgtttcagagtcatttgtttatgaaccttacataaacacacacacctggatatgtatatacacgtgtatatgcacagatacacacacacgcctgaatacatatgcagttggctgtctttatccacgggttccacatctacacattcaaccaacctcaggtcaaaaacatgaaaaaaaaatgtatggtggatgtagaaactattttcttgtcatttttccttaaacaatatggtataacaactatttccacagcatttacattgtattaggtattataagtagtctaaagatgatttaaagtattggaggatgtgtgtaggttgtatgcaaatatgatgccattttatatcagggacttgagcatctgtggattttggcatctgcagggtggcctggaaccagccccccacggatgccaaggcatgactgtatacatatatatacatctgtatacaaacacttgcacatccatatacatatgcacacacacacaccggcatacgtatatacacgtgtatacaacactcacacattctatacatccacacatatgcacacacactcgtatacagacataatggaataatatgtacctgaaacataatataggcctcccatgatttccttattgaaatgaaggaaagtgcacacatgctgagggtactggttctctgggaaagaacctgccgcaaaggacaaggaccaaggtgcctgaaattccccatggtaactaacaatcttaaccatgccgagaggcagaaggttcaacggtgaagaatcctgactgttcattgactaaatgaatcttgaacagtttcactgctctgtgcctcagtttccccatcagtcagatgaggatggtcataacatctactccctacagttgttatgaaaatgaagcttattaattcatctgaactccaagcttgctgcctggaatggggcatgtgcccagcaagcgtcagctgttgtaatgagccaggggcactcggtaatagtgaggatccctggctgggggacaggtgaaggagggggaattgctgttccccactaactctgtacccttttgtaccttccatgttttgtatcatgtgcacatattacctatatttttttaaatgtcagagcatcttgttaaagaggattacactacattaaactctcttcactgtgagttctttgatctcattccttccagtgttctggtcaagaacatttagcaaggtttgtaatgatgttctaatgatgttatcagtttgatcaagtaatgcatataatcgcctatcaacgttgagtaaagaaacatgagcaccctgtattcagcaaattgtttattttcttgaatggtgcatgagacgggctctaattaattcattgtgaagataccacgggcaccaaagagaacaagaacgtatttaaatttcatgttatgacattacaaagacaatgccttgtggactagcagtcagattcattgatgaagagcagatggaggtcaggggaggacacggggctgagcaggactgggacgcagcctgggatggtggaggcagcgcctcccttctataatcgagggaaggaggaggaggctgccagggccctccgatagcggcagtccgtggaagccaccgctcctgattctaaaggcgggctgctcaggcaccggctggagaagcggtgcgtagtcgatgagctgtgagcacgggagcagagccagcgcctggtgtggacaccgtccgaggccacagccaagcagcagccacccaggacgtccaggctgctgagcagggaggaacacctgccatcagggcaaatgccacataaaaaaagaacctcactttacctggaagattatttggaattttgtctttaggccgcccccttcctgagtccaccgctgtccatttgaccctgaagaggtcctaaaagtgtggcagtcatcttaaaccctactcgtgtatctgtatgtcatttagtatcaaattttgtcacctgcttgtctgtgagcagaatggggaggctgctggtttaggaactgggagccccacagtgtgacatagtcttaacctccctgggcctcagtatactcatctgtgaaatggggacatctctgtgggtccttgtcacaccctaatctgtgagtcagggccagagggcagccaggtgtccttcatgttcaaccaggccagtggccacatccccacaggtgaccctgcgtgagcctgggggcctcacagcctggcatcctgtcccccttccccatgaaggcacccagagatgtgaaggaacagcctccctcactggggaggggcagaacctcctcgtacctggggtggaccctgctgtggtaggtcagatgagaagcctagaagggcttaggtgggtggggaggacgagagacagcaatggctgtatcataaacgcagcatcatccgggccgacgagactttcaatgggcctgtgttcctgggcagctgctcctgcctcctgctgtgtcacctttgattctctcactggttttgcccgtgatgaaaacctcacactcctgacctggtgcctgatgttgcaaagggagggcagagggcaggaccacatgagtcagacagaaggacggggcctcttggagcatctgacaaggtttatggaaaaagcacgtctcagagactcaatgagatgctgaaggtctaggcttgcagccgcacctgtgtttgagtcactccgtgtatggaccgccacttcccagccctagagaacccttgcttgacatcagagactttggtgaactcccctgatactctcagcagcaaatgctgtacatcacaggctggcagccttttctgtttcagagttcacatatgaactctttgatcctcgtgggctctagggtctctgttgcaaccactcagctctgctattgtagtaggaaggcagccatgaacagtagggaaagggtgggtgtggctatgttccaagaaaatttatcaaaaaacggtaggtggatatatacccaaaagaattgaaagcagggacacgagcagatatttgtacacagcagcattattcccagcagccaagcagtgggagtaatccacgtgtccataaatagatgaatgaataaacaaaatgtgagatgtgcagataacggaagattagtcagccttaaaaaggaaggaaattctgacacatggtccaacactgatgaaacatgagcacattatgctgaatgacataagccagtcacagaggacgaatgtgtgattccagcttcttctgcagctggctttgcaagggcagccttggctggtgtccccttctcccctgcagtgggagcgtccctccccggccccccagctctcatgctaggccggacataagtgtccaaacagatggagttctggccgctgctgcctccagaggtggttggcctggtcagcattctggggactgtctgtgcctttcctggatcgttcgtggagaacagttgacatcagcccagacccaggggcctttgcaaaggacagtcatggcggccccggggcagggggctggatggctttgggactggcctttgaggggaaaggtggcttccccaagcctggcttagctggtcaaaggccaggtgctgccctgaatggcttccaggcccccctgtcatgagcctgctaagggtcagcactgctgcaattagtctctttgccagcaagttttattcaactcttcgttcctccatgtccctgactgggaattgactcgaatgcccagagttaaaagaccaaaagttacgtaacgtctcccagggatgatggcagcttatgagcaaacatgttgattaaacactgcggcaagttgagactcggtgattgcctccgtagctaaataacagctctagtgcgggtgaggaggagccttttgacacgtgtggcagttaactttgttgaagaagtgagcaaggtgacttatctgtaggaagaaaaataaaagtgcttgtgagcaaaatagggcagaaataatgaggtttatgatggcagaaaaatgtgagaatcagaattgcggaaaaccgtgtatcgagcacttactacctgcctgctgggtctctgctagctctttcacacgtaaatatcgcgttcaaatttcggagcaacccttcagggtggtggttattagtctcataaggaaactgagagagggtaagcccaggtcacccagagggaagggtcacattagatgcagacctggatttggccaaaagctaaagcatcccagacccagagaagggagtggaggagcccgagagagaatcccagctcccaggaccaccagcatttgctgaatgcccactaggttctagacactcagctaggctctatataggtgattcccattgattcctcatgactgtcttcgtatttgatgttctgtggttgtaagcaacagaaacacactggagcaagctgaagtagaaaagggaactctttatttcgaggacaaagtggtgtctcctaaacccacgaacaggagacagcaaggctgccagggttgccggaaaggagaactgaagggaagcaaaggggctgggaggctctctcttgcactcctgccttatcttcttgtgtaaagatatgaaaatggccacagcatccaagtccctccaggtctccacctgggccagtcaactctattgaggtcagactatagcagactaaatggctatgaatgaggtggaggcagccaaggagttgtgagtcgggtaggctttagtcctacttaacttttaaaggtaagtacctttatccccattttacacataaggaattgagattcccatgagtcaaatgtccttgtccaaggtcacatggctaatcttggtggaggggtaggaagggtttggaccaaatcgatctgactcaaaacccatgtttgtaatcatcatatagaactgctgtagaggaccattagtcttaaatttaccctttaatcaagctagaaaagaaaccaggatggtttagcctgagaagatcaacctgagggtctgtatgatatccagtccatcttgattttaaaatcctttttggaggatggtgatcaactagcccttctctacagccaagaagcaggcctccgataacaatgtccccatgctcgagcccggacagacgtgaggacaagctggtgctacagcgagggccagcccttcttgaaggccaggggctggggcacagggctgctgttggttccatccggtcctcaagctgaaatctgtcctgacaaactgcccctggcagaaaattgggacacctcggaggtttagatgttctcatctgaccctttcacaatccccaagcagatggatccatgtgttttctttggctgtcctgttgcactggagagtgagtgttcattcttcgatatttcagtttacccatggggtggagaggatggggtttgtttataaatgaatgttttggtgtagacctgacttgacaccaacttagctacttcagggattcttggccctaaacgaacattcatttctgtctaaaaaacttggccatgatagtccaaactttaaatgatgttaatttaccgtgagatgtgatggagtatgtggtccatgggaaatatgacttagtgttatttatctaaaaatgagtgtctgaatccaccttcacgtttataaacactgcacacatgccagagatatgaggagcagggtgatggagggtgtgtttcctctgggagaatgagcccctcagataagggggagattcttgtggggtggaagattttggaagctgttcgtgagactattaattgatggcattctgcttcttgtcttgcagattggaaacctggaagattactaccatttttatcacagcaaaacctttaaaagatcaaccttgagtagcagaggccctcacaccttcctcagaatggacccccaggtacagagtgtccggatgctttcctaagggctggagggtttgggtctgtggtcttaaaaatggcggagtctggattttaatgtgattctggatagacatgagttttccatattcactttaaatacagcaagacaggtgtagctacgaatcagaccatctgaactaaatcatgtgagtgaggatctctcagcattttaaaatcaacaaaacacaatactcacaggagatacatatatgaatcttacccatgaaacaaaaactctaagcaattcaagcaagtattttaataatgaaattagagatcaggcaggtggatgtttttgtggttgtcataacatgtatgttaatggttactatgaatttgaaaactgaggcagtaactatgactttttttcctcaaagattcacatgatcttcaggattaaaacaaatgcgatttgaaaggaggctaacattttaaattttaacataacccgtatttattgggtggttaattatacttcctttctgcatagatttgaaattaatatttgagaaagatcaatcaacagttatgtgtcaagattaaaaatttaagatggccaagtgagcctccagtgagttcattcatttggcaggtatttttggaataccttccatgtggctggctctgtccatagcagggcccgtggagctggcggcagggctgacagaaaacgaagcaggaaatagaaaaatatgtgatatgtcacagggcgatgagtgctgagaaggaaaatgaagttcacgtgagaagcagtagcagccccagcaaggaacggaggtcattggtaaatcatagttttaggtcacagaaatcatcttctcttaaaagttaacgtatatactagatgtttgtttgggccccctggctggtgcacaatattatttcagctatttccagaaaatacttagagtaaagtttttatggaaaaatgggttcttggtgttgccccaacccacctgcttcaatgacaatcagggctctttttgtattgactgagcagggatctgttggagagacgcgttatctctgggctctgtacctgaattatccttctctggggcatcgcatggtgagggttttgatttgaagcatatgaggaagtggtccccatggagctcacccatggacctgggctgtgaaaagacagacttgtcttgaatatatttctggattggttttataggtgggtggatggatggatgaatggatggatagatagatacggataagtcgaacgagatagatatgaaacattgtgctaattccattattccttcatagcaagggaaggagttaagtgtttactaagggatggctgtgcttgggcactttacatgcaccgtctcaccccatcacatgggggtgagattacgtctacttgtgcttacaccatggaacatgaaggaatgtttttcaaaggggccagtatatttaatcctctaggaaaaaagccagattgtagttgctccttcccaaagagtggggcacttggggaagggtggatcagtagaaaactgagcagcagggagcctctgtacagggtgcataggctgatcccggaggaggcgtgagttctgtgcggttgagagaccgtcatctgtcatcttggaggaaattctaagctaggaaagaggtcgacgcagcatccctccacactttcactttaagcaagcacttgatctgccgtgtgaagaaacatcctcattcttcaactgaagtcttttgagttgttgaattgccaccacgcggatagttacaatgaaagcaagctgtttgcatgcaggaagcccatctcataagcatgctctgagaagagacggggaccgtggatttcttggtcttctttccatgaggccttccaagaattaataaagcagattcttaatggttagaactaaggcagagtcgaaataggagacttaatctgtgttttgactacatcctctgttgttggtgactatattttaaaacttttaaaggtactcaggtcgactgctcatcccttccttccaaaaatattaatggtgcacctgctgagtgcaggaccctgtgcctgagtaatgcagagctgcccagcaggtctctgtgttgctgagttctcggtgaagatggggatgggagacctgtgcatgagcaaggcaggctgaggcagcagagacagactctgtggggggcttgagggccaccataccctggacctgcctcctctctgcagcacctgagctgcttgattgacccattttaggtgtgttaaaagtcctatattcagtttgggtctgagggcaaagcattcccaggcattagttgtctcctcgaagtcagcagaaggaaggatagagacttcctaggcaaaggctaacgtagcagttaaattttttcaaataaaaatctccttctcacagagcttcttaataagctcctggcaaggcttctatcaatgcatcctgccagtaaagaagaaaggaagaaaggtaaacagcctgggcatcccaggccttcctggaacgttcctaggattggctgattgtttctcatagttctaattaaattgttagccccagggaaagcacacagacatctgaaccgattatgaattcagaatcgcaactgaaatacctctgtttaaatttgtctagctttaatgcaaaccaaatcaattagctgtcagtctgactaatatttactccacccagtcattacaattaaacacttggtgaaattagctgttttatggaagtatttagtgttatcttttattgcagtgcatcagaacgtttccctacgttggcaaagcatttttatgataccttcacatctggagagttgtgtaattaatattattaacaaaaggaaaagatgatttaatattattcagagacttcggaatgcgaggctgccattgtgttcaaatgaccaaactggaaatgaatgttatggggcttaggataaagttccatcaaatgcagacggtatcttattttaattagttccagtccctattgtataggagtgctttgataagtgatggaatgtacagtccaccccatgtcacataaaagcagatagaatgtacatttgggaaagcaaaacaaaactcaagggggtgtcagcagcaggactctgttaagcacgtgtgtgcacgcacacttattaggcatcttcttcgcactgatcctgtaccggaatggtacagtcattttccttgcattcttaattacctttacttgatgtttttcttaccgtctttgaaaagggccattttgctcagattgctttgttactcagccctgtccttggaggaacagcccaagtgttcgcagtgtgcagttatcggtcgctgggtttttccaaggcttgtcatttaagcaaactgaaagcatttgtttttaacttgttcttttgccaaaagtctggagaagggtggatattacagaagcgtcgaccaatcactgaaagggctcacaaatttttttaaaattacttgttctgattatgttccaagctggcttatagttagtcgttgctgcctgtgtcttccagaccttacattttagcatgatgacttgggttcagctcttttccttccctacagatctcagccagattggtgatggaaatggaaggataaagatgttcagagggagccttggtggctccttctagggccgtaggaggcttgggttcaatgcttcatttcagtgctttaaagcttagaagttgcaaaatgattgcaaggaccagaggaggcattctgttttgtaggatgggactttgcccccggagtttaatcaaagctcgggtttccttccagcagtgatgcaatgttgaagcagatctttccattaaccacagatggaattttatctaacagttttgtgtgctagagcaattcaaagtgcaaacaaacagaaagttcctgacaagagcacatagacagtaagtgaccacattggtctcaggggttgatgaactgtgtcatgggctgagggcagggccaggcagctgcccagggcccagaggatttgcccacgtggggacggtggactgctcccccatgagggtgatcgaatgacagtgacaagttggctgttcacattttcagcaccacccagctggttctagtggcatggctgctaggaattggtaaaaagtttgaatgtgtaaatttaccttaaaagacagcattttattctttcacgacatgctctgcccttccgcttagatatctcaaagacaatccaaagtcagtatgtcccaaacccagctcactgtctctgaccctagtctgtctcagagggaagcgctcatccgcattccactgcagtgccagcggcctctccttcccccctacacttgttccacctcccgtacaacctggccctgccatgtcctgtgtctcctgccctaggcccagctcctgtcatctcttgcctgcaccactgcactgccctccttgctggcctcatgtgggcatccttgccccggccagtcacctcccatgctcctgagggatcctctgaaatacggccaccactggcctttaagatcctcctcgggtgactttcgctctttttccctctgcagagcttttgcacagacggctccccaccttcccctgctgttgctctcttccccaccttcccctctgggctccaatatccctgccaccaggaagcctgctcagaggctgcggacttggcctgctcttctagcagtcgtatgtttgtattctagatctggccctagagtaggagcacacagcagtgtttgttgggaacgatgactagttcagtttgtttgggatctgtcagggacagacagagtcggcaggggagctgcaggtggttcctgggggacctggatcgtcaggcttgggagggcgttcagtgttccagaaccagaggagaggcgatgggaaggcggactgacgctgctgtgcggatgcctcgggagagaggaacttggagttcaaagcatgcaagcccatctcttgccaatgcaacaggaggttatcgagggtcaaggccacatatcatttgcttttactcccttacaagtccagcagcaacccagagaacagtagacaatgcttcctgaagcatatctcaagttccagagatgtgactcctataagcaagttgtgtgtaacataagcaacttctttctatgtaaatactttagaagtaaattctgacccaccttggctaaattatggaaaaatcctaaatatagttttcagttgacaaagctgtatcctgtattgctgaagctaaaataacagaggtacagacagtgactgcatgtcagacacgttgagcagtgttggacctcatagtttgttagtctgcgggggcagttgtaacaaagtcccacaggatgcggggacttcaaccgcagaaccgtattgtctcacacttaggaaggttggaagactgagattacggcgttggcagggttggtttcttctgaggtctcttgatcctcacgtggttgtccctctctgcgagtggctctgtcctaatctcctcttctcatgggacactggccagattggattagggtcccccgcatcatgacctcatattaacgtaactacctctttaaggcccttatctcccattacagtcacgttctgagctaccccgggttaagatttcaacataagaatttaggggttcacaggtcagcccctaacaataggtgaagctgggctccagctgcctcttctgttgtcagtgagtggaggtgggtggcgggcggtggggagaggggcaccttctgtcccctttcagcaaaataagaactaacttacaaatgagtagctttactttcccaaagagctttcacacgcactgtcccatttccgtcatcggcagagcgaggacttccctctctcatgactgttaagcaggggtcttctggcacctgtagtttaacttcaatggaaagaattcaagaaatggtctctacgctgttgcagttatggctgcaggggaggcagtggggagggagctgggctcgcagctgcctggatgacacgggaggtggtggtgggggtggctttctaggctgagttagaatgtcctttattttctggttcctcctccccctcctctactgcccgggcttactcactgggttcccgctgtgtgtttgccatggcagcctggggtttcccggccccacccctaggtgagccagtgctgcgccggaggtgggcctgggcatctcgccatgatgggctctcacgaaaccatgtaatcgtctctcacttgtcacgatggccctcttgccctgctggaagatgacagccacaggaccaatccctcactcggagaacttggatctgctttctgcctctgtctagcttggttcagtggttcttagccatttgggggaatcacaggcccctttgaaaagctgttggaagttgtggggcctctcgctctccagaggaaaaaagacatcatgctcatgccggcaccattttgcatacagttctggggtttctgggactcgagcctgtccttccactccttgagggactgtgggatccagggcaagatggctccagtgtgctgcatgaatcgtcgcctgtcagtgagagaagggccacgttgcacattatgcagtgacgggcacttgtcggggagtgggatttttctttctttaaattcaccagtcagctttctcactgagctctttagctggttggatgttggcccagcgaggtgctcagagcagtcaaggttgatgggaatcaagatctaagcgccacagactgttgagtgcacaagctctgagagagggaccggtcccagcccctgctttacagtgtggagggagaggcccaggcagggtgcccacctcccacacagagagaataacaggcttattttctacggtgccctgattgttctctcctggaggaggctttggagcttggtggctcctgggtgccgaggtatggcctccgactccctcccttgatatgccctggtggacagtcaggtctggcttgcagtccccttgttctttcacagttacagaataaagtaaccttcgctttgatgaaaccagggagaaaagagaaaagaaagagctggccgagctgtctcccttgcgttggctacaactgtgcagaacctgtgtgaacctggtgtccgcagccctgccggtgcgtacttcaaagaacctcagcagcttgactcccttgatgctgtgtgggacccctggaccgctgggggagggtgcctgtgtatgcccttcgtggccttccctccatctcagagcaaagactgaagcccctctccttttaggactctccagctcccaagaacttctaggggccttcctgagccacagcagggcccctctgaataggcacaggcttgaagttagggcagaaggacatggtggctttgggtggacgtgcaagtgggagggatttcatgctctctttggtgacactggctcatgagtgaaagtttcaaaacaccctcccctgtcgcttgtcacacctgggaatgatatgtcagcaagcttctggcccacctgtggcccacagggaagaagacagggccaaggctgcccatggctgctcgctgaaaggatgcttggacaaggatcacaactcggtggcatggacagcctgcagcatggcaagccatttactggaacgcgggcagggccccctcctgggtctctgcttgtttatgttaccctttaggaacatccttagattttacctcgtcttatcaacagagggacagtcaacggatgcctcattttaacttggcttctcgagaaggaagctggaggaagcacacactacaaaagaaagtgttgctgcgcacctgtcttgagaagacgatgaagccttcttcatgattagaactccctgccccagagcgtagcttatctataactgtgctgcatgtttagcaggaaacatacatttggaaaatagagaaaaggataaaaaggtcagagtgaagttctatcttcaaagtatgacgttaaagaaatcctggcactttctacagatttgcagagaaagacggtttctgtttgggctagaagtggcatttggcaaaccttgcctttgccccaaatcacttatagttgattttccacaagaaaagtcaacagatgtcatctagcagtcatttagacctaatcacattttctttctttctttctttctttctttttttttttgagacagagtctcactctgtcacccaggctggagtgcaatggtgcaatctctgctcactgcaacctgtgagggttgcttccattcgatgggagggctggagttttagtcgcttggtttggggctggtgacacacctctgacctccacagagtgtccaggtggctcctggtttcaccccgagggggcattgaaggcagagctttgcatcccagctggggatgggagggggaggcactttggtcctggccgggaaccaggtatgttcatgctgatcttcccagaacctagcgccagacacacaggaagactcagtgcatttttgttgagtgagccacagaataagtgaccccaggatgcctgctctctggagacactggggaaggtgaacctggaaaatggctttctctttgtggtgggtaggaggtgggatccgggatccccttgtgctgtcctggagctgggtgagaagcaagggagtgactggaacccagaggaagggacacagtgccgggagaatcagcctctgccaccgcgctgtctgcctgcatcccgtctccacggagaagcccccacgcctggtcagtcatctgttgtacagtgttcggttccattggcctgagagcacctcacttgccgtcagagacttacaatgagcaggtgtgttagcagagagagggctgcccctgcgaccacgacagagagagagccccaaactgtgctgcgggccgcaggctatcacagtccccctcagaactgtgtgccagtgttgtggggttttgcccagagcccagcaaggaccaagggccgggatgcccaggctcttccatcctgctgaggaaccctcttatgacttctggctctacgctttcccacatctcccagctgattagtggggtgtcacccacttgggcttggaagggcagagtgtgcctcctcctctgactggaagtgtggtctggtgggcacagcaattggaaggggctggatgttgttagaacagagagttcagggccccttagcacaaacagggctcagcctggcaggagggcgggacatccctgggagctttgggctgtgcgggatctacataccactgtattttgtaatagcgtgctgaacagattatgaaatattgtttgcggcatcttagaccaggtaaaaagccttctagttcaggcagtaatatatggggacattgcaaaatgccatcagccggtgttaggaacaaaatatctcattttatagttttattttctgtggaagtatctgtcagcggccattataaattatctaggacttggtgctgaggattttttaagtgtgtgacgtgaaactggttttgagccctttgcagtgtttctaaggcgtctggtctgctggtgttttatagacgaattacatcggggtgggacaggctgggatgcctctcttccggcattttgccctgtacaccaaggatgtcttggaggccatccccagccctaaatttgagctgtgtatgcaggtgctccgctctccttgctcagggtgatgtggggaggccaaggctcagggaggaggaagagaaatcttgtccctttgctcttggggactgttactccctgcccactcagcctcaggtagctctgttctagcttccagcacgaccctgggtcgccagccttgggtcaccttggggccccgcccccttctcttgttcctcccctgcctctagctgcctcctccaggcagcctgccctgtttggaactcacatcatcctctgattggtgggatcccctgaatgtagtgcagactcctcgagagcacggccctggcgcccatccttatcccacccatgtcaggccccagagccaggctgaaccccagctttgagcattattcaatcaggtggagctgccgtggtaagaccaaagaaaacattcccactcagggtccaagaagtctttaccccaagatccttttaaaatgaaaaagtttttccagcttgaaaagaatgtgtacacgggatgataagagcaggagtgctccaggcactggtctgagggctttatatgtgttgtttcttatattaaccctgtggcaacccatgactgtccccactgtgtgggtggacaccaccctgaggccatggatgtccactgtcagctccaagtcacacagctggtgagcacggggctgggttttattgcaggtggcctggtgccttgatccttggtcttaaatatcagtgatacagccttgtgaacttttttccttgatcgtgaaaacaaatcatgctgattgaaagacatttatgacatcctgaaagtaattgtaaaattttaaattagcaataatgtcaccacccaggaactgatgctactactattttgctgtattcctttctagatttttctctgtgcatgttttggtaccatattgctggtggctgccaaatattccaatatatggcttaccatatttacttatgtccttactgtaaagcaaattccaataccagttaaccaaacactttcttcattcactgctttcccatgtgtgtatttcctttttcttcaggacaaggatcaccagataatttatcggcaatttcacaaggctggcttccttccttctctccctctctccctcccttccttcttgtctttctgtctctctctctctctgtctttttttttttttgacagggtcttgctgtgttgcccagactggagtgcagtggcaccaatcatggctcactgcagccttgacttcccaggctcaagcaatcctttcacctcagtctcctgaggagctgggactacaggcatgcgccatcatgcccagctagatttttttttttttttttttggagaggtggggtttcaccatgttgcccaggctggtctcaaactcctgggctcaggcgatcttcctgcctcggcctcccaacgtgctgggatgacaggcgtgagcactttctttcttttagtacaacgacttcaaaatctatcagagtggtgttatttcttcctctgtatacacaaacaacttctcatctttcaaatgtagtcactttgaagtgaaaatgtccccaggaacttaccatctaaaatatctgctatgacacagatattcacgcacaaggaaggctgtagcacctgcaaagaggctacataaaatcaagaaatcatttctaatataaacagtaattgcatttcttctggtaggtgaaatggctccagcaacaggaagtgaaacgaagggtgaagagacaggtgcgaagtgacccgcaggccctttacttcaacgaccccatttggtccaacatgtggtacctggtgagtaggacaggacctctgtctgccccaggacacttgcactgccaggtctctgaaatgggttaatttccctcaacaaagctaaattcaaacaacatctccagacagacacacttcaccttgagggtgtaaaaccactaccgcaaggctgtgcagtaccggctttcctgtggattttttctgaaactttgtgcagcacactctgggatgggggctctttgagaagggaagtgatttgatgcaggctgtatgactaaatggcaaagcccagcccatggacagagctcctgctgggaggcgatgccctgggaaaatatagattgcaggtgcagaaaaagcaagggagccgtctgcatgattctcgatccgagtgggaaagaggagctctgctatgtaaggcagggataggtgttccctccttttttacttgcaagcctaagcgcctccctgtggggtgtgcaccgagtgtcagttctgcatctggaatgtccatgtcggggggactttgtgtctttcgtgcttacagcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgtaagtcaatcctcggaactgacatgcaaatatattcaactgtgctggtcattaagtaaatgcaagtttaaaaacagtaaggtcccgatctcccccagcccccattaagttaggcagtaaagaaaactatgctggaaagaattaggaagatgaatattctgctacttgctactgtcaggggcaagggttttgcagagggattcatccacatgcttgcacagtcacatacacttttaggaatggagcctaaagaactaagaaatgcatggagggggatcatcagcgtacagatagtagcaacacgaacagtgacagggtgacagtgtgaaaacacgggctctaggcccagagtgcctgggttcctatcctgggtctgcaaatgattagctctgagatcttgagtaagttacttaacttctctgtgcctcatctgtaaacattttaccgtctgtaaaatggttcataagagaacgactctctcacggagttattgtaaggactaaattagttaaatgtaaggacacaagcttggcatatcgtaaatatcatagatgcaagaaatactctaagggacttgggcacctaccggtgattaagtaaaccatattgtatccatctgacagatcgttatgcagcccttagaaatgaattttgcagactacgtgtcaacaacactggaaaccttttatcatatattttaaaaggagaatgtaaaattatgtgaatactgctgttacagtcatataaacaaaagcatacctattgaaaatataaaatgaaggaaatcctgacccacgtggaaacgtggataaaccttggacgttatgcgaagtgaaataagccagtcacaaaaggacaaatactgcctgattccacttacacgagtgactcggagtagccaaactcttagacaaaaaggtggagtgggggttgccagggcctgggagaggggagtggggagttagtgttgagtgggtgtggggttttgcaggttgaaagggttctggagatgggtagcagcgatggcctcaagcactgtgaattaatgccactgagccgcacactcgagaatggttaaggtcgtgtatttcccgtcacatatattttaccacgataaaaacgtatatgagattatagctatagtaagagaggagccccgcgtgtggtttctctatttgccaacggaacataaaatccatttcaaacagagctgtcacatgccatttctcctcactcaccacgattccatttcttaggattcctacgccagctacgacgtgaacggcaatgattatgacccatctccacgatatgatgccagcaatgaaaataagtacgtcacctcgcctcatctccccggcttctcttcccctccctgcagcgtcactattgaatgtgtgtgcgagggagctggagaggcggtggctgccggcgtatcttccctgcctgggcgcgaggcaggcttctccaggagtcacaggccatgccaggcacagcccttcaggcacggccagcttctgtggagtcagcctgttcctctggggtgtcaccgctgccgggcagctagaaatgggtgtttgacagacatcgttcctgtttccaactttcttgaaatattttaaaagagaaacccttaagtctaaccgtctccatgacctgctgtgtgaagacagcagtttggtctgtttgagcacacaggtcacgtgcctgagcttttgtgactctgtgaccttaggaatgaggtggaaggggcatgagtaatgctggatagacccaggttcagatcgcagctctcccacttactggctgcgtgcatgccgggtgagctggttgaaacttcatgtcttagtgtcttagaggctcgtccaggccagtgatgtcccctacctcacagggtcacaggaggggtcagtgagatgatgcatgaggaatgcacccagcagattcttccgaaatggtgggcgtttttgtgtcactgtcattttgcaagtggaggcagtggggtccggagagcccaggtgactttgcagtgtaaacggcagccctggggtcagtcctgggaattcatttgctgtctctttccttctccatcagcatgccccataccctgagctcttatcattcctctaaaaatatttagagggaaataataaaagctttttcttcctccccactgttgacaagactcttgctgaggggcgtctcccgattatagtcttttagtttgtggtcgctttgattctgagattcacaaacgggtgcgcaggcaatgctgtgcaggaagcctcggccactggagttccacacagcaggctgcagagctcccgcgagcctgcagcagcccagcctcatgcacgtcccaaggtgcccttcctgctgccagtgaggatgcctggggcaaaggaggaatgacccacataccacgcagtgacccttgaagggcaggattcaatcccatcccgagccatccattgagctctgtgaccccgggaacagccctggccttgaagctgtgtggcttccagggaaggacagatgactctcttccagagggctgctgcctggggcgatttttaaaggcagctttaaatttgaatcaatgattcccatcctctgtggactcttctcaaagatgtgctatttcaagttgctcctattttggcccccgctggaggaactgacccgacgtggcacatcagagaatggggtcattactgaggaaaacgcatttgtttttctggtcatttcttcatagtctcccagctgctgagtgtttaatttagagcgttcttcctcagctccagcttaaatggccttagaagcacaggaagggctgcctcagggtaagcatggtgttgtaggtgcataggggatgaggcaggtgacatcagcaccagactgttccttctttcatcctgccaggcagcaggtgtccctgctgccagccacaggagacacgaggccgaggtggcgcagcacccaccctacacagcagtggccatgtgccaattacacgtgctgggaggaggaaggtataggaccacgggcactggggcaggcaccttcctcccacatgggggtcaggggaggcatgctggaagaggtgaccatgcgtgagcacttgccacattcaggatgccaggaagggctgtacccaggctgacttggtgccttctcccagagtggggttggtgatgagaggggatgcaggaaatgggctttaatgacatctctgggcttcggacaactgactctcttgttgcattgaactgagccaggcactgaattcactgaaacttgctgggctgcgtcctcacttggttttttcctttgtttcagacacggcactcgttgtgcgggagaagttgctgcttcagcaaacaattcctactgcatcgtgggcatagcgtacaatgccaaaataggaggtaaggccgggcgtggcagcctgcgagccgaggggcctggggcaggggcagctgggagctccctgtccgctggtctcagcagcctcctgttttttggctttggccatgtcagcagacccctgggccagacgcagcagtgccgtctgtatcatggcccaggcagctgacccacagggattggggcctcaagacagaggaactgcttactgttttgcctgaaaagccattgcagttcccatcagaaaggtaccctctctcctctggtcctgctggcctggctgctgactcctagaagtctgcgttgattccccgctgcccatagccctcagtggctccgtcacttcccagacagagtgacagcttttacccgggaccagagctttccctgggttctgactcccactcaagcctgctggcccacttctcctgcccctgctctgaccttagaggacatttttcatagtgccccttagacacatctggtcttcccgattgatgcctgggcttgaaccattcccatccccgcctcccccgtctttccacttggctctgtccacctgtgccttatggcagcctcatgcctgctctgttctgtgaagtgctccctggatccagctgtcccccgtctcattcaccagggaatcagctcttcttggtccctttacggagcagcagccgcccctgccccgcgtgcgtctggtcttgccatttagcttctcacactgctcagtcaagctgcccttgctaggatgaggctttggagtaaagtattgaatgtcttcctattccccacgggagcccggcagtgtgacagctcagtcacccaagtgctctgaaggcccctctaggtgcatgtcactgacccgggaactgagcaagtgggggcagcagagaggagtgccagagggcctccagggactgcggcctcacccaggaggcctgtctgcttctcagtccgaaggtgctcctgctcactcaggtggctgcagtgggaaaccaccttcccgggggggcactgccatcctgccactgagccttggtgagggtgcctgcagccgctttctgccgttctgccaccgagccttggtgagggtggctgcagccactttctgccgttctgccaccgagccttggtgagggtggctgcagccgctttggctccacttatgagcagtaccaggcagggaggttgggccacggttccctggatcaccagtccttgggggaatttcttgtgtttcgaaaagagggtccttagcttttacttaattaggactctgcctgccttttcccgtggaaatcttgaaggtggcttggattttcattttatagcagaattaacccccaagggcgcgttctgcagaacaaatcaggagactctgtcaactggcctggctcctttgtggatagttcttgcaaactgagatatataagttctccctggagcctttgatgatgggtgcagagccctgagacgtctctccaggatctgtagaatcgggccaacctgggtgccagttccattcccaccactcactgtctgtgtgtccttgaacaacttacataacctctctgagccaaggtttctttacctgtggggtgaaatgaccaccaggcagctgcctccccagttttgttatgaggatgaagtcagataccatgtgtgaaaccatcggcttgggctaagtctgcaggggatagctgagctcctccttccctcttgctgagactctcagtgggagaataaaaaccatttgtgttgctttgagtgaggggtggaccccacctttggagttgcttgagccttgctcccccaagtccctagactttgagcatggcatcctctgggagccgttagaaatgcagaatccccaccccaggcctacggagtcagggtttgcattataacaagatcgcaggggatttgtctccacgtcacaatgtgagaagcgctggtttagaggactccctggggtctcacaggtaggtaacacctgcatcatggattgcggggaggagtcagtggaagtaacatgcataaagatcctcccagatgaggtgcacagtaaatacagcattaccgttagatagctctacactcatcgccaaactctttccctacgtttcccgagtcctgcaagtgaaggtgctccctccagatctggaaaatgtagggatagaatttggcatgtgtttaaaacaagaataatagcaatgcactgtgggtttataacgtatgaagcaatatatatatatatgtatataaacaacagcaggaatggtaacagtcatggtgaatggaaacgctctatcttagatttatacattatacagaaaatagtatactattaattccagatagactgggataagttaggatatgcattatagtctcttgagtgacaactaacaataaagacatgaaaaggaagagctctatggtcagctccagggacatcccagggaaattccctgttgtgtgccagcacacacagagagggagctgtgttagagcacctcacccagaggtgggcttggagggagaaccaggaggaagcgggttggctgcctgtgtggagaggctaaagctgtttgcagcagctttggagccagtggctatcactggatccttgggtcaaggccagcctcaaccccacacctaccttccagagaggtgtgagctccacctcatgtcctcgatctttatgtggcctgctcaccccagccccacgccgcagacgtaattgtctcctcagcactctcacgggtagtcaagtcctgccgtgtcaagctcagccacaccctcatgccctgctctcatggggtgcctgctctgccacccctggggctcctacctgcccctttaacttcaataggtggttctgtgccatcttccttgttggttccctccaaagacatgctgagctcctagaggcccagaactgtgaccctcatctctttcgtctctctgtcagcggcatatccagtattatacatgcagcatgtgctcaaccatattcaatgcgttaattaaaaaatatccctgttatcatgcatatcccaacttatcccagtctatctggaattaatagtgtactttctatataatgtgtaaatctaagattgtttccattcaccatcactgtcattgtttgtgctgttgtttttatagattctacttcacatgttataaacccacagtgcatttcttgttttaaacatgtagttgaccgcaaactacttatgacaagaaatacatttacctgcctgtgtaccattccactgactggtcttccttactttttctagcttcagatttccatctttccatttatcttcagcctgtcgccaggctctttggtatttattgaggttatctctcacctcttttggtatttgttgaggttcaggtatgctagtgaaaaattctctccaattttatctgaaagtggcttctcttcatttttcttaaaagaaattatgctgaacacgaccttctaactttttttttgtctttcaacactttaaaggtgttattctgttgtcttctggtatccattgtttccgacgatgagtcgattgttaattgccatccttattgttgttcccttttaagaaacgtgatttgttcctatggctcctttttttttttttgaagagatggggtcttgctctgtcacccaggttggagtgcagtggcataatcatagctcactgcagccttaaactcctggcctcaagtgatcctcccacccgagcctcccaagtatctgggactgcaggtgaacacaacctttcccagctaattaaaaaaaacacacacctttttccttgtaggatgagatactgctgtgttgcccaggctggactcaaactcctggcctcaagcgatcctcccacctcagcctcccaaagtgctgggattacaggcatgagccaccatggcccttccctgtagctgctttcataatgttatttttaaaaatatctgtgctttgcctgtggctctaacattcttttatgtagttttcttcgtattaattccatcttgggttttctgtgcttcttagtgggttattctttttaaagaaaatttggaaaaaaaattgtcaatatttcttcaaatttttttaagttccattttctttctactctctgtgggcacagttatagttgttagattgcttaatacgcctcacaggttactgaggcactgttcatttttttaacccttttttctctgcttcgaatggaatgatttttattgaacttcaagttaactaatccttccttttgttgtgttcagtctggtctttaaaaaaaatttcagggctgggcatggtggctcacacctgtaatctcagcagtttgggtggctgaggtgagtggatcacctgagatcaggagttcaagaccagactggccaacatgctaaaaccccgtctctactaaaaatacaaaaaatcagccaggtgtggtggcacatgcctgtaatcccagctactcaggaggctgaggcaagagaattggcttagacctgggaggcggaggttgcagtgagctgagatcataccactgcattccagcctgggtgacagagcaagactccatctcaaaaaaaaaaaaaaaaaattcagatatttacttttctgtcttatgatttccatttgactctttttttactgtttccgaatccctcatgtgtctccatctcttcagtcatgatatctatcttttattctagactctttaacatgtttgtaagaaatactttaaagtcttttgcacttaattccaacatctaggccattttaggagtatgtttataatgactgatttttctctttacagtgggtcatgtatttctctttctttgcatatgtctagtaattttttattgtatggtagatattgttacattgtagagactctggattctgttgtctttgaatatcattaagtttctttcttggccaggcgcggtggctcacgcctgtaatcccagcactgtgggaggctgaggcgggtggatcccgagatcaggagattgagaccatcctggctaacacagtgaaaccccatctctactaaaaatgcaaaaaattagccgggcgcggtggcgggcgcctgcagtcccagctacttgggaggctgaggcaggagaatggcgtgaacccgggaggcagagcttgcagtgagctgagatcgcgccaactgcactccagcctgggcgacagagcgagactccgtctcaaaaaaaaaaaaaaagtttcgttctagcagttggttaaatgtgagcttgtggagacctgattattcttttttttaatgtttgctatctttctgattttcgcatagccttagggaaaatccattagccctagcatatggtctttactcctagaccatgacccttttggtatttcagtggaaagcctgaaatgtttaaacccagacctctaacttagcaagtctgaaactccagatggactgccctgtagtgggcagcagctgaaatacctgctcagctcctccagcctctcagctgctgttttcctactggacttcttagtgggttgcccatgtatacttcagggttcagccaagtggttgtgaggagtttatatgttctcttctgtagatctctcctttctgaaatttctcctctcaatttccagcagctctgacagtcccaactctatcccctgactcctctggagaataagatgacattttactgtacttcagtatttgagttctagcctctctgcaccaaaagaaatggaaagttccctcaagaggaaaagtcatgtcaacttggagcatacccagtatggtttgtcaagaattgaaccccctgcctacctctgcccttttctggttgttcttcagtggtcttaaaaagttaattttttctaagtaaatattttttcagagtttataattattatctttaataagaagagttagtctgatataagcaactctgtcattgttgaacttaaaacttgtggtttatagttatcaattagattgtgtattagttatctattgctgagtggcagtcattctaaaaatgcagctgcttaaaacaacaaacacttgttttccagcacagatagtggctttgctgaatgtttctgattcagggtcactggtgaagttccagtcaagctgttggctgtgattgtagtctgaagacttgactgagtctggaggattcacttccaagatgggttacttatggggctgttggctggagtccctgattcctcactgtgtgtacctttccagagggttgcttgagtgtccccataacatggtagctggctttctttataacaagtgattcaagagaaaaagcaaaaccaaaccagcaatgtcttttatgacctcatctcagaagtcatgtaccatctcttcagccatactctgtgcattagaaatggatcactaagtttaacaatacactcaaggggaaagaaatttggtcgcaccttttgagtagaaaggtgtcaaaaaacctgtggacatagtttaaccaattttctttgtaaaactgcacattccttataaatgttgtcacataaaaataattaaatcaactgaaagaaacaggaactgtccaaattatatcttaagaaatagccaggcgtggtggctcatgcctgtaatcccagcactttgagaggcggaggtgagcagatcacctgaggtcaggagttcccgaacagcctgccaacatggtgaaaccctgtctctactaaaaatataaaaatcagctggatgtggtggtaggggcctgtagtcccagctacttgggaggctgaggcaggagaattgcttgaacctgtaaggtggaggtttcagtgagccaagatcgtgccactgcactccagcctgggcaacagagcgagactccatctcaaaaataataaaaaagaaacaaaactccttcaacccccagtttccctaggtgtgttgccttcaggtgcattagcacctaccctggggagaaattttacactgtcaggaatccacagaggcatgtgccatcttcattgtttccagagaggagagtggggtacccctgtgcggtcactggtccctgatgtctttcattttagagagactttaattttatattaagttgtcaagctgtacattgatgatttgtgcccccttttcatatataattttttaataaaaatctgtttaaagtttttatgggctgggcatagtggttcacacttgtaatcccagcactttgggggttgaggcaggaagaccttttgagcccagaaatttgagaccaacctggtcaacatagtgataccctgtctctacaaaaaattttgaaaaatttagccgggcatggtggcatgtgcttgtagtcccagctacttgggaggctgaggtgagaggaccacataagcctaggaggtcgaggccgcagtgagccatgattgcgtcattatactccagctgggtgacagagtgagaccctgtctcaaaaaaacaaagtaaagttcttatgatgtcacatttgttcatcttccttcatgactcttgagtttgggatcttgcccaagatagtaaacctgttttgtatttcctctaaaaacttagttttaggacaataattggtcttaaaatttttatggttttctctttcctgtttagctttttttttttttttttgagacagaatctcactctgtcacccaggctggagtgcagtagcatgatctcagctcactgcaacctccacctcctgggttcaagcaattctcctgcctcagcctcccgagtacctgggattacaggtgcccaccaccatgcctggctaatttttttgtattttttatgtaaagacggtgtttcactatgttggccaggctgatctcggactcctgacctcaggtgatccacctgcctcagctgcccaaagtactgggattacaggtgtgagccactacaaccagcctttctgttcagctttttgatccatatggaatttatttctgtgagtagtgtgaaagagagatccccccaaatcaatatttggtgattgccacacgtggccctcatcacatcctagatccccatatggacactgggtctgcccttacgtttccttagtcagttccttcataagccctaacaataccacgctttgaattattacagtcagtttaggagagttttggggttttgtttttgtttttttggtaactgatagggcaaattttctcttatggttccttttcaaaaattacttggctattcttgcacattttctctttcagatgaacttgagaatctgcttgtcaagttccattaaaaaaaaaaaagccctgttgggattttgattgggattgcttggaaattatagattaattgggggagaatgacatctttacaatattgagtcttcccacccaggagcatggtatgtttttatttattcaggtcttcttttacattgttttttaaagttttatcactttctccatatcgattttatacatttcttattagatatatatctagattttttaaaaatttgtatttctaattggtcattattgaaacggatataggaaagctattgatttttgtatgttgggttttgtttctggtcaccttattgatctctgtgggtgctgttgtttttccgttggattctcttggcttttctggagagatgttaaataatagctatctgtaaatataatggtggttttatctctttaatattaataactctctttttcttgccttatttgaatatgtagcagttcctgatgaatattgaatagtggtggtttataggttctgtttgatttctgacttatacaggaatacttctaattttatgccatttgtaaatgtcttccctgtagttaccctttatcaagttgagaaaattttattatattcctagatttctaagagatttaatcaggaatggatgttgaatatttaaaagtatctattgagattattatattgtttttcaactttattgtttaatctgtgtagtgtaataagttacattaatagatttcctaaactgggctaggcacagtggctcacgcctgtaatcccagcactttgggaggtcaaagtgggtggatcacctgatgtcgggagctcgagaccggcctggccaaaatgttgaaaccctgtttgtactaaaaatacaaaaattagctgggcatggtggcaggcacctgtaatcccagctactcgggaggctgaggcaggagaatcgcttgaacctgggagacaaaggctgcagtgagtcgagatgacaccactgcactgcagccctgtaagactttgcctcaaaaaaaaaaaaaaaaaaatcctaaattggaaactttttctttcatttttgaaataagttccatttgctcatgagtattgttgttttgatacatctgcattcaactgctgatgtcttcttatggttttacaacttcatttataaaatggatagaatcacagtttctgtgttttgtgatgtttctctctaacttgtttatcagagtcaggccagtctcgtagaaagagttaggaaactttcttttcctgtgctctgaaatagttaatatattgtggatagtgcctgatttctgaagtgttggtagagctgattaactagtctgattggatatggtgactttcaaaaggactagacctattcaggttttctgtttcttcttgaggagatttttgtaattaaatcttcctagaaaatcatcaatttttcaagattttcaaatatatgacataaattcaatatcatatgctcgtaatttaaaagtacatcctccatgtttatagttataattgtttctaatcttatttgtgacatctcctcttttttccttgattgatgaaaaatttctatttttaataaaataggttttttcacctcagtgtcatacaatatacccatgtaataaatttgcacatataacccctgaatctaaagtaaaagttaaaattataaaaaatagtgtacgtaaaaataaaaaaaaacaggcttttgcagagaactaggttttttttaattgagttcctttattttctgcatcataaatttctgcttttacttatttattaattccttcagcttttaaatttgttgttgctgtgttctaattccttgaatggaatgtgtatttagttctttattttcaggattttatgtgttctaataaataaataaataatcatacattctcctttcatcacctcttactagtttaattatatggtgcttttcttgctatatatttctgaataattgtacgtttcagcttagatttttctctttaacccaggagttatttagaagagatttataaaatttttcaactgcgtagattttctgatgctccttttgttgttaatttttaagtttcttatattgggttcacagaatgttctgtatattttctgccttttggaatttctggagaatatctttgtgtcctaatacacgttcagtttttgtgaatatgccaatgggtgtttgcattagtccgttttcacactgctgataaagacatacccaagactgggaacaaaaagaaatttaattgaacttatagttccacatggctggggaggcgtcagaatcatggtgggaggtgaaaggcacttcttaacatggcggtggcaagagaaaaatgaggaggaagcaaaagcagaaacccctgataaacccatcagatctcataagacttattcactatcacgagaatagcacaggatataatataatatagtagcttttccaggcacatggtacaagctgccagtggatctactattctggggtctggaggatggtggccctcttctcacaggtccactaggcagtaccccagtagggactctttgtgggggttctgaccccacaattcccttctgcactgccctagcagaggttcttcatgagggccccacccctgcagcaaagttctgcctgggcatccaggtgtttccctacagcttctgaaatctaggtggaggttcccaaacctcagttcttgacttctgtgcacctgcaggctcaacacacaagtggaagttgccaaagcttggggctcccaccctctgaagccacagcccaagctgtacgttggctcctttcagccacgactgacgtggctaggacacagtgcaccaagtccttaggctgcatacagtacgaggaccctgggcgtggcccatgaaaccactttttcctcctgggcctctgggcctctgatgggaggggctgctgtgaaggtctctgacatggcctggagacattttcccatggtcttggggattaatgttagattccttgttacttatgcagatttctgcagccggcttgaatttctcctcagaaaatgggattttcttttctactgcatcatcaggctgcagattttctgaacttttatgctctgcttcccttttaaaacagaatggctttaacagcacccaagtcaccttttaaatgctttgctacttagaaatttcttctgccagatactctaaatcatctttctcaagttcaaagttccacagatctctggggcaggggcaaaattctgccagtctctttgctaaaacataacaagagtcacctttgctccagttcccaatgagttcctcatctccatctgagaccacctgaccatggaccttactgttcatatcactatcagcatttttgtcaaagccattcaacaaatctctaggaggttccaaactttcccacattttcctgtcttcttctgagccctccaaactgttccagcctctgcctgttacccagttccaaagttgcttccacattttggggtatcttttcagcaatgcccactctatgggcaccaatttactgtattagtccattttcatgctgctgatgaagacattcccgagactgggaagaaaaagagatttaattggacttacagttccacgtggctgggaaggcctcagaatcatggtgggaggcgaaagccacttcttatatggtggtggcaagagaaaaatgaggaggaagcaaaagcagaaacccgtgataaacctgtcagatctcatgagacttactctctatcacaaaaatagcacaggaaagactggcacccatgattcaattacctccccctgagtccctcccacaacatgtgggaattctgggagattcaattctagttgagatttgggtggggacacagccaaaccatatcagtgtttgaagagtatttttattctatgctcattgagtaaaaaaaatctgtatcagattagggattgcaactggtagcccataagctgcctttggcctgcagacatgttttgtttgactcacacaagtgtatttttgaaaacttgagtaaacatttacaaatcacagtattttatgtaaaaatatggatttggggctttctatgaaagcttagaagctctggctgtgctgggccctcattccttaatggcaacagtcggctacgattgctcctaactcaaagggcagtctacccgtccccgggtggccttcacagacctggctgcttcagccatttaccctgcctgcctgatacctttaggcatcagcctctatcacctgtgtgttctatcaagttcattcagaagttctggagtctttcttactttttgtctacctgatctgtttctgagaaggaatgctggtttccatgatgattatggatgtgtcagtttctttccgttttcgctgtacacattttatagctatttacaaggtacattacaaggtataatgaatcttcatcaatataaaatcctctctatctcatttttgccctttaattgtactttggctgatataacacctgtactttgattgataaaagtagcacacttgcgaatttattttatcatccttcttctcatatattctttatttctaatgttggttttataagcagcatgtatctggatttatattttaacacaattgaagagtctctttaaagaaggactttgttatattcatacatgtgctgatttcagatatctttggatttatttctattgtatttgtttttatctattcatccatccatccatccatccatctgtccgtccatctgtctaccaatctgtctttacctgccttttgctggttagatgtagtttcttctcttttctttcattctaatgggttgaaatttttacattctaaatctgtttttctgttactctttaaacacagttattgggacttatgtttctctacagtgtttagcgctaatcagtacttaactctttcacctgagcaacataagaaacttaccatagctccactcctctgccatcttctgtctgtcgtcacctccttgaattgggataattcaaaaatttaactccatattatttttaacaagtttacatcatgcatcaacaattgtgtgagcttaagtataaagtctaattaatttctttggtcaccattgtttcttttttcttacatctttgtatgtgatttttttattttactagattttctcatctattaaattattcattctcttaaaagatattttgagtgcttgctataggtatgaatggttatatagatagtaaattttctgagtccttgaagtctaaaaatgtcattattttctccctacaaatttggctaggttttgactttaagttcaagataattttcactcataatttaaaaggtattaccccatggtctttggtattcagtgttgctgacaaggggcgtctctttgtctcaggtgaatttttttgctctgaagtctactttatctgatattaatatagctacttctactttcctttgattaatggttgtacagtatacgtttttccatccttttactttcaacttgcctatattgttatatttgaattgagtctcctgtagataacatatatttgggccattttttaaaatttatttttcttttataaaaatttttattaatttgaagagtacaatacagtagaaattgcctcttttttcttttattgataaatgacatttcacatatttaagaggtacctgtgaatgttttctacatgcatggaatgcagaatgatcaagtcaaggcatttggggtatccgtcatcttgggtgtttatcatgtctatgtgttggtaacatttcaagtcctctcttctacactgaaatatttaacatattgttgctaactgtagccccccggtctgctgtcaaacgtgggccatgtttttagattcacttgccaatctcttttagttactatatttagatggttaatatttaatgtaattattgatacattaggggttaagtctgccattttaacttctctattattttcctctgtatttagtttctctgttttttttttcctgccttcctgtgggttacttgaacactttttaaaatctcacttggtttataatgtttttgagtatgtcttcttgtatagcttttttagtggctacccttggtattacattatgcacatgtaacttctcacaatcaattttatgggtgttgtcactttaccagcgtgaggtacagaaaccttaccttcctttatatcccattattctctcccatttatatttgtaatatacatacatattaaacatacattcatttagaaccacatcagacagtgttgtaatttttgcttcaaccatcaaatgtaatttagaaaacttgaaagtaaacttggtgaatctgtaggtttatatctcttgccaaatttggagagcgtttagccattatttcttcgagaacttttccagcccccactactttttttcctcctcctcctcctcctcctcctcctcctcctcctcactcctcctccattattagagacagggtctcgctgtgttgctcaggctggagtgcagtggggcagtcatagctcactgtaacctcgaactcctgggcacaagcaatcctccggccttggcctcccaaagggctgggattacaggtgtgagccaccactcctggccctttttcctctcctcctgtccactctagtgacatgaagtttaggtctttgttatagtctcacaagtccctaatgctctgttcatatttttaaatttttttctttatgttgttcagattgggtaattttatatatatatatatatatataattttccagttcactctttcttctgtcctgtgggttctattactgagcccatcactgagctttttgattattgtatttccagttctaataattctacttggttcctctttatatcgtgtatttctttgctgagactttcagtttctttattgagactttctattttttcatttgttttaggcatatttgtaattgctcacctaggtgtttttttcatggcctctttaaaatctttattaatatacaactagtatatccttaaaaattaaaaataattttaaaaggtaaacctaaaaagaggaagaaaatgaataaaatgtctgtcagatggttccagcatccgtttcctccatgttggcatcggtgattgtctgtctttatgcatttgagatcttcctattcgttcttggaatgacatgtgatattcctttgaaacctgtacatttttgcattatgttatgaggctatacctgacttcagccttctgtttcagctggcttctctggccctgttgctgcagaggacaaggggtaccatttcattattgtcaggggtaggttgtccagggcccccattcagcctccgctgatacccaagcgtgggaagtctccttatcagtgctgagaaggggcagtggttcccactccctgtgtgcctcccatgaccccacagtgcaggtcccctcattactgtgagcagcagtgagcctcctgactctccaccaggcatcctgacacaactccaggggatggaggggacacgttgttactgctgggtgtggttggaagaccaggctcatggcatggtatctgctggcaccatgcaagtgggccccttttgaggttgctggaggtaaaagcgctgcttcctacctgctgtttcctgacatgccccagcagtgaggtcgggcacctcatttcgtcctcgcatgggtggaggtctaggctcgccactcaggctgtgctgccataggtcggggtggtaccacggttccttgctgtggtatttggcctacttattgtgtatggttttttccatttgttctattggccctgtctcgtcgggtccctctgttcttgttcatgttgctttttaattgggtgcccctctttcttgggatgggttttcctcaaacatgggctgcttcttggtcgtccacccctgcatgtgctcacagatccccatgtggctgtgggtggttgtctggtctgacggcaggggtctttctgtgatgtggagtggagggagctgttgcttgatagcatttcttctgagaagggtgcgaggcggactccccgctcccagggcatcgtcctggtgctctggccttaggaccctgtctcactgcaccagcctcaagatgactctgctgctgtccccactcagcctggaggctgagacctgccaccctagctccttactccgaggcctgtttggggctcctcctgtccttgcacgcccagcctggcaccttcctcagctctggaattgttccccactcagaagtcctcgcgccaggaccccgcctcctgctgctacctgatgccctctgcttcccgtctttcctcagtgcctcaagacagctcgtctgtgctgatcttgtttcccaaggctggttcagatttgttcgttctaagttttattcctagggatccaggccctggggagaggtaggctgcgtgctcagtcttcctcctgggttgggtctcttgagtcttttcactgtggtgcagatggtgacacctcttgccgattgctgttggttgccaagcacttgtagtcatctttgcatccagttcttagtgtgcctctgtgcgctggacatgatcatggccgtttcccaccaggggagactaacagagagatgaattgccacatctgggttcacacagctgccaagaggcagcgcagaggcttgagctcaggcctgttgccctgaagcctggattccacctttgcaatcatagccttctgatgctaggacatcgcggtgaccagatgagaacagctgccaccaagcccagtggccagaaacagaagcagaaggggaagccttcgcagtgtataactgtatacttcttgactgaattctgattccttccaagcatattttggcctcgcctcttcctcctggcctaaaaaggtatgataatgggaacagcacaggagggagcgagagagggcagcaggcatttcctagcccctcttcttattcatcctttctttgctctcttgctctgttcacctttttgtctttttaattttgacctggcacatagttctccttctctctctctctaatgctccttccctcccagcccttctgcttcagggtggcattggtggtggggggctccagacttggctgcctccactgccatcagctcacctccaaggtgagtgcaggctgagcttcatggcaagcccttcctgctggggcctgcagaattctaaaggccctggccaagcacagtggctcacacaaaatccctgcagtttgggaggccaaggcaggaggatcacttgaggccaggagtttgaaaccagcctcaacaacatagtgagaccctgtgtctacaaacaatttaaaaattagccaggcatggtggcttatgcctgtaatcccagccactcaggaggctgaggcaggaagatctcttaagcctagatgtttgaagctgcagtgagcaatgattgtggcactgcactccagcctgggcaacagagcaagactcaaactcaaaaaaacaaacaaacaaaaaagtgtgaaggcccctcccagaatgcaggctgaggatgtgatcccatccactgcaccaggtcctcctggcttcgtgccccatgcggcatcctttgagaaaagcttgctggggagccaggtgtgctggcttggccggagtggaacctgctctctcagggaggcttgcaatatgcaggggaggtgagtggagccctcacccctttaactttaccaggcttctaccctttagcaagttcctcacgtgtgctgatacttaaccagattcagacactttcctaaggcaggaggggtgtcatgagggacactgcattatggtacactttccctgcattttttttttttttttgagacggagtcttactctgtcgcccaggctggagtgcagtggcacgatctcggctcactgcaagctccgcctcccgggttcacgccattctcctgcctcagcctcccgagtagctgggactacaggcgcccgccaccgcgcccggctaattttctgcctttttagtagagacggggtttcactgtgttagccaggatggtctcgatctcctgacctcgtgatccgcccgcctcggccgcccaaagtgctgggattacaggcgtgagccactgcgcctggccttgtatttttaatagagacagggtttcaccatgttggccaggatggtctcgatctcctgacctcgtgatccgcccgcctcggccgcccaaagtgctgggattacaggcatgagcccccgcgctcagcctccctgcttttcagaagcatcgccagtccacagggcaggatccctgaggctggtctggagtaggctgcatttggggcctgcagcaagggcagctggagaccgcagggagccctcccacctgacaaacagaaaagctcccctgctccggcccccggatataggtgcatcttttcagaccatgtttgccctgtttctgggaaggaaaagtaaacggcagcgaccagattcctgttggtgtttttgctccatattttgattggggaactgaatcatgtttttcctttcataaacacgaaaatgttaagtacataacagctaaattaatccatgcccataaattggttaattatgttaattctgagtcacagaattcagtctcgttagtgtttccattaagcagtttaggcctgtgagcattttaagagaacagtttaagctgtagattaatcttcaaaggttcccagcgcattttcaactgcaagaggattttaaatgcactggggggcttggggggatttggtgaatgttaggagctgctgctgtcagggagcgggtgttccccacttcctcgtccctcacctcccccaacacatccaaggcccctgcctgctagatctgagcatcgccaggctaagcaggagccataggaaggaggagatgggcaagaactggcatagccccttctgccctgtgtctccctggtggccatgccctcctcaggccgccctgctgcagacacccgcagagaatgggtgaggctagctctcgaatgctgtgggctgcatagccctgggttcctgagagggctgctgaggggctttcttcctgggtgtacataagaaagaagcagagagacaggaagagagcacgctgagtcttagaaacaagctcctgggtggcctttgttcatggcggcatgaacgtctccttttcgccgtccgtgtccccttcagaggtccgttcaggatatgggtttgctttcttggcacgtgcgcctcctctagggttccttgccgtacttgcgtgtggtgcagatgtacgggtgctccatctggctcagaagcctgctgtcctgtcctgcatcccaagctgccggctctcactggcttcctgtgtgtgcctgggccatgcacttctgttctccagccctcattccctagcggggagaccgtgaaagggtcagcctcgatgtcaaacctctagaccatggctaaggcttttccaggttttgtattgttctttgaagaatcaacaggacccgattatcaaagagagacctgtttaaatatgtacaatcattttcggtattatttaggtttggcaaggccagcagatgaggagaccactgccatgcattgaaaaggtggtttgttccagttcccaagaggatgcgtcccagtaccgtatgtggggccacacagagaagcagcgggttctgtcaggaggcaggagagaggggaagacacgggccagaggccttgtggtggtttctgtgggaaggagtgggtgaggcagagaaggcaagttcagaatcagctaggctgaataatttcagcagactcaggggaataggggctgtccctagctgcctgacacctggccttgggtggttaggttaagggagtagtgacctggtgtgtgagagcccatgatggaggtggctggggtgtagactctggattggttggcttgcatgtgaaaagcacactcctgatgggtagtttactatcccgagaccctgggtagcgcctgaaggaacagtctccccagggtcagcaagccccagatgtcaaagcatcagatactgaaaatacaagaggaaggggagaagatggatgataccaaagttatcccagacgcagtaccagggccagggcctcaacttagcttttcattaatcttctcaactgccttggcagataaatattgtagaaaacatgatttagagaggctgagactatggcccaaggtcatgcagagccgacattccgctccaggactctctgaccccagctgtcttccccctaccatgagctgctctgtatcttgccaggggccatacccttgccacaccacactgccagcctcccacgctggtcacggcccttctcttggaggtcgctggctgagagagctgcgcacctgtgtccgtgacacagctgtggagatgggacgccagacacatggaccacagactggggaaccagtctcagttatcacgggacctgacctgggacagacctcatctcctggatccagggctgcatgcaggacatgcccataaggagcgtcgctggctacagctgtgtttccactgtagaaggaggtggagtggctccatcagggcatcaggaacagaacaggaagcaggaagagatttggcttggtgatcccccgcgcgtccccacacacttcatgtcacgatggcgaacgtaggtctgccttgacaactcggcagaccacagctccctggagctcctagaacaaggctgtcctgtgggggcatagttagcaatttgaaagccgtgtctattgtcttaggtgataatgagggttgacagaaaccttttaggattgtagcatttctaagtaactgttgaaaccttacttggcccggaatggctgctcatagaacagaatgtgctatagttttactgaaaaaaacaaaacaaaaacaaaacataattctctgtggacttactaaaataaacccagggctaatgagcaaaatgtgttggggaggcctatttgtcacactcaggaagcgacagtctaattttatttgctcctgttcattgcttctgcattgccattcattcgctgaaggcaaaatacattacttctcaataaacaaaagtgggcccagcgtgtcccgctccctgccttcctccagccgttatccccccgggcaggagggctgacttgtattgatgtgcatgtgtgcgtgtgtgtgtgtgggtgtgtgggcttgtgggtgtgttcttcccattgctcttaatgttgagcttcctagaaagttttcaggggaaatgctgtgtctcgtgctgactggggccggctgcatgttgataggttcaccttgccttatacaaacctgctatttggaaagtcgagatataaattagaagcaggcggccgggtacggtggttcatacctgtaatcccagcactttgggaggccgaggtgggcagatcacttgaggtcaggggtttgagaccagcctggccagcatggcgaagccccatctctactaaaaatataaaaattagccaggcgtggtggtgtgtgcctgtaatcccagctactccagtggctgaggcaggagaatcgctcgaacctgggaggcgaggttgcagtgagctgagatcacgccactgcactccagcctgggcgacagagggagactctgtctgaaaaaaaaaattagaagcaggggaaatggaggaaagacaggtcactacggaaaaaaagtggctttgtttttttttttagcttcactaagtgagttgtaaaatcattcatttcatcaagttctcccagggcatttaaaatattattgggtttaggagattttataggaatgcacgtattatttaaagcaaggcaaactggtgtgattccttcctggatggagcttctgtgggcagctgcaattgtcagtggggggattggttcccatagcaccccgagttcttccctcaaacacaaaggcaccaggttctccaaagcaaccatcttccttccactcaacactcctcccgcctcacacccacagactcgtccttagagtggactgggcaggcgggttcattgtgccacgctgtgctctgaacccagcatgcccaaaagcagtccgttagcaagctgaccatggggagttcattgccatcaatgccatcaaaacaatttgcccaaatcaaatttatacctgacattttatagtaaatgggcctttcttttctcattagagaaatcattactgtttttcttctccttggcatttccagagagccattcacatttaaagctcatgttggaacagcaggcttctactgaaaatatttaccttttctttgttggcaacttgtcagtgttggggaaaatagatgcttcattaagatctaagcgcgtgatgcttgctttcccacacatcagtcagtctttttccaagatgaaaagcatggtgagaggtgttgggaaatcattctggtcatatgtttttatgtatttttggatgtcttctggcatcccgttcttcttgttcaaaaataggcatttcaacacctataacttgtagagagaatcctagaacaggatcagcttcaccacttagagcatcagaattggtcttgacccccgggtggccagtgaggtctcctgccctggagatccatggctgaaagtaagggcaaagagaaccctgctgccatttatccagcagttccggggccagggcctcaacttagcttttcgttaatcttcttaactgccccggtagataaaaattgtaagaaacatgatttagagaggttgagaccatggcccaaggtcatgtggaagcgagattacaccccaggactctctgaccccactctcttcccctaccgtgagctgctctgtatcttgccggcggccacgatcttgccagcctcttgcactgggcctggccctgacccttctcttggaggttcctggctgagagagctggacacttgggcccagtgtccctgacacagccatggagatgggatggcaggcacatggaccacagatttgggaaagaccccacttcatgtccacccgacccctcctctccacccagaaaggacaaaatacagtgagctgatgccacagcccatgtgagctgggcctagaggtggctctgccctgcctataaaagggggaaaggaacttacaatagatgccagcaaacccagaaacccagagaaggttggcccctgttacgactcctttgatcttcacagggaggtgagctcttgctctattaaaattaagaacctctgtttgtctagagctaccataaacacagtgagaagaccaggcatacactgggagaagatttttataacctgcattaccaacaaaggattaattctcagtacaagcaaaattaaacaatgtatcacttaagcatatatacaattgtattaaactagtagtatttaaaaagcaatggcctgcgaggtgggcggatcacctgaagtcaggagttcaagaccagcctggccaacgtggtgaaaccccgtttctactaaaaagcacaaaaattagccgtgtgtggtggcgggcgcctgtaatcccagctacttggttggctgaggcaggagaatcacttgaacccgggaggcggaggttgcagtgagccgaaatggcgccactgtcctccaacctgggcaacagagcgagacgccatctcaaaataaataaataaataaataaataaaggcaatggcatgaataatccaaaaattctgatcattttcctctgagaagctgggggtgacagggaggacacagaagtagaggcccccagtgggtcacgttcttgttcttgcattgggctgcagggttcatgggtatccgtttttttattaggctttataactaacgtgtatgtgacatacaatcttttgtgcttatcaagtcatgtgtttttagaaaacaaaaagaaaaaccaatcagttattgttactacctccatttttttttctctctctttttttttaattattattatactttaagttttagggtacatgtgcacaatgtgcaggttagttacatatgtgtacatgtgccatgctggtgtgctgcacccattaactggtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcgatagtttactgagaatgatgatttccagtttcatccatgtccctacaaaggacatgaactcatcattttttatggctgcatagtattccatggcgtatatgtgccacactttcttaatccagtctatcattgttggacatttgggttggttccaagtctttgctattgtgaatagtgccacaataaacatatgtgtgcgtgtgtctttatagcagcatgatttatagtcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgattgccattctaactggtgtgagatgatatctcattgtggttttgttttggatttctctgatgaccagtgatgatgagcattttttcatgtgtcttttggctgcataaatgtcttcttttgagaagtgtctgttcatatcctttgcccactttttgatggggttgtttgtttctttcttgtaaatttgtttgagttcattgtagattctggatactagccctttgtcagatgagtaggttgcgaaaattttctcccgttttgtaggttgcctgttcactctgatggtagtttcttttgctgtgcagaagctctttagtttaattagatcccatttgtcaattttgtcttttggtgccattgcttttggtgttttagacatgaagtccttgcccatgcctatgtcctgaatggtaatgcctaggttttcttctagggtttttctggttttaggtctaacgtttaagtctttaatccatcttgaattaacttttgtataaggtctaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtcgtatagtttgaagtcaggtagcgtgatgcctccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcacaatattgatactacctccatttttacagatgggaaaactgaggctcagtggggtcaaactagcagcaaacacacacgttgaatgcttactgtgtgccagaccctttacacggatcatccgatttcatttgtttgacatccctctacatatgataagtgtcatcattgcagtgtgcagaagactgaggctcagcgagacgggagaacttcagagtcactacctggtcacagttgatggtgaaggcaaggtcttcacctgtggcatgccccacgtccctcctgctggctccgaggctcactgtgagtgacagctccactctgtggacctccccttgggagcaggcgtcgaggcatctaagtccacttgccttgtgccatctcagtgcctggacactggtggctaccctgggccgtcctgcagccagctcgctgaggtaggaaagagaggaagggaaacaggtggagtgagaagagaagatagataacactgaagttacatttattcctactgctcatagtaggctttcaagctatgaagagatggctcttcccgtgacttcagccccatcctccatcgctgcccacgcccacgtggctgacactgccgaatgtctctagcactgttgttgaacttctgatgtctcctatgcctcaaccttgctattgccttggtgtaaatttctctgacattgattttgaatacaattccaggcttttggagcagaagtttccagttaagcttggtgtcccacctaagtgttaaggtcaacatgccgagccctagagtggtcctccctctcccaccaccaactatcctacctggcctcccaagaactgcctttggtgactcttgtattctctgtcttgcttcatgcctgggaaatttcagggcatatattaaggggaaaaccttagggaaacctgaaccttcaaaactgggtagaatgaatggatggaatggaagaatttactgcagcgaaatcatcttcaaattccttttaggttggaagcttcttaccctggcaagtgaagaagtacatttggttatatgtttataatccatgtgctactgggtgaaagatgataggacaagaacatttgaaatgtatgtgttagggatctctgcccagcagtttccatcaaaagagcacacccatgattatcgtacaaatggatgggacagcaggattctactcacgtaaaatgtttgtccctgagcacctagggagggtgtcacctccagggtctccttcctgttgctcttctgcatgagtcctgcaccacctcttttaacctcagggaaaacttcactattttgttttttaaagtcagtcatatttaaagttgctgcttttgagtatgcactacgtgttgatgtagattctggaatgtagaacaaacaggcgcagactagtatgggtaaggtggggaacccctacttcagaaggtgaaccccagaaggaagctgcctgggccaggggtgtgtgcatgatggcagggagctgcagccactaagccttggaagagtctttaatggcacagggaaatgccctgtataaagctcagtgggggaaaaaaaggatttagaaagaaagtatatgccagaggcaaagaaaaagactagaagaaaataaccagccaggtgcagtggtgtgcacctgtgatcctagctactcgggaggctgaggtgggatgattgcttgagcccaggtgtttgaggctgcagtgagctatgatctgtgtcactgcattccagcctgggtgacagagtgagaccccatctgtaaagcaaaaaaagaaaagaaaatagccaaaatattattggttatttctctttttcccaaagtttgggcaagagcatatactattcttacaatcagaagaagtcctcttttccattacgtcttaaatagctctaagatttagaattcgtcttgatgaaggcatggtcatcgcacacacagagctgggccccgtgggtgaggggctcccgggggcctctgagtggggagctgtgggtgtcaagtggccatgaagagagttgacccagggtcgggtggcaagattctctgagccccagagaagtcgactttctgtatctactagaatccaggaagagtgtgtccatggccgtcattaccccctgcttccccgtttcatgccaggtttttctcagatgccttctctgggggaggcactgttgctggggcaactttctggctgcagagggcacccagtaataaaggcaaatgccaagtatgaggcaagaagggacgcccctggctgggatggcaggcattgggagaggcttatgggagcccctcacccctctctttttggggtgctctcgaggaagctggactctccacctctaaagacccctccagggaacatagaacccaaacccaaatggagatgagctggccagcgaagtccaagaccccagtcccctccattgcaacctggggtgcgggcttctgtcttccaggttgaaagctcatcatttggttcatcataagttatacgtcggagtggaattataaaggagagagaaacagatgtgaactctcaacagctgggagaggtggaaagcctctggagttccattatagaaatgtgccttttggccaggagtggtggctcacgcctgtaagcccagcactttgggaggctgaggcaggtggatcacttgaggtcaggagttcgagaccagcctggccaacatggccaaaccctgtctctattaaaaataaaagttagccaggcatggtggtatgtgcctgtagtcccagctactcgggaggctgaggcaggagaatcacttgaacccgggaggtggagcttgcagtgagccgagattgcaccactgccctccagcctgggtgacagagtgagactctgtctcaaaataataataataaataataataataataataataggtcttgttttttaaaataaaaaacagaaatatgcatttttagataccagcaggacatcatagcactgagggaagctgaaccctctctttgggacgtagcttgctttcttttgttgccctggcctgagttctttcacatcagccagcatggagaagaggagccagttttgcagaatgactgggaacagcccctgctggggagggactctgtgatgcggtgtcctcatccgagcctcctgggcccgggttcccgtcgctgtgtgcccggagcctgggcgccgacaccgagcctcctctgtgctttcaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaaggtgtgagtaaccagggctacaggggagcgctctgggacaagggtgacagtaaacattttaacaagtatcagagtgacactggccacagccctgaaacaagacagggaagactctgctgtgacaggtgccagggccagtgtggaggagtcactcggggagtctgagaagtggctcttgaccggcgagagcagaagtgtttttgcctcgttccagaacagctgttccagtgacagccaggtggccactgctagcacgaccctctctgccttggagtttgcccatccctggctgaagggggtacacaggtgggtgacgggggtctaaggcagctcacctggcctgttacttggactctgcaggggcctcggcccacctgcccttagaaacacccagctgtggaactctgtgcattcatcgcggggtatgtgctcacccaggccccgctgcagcaggaagcagtggtcggggtgtcccccaccagcgcacagcccagcccactttgaacttctccaggggaacctcacaaggggctaagcagggcaaagatgcttctctgccgatgggccaaggggaggctggcaggctcctgcgaggccacccgccagccactctgtggtctttggttccggatccttgtgtgtcaggaaggctgaggaagggggaggaggtggctgcagatgagccagttcttacaaacagggtggcaaggcagatttctgggtgaggacagcttcttggagcaggcagacagagctgtggtcagcgtccaggaggccctgggtggccgaacaggtcccagcccaacgtacaatgtgtggtcagtgactgctgtagggagtggggaccaggggagttccagcaggaagtccaggcttctctgactcctcctgtgggggatgggagaatgggagggggtggcaggagtcaagcccattaaatttatatcgtttaaaatatttttacagttctcatcgtattataacccatgcatagtgattgcagtgtggctcataaacagctagtaagtcagtcggatagtaggaagagattatactgcaaacagcctctctctgtctctgtctgcccacccccgagtcctgccccacggaggaggaatctgttttcaaaccatgttcatgatttcctttctctaagtaatatcatttgatggctttcctgggtgcgttgagtttggtcaccatctgttaatttcctcttatcagaatgagcgtttttctctcaggagacccctagccctgctgccctgccgaaaccctggagtttcctccacttcttacctttcccgggcgtcaggcctacactgcatcctctgcctcctgccagctgcacctgcctgcacctcctccgaaggacttggtgtcactctgcaagtgtgaggcggaagcttcctcctctactgcccccaccccccaaccactcaggtcttgaatgcctgagaaaccaatgaccaaatacagggtatctacccacctgtccctccgagtttagtactcacccagacactaaatgtgagaaggaaaattaaggaagaggggcggtgtagacacacacacgcacgcacacagcatggggtcttgcgggcatccttgggacactggacagcttcctttatctccattcccccaagaaaacaccgaggcagcttcaatgaggctgctgagcacctaagccaggcccaaggctgggctgagtgagtgctggcacactcgggtatgaccaagtcagctgctgcccaccaagaactgccgaatacataaatcacccttccattacttagctcccagctccaacccactagatcgcttggatctcagtcttgatgacaagcgagacatcctaaaaattaagctgaatttaagcttcggagagggtgggtaagctggagggcgggtttcctgcatagaacatattgctttggatggtgttcctgctgagcgtctgtcatttctacgggatgatttccaaagatggagctcctaggatgaggcaccctccgtccaggaggggtcctggttgtttggcagtgatcgttcgggctctctggttcactgagcctatgggaggcttggggaggttggagctgcagagagggatctttgcattcggaattctgagcagtgttggtttcatccagctgtcaggggagtggggaagttgcagaggggaccacgtggtttcccctcattcttgtcacagttttgtgaaatactgaggtcatttgattttttttcgtcatttggaagtaaaatatgtcatacagagaaccttaaatcgcaactgtctcgatctgtcactgaaaatcctcctagaaatttgatgatctcaaaccaaaccacattcccccatctgcttttcctccttgtggccctatttgtcgcctacagtcttctgtaaaatctgactttatctttggtagatgatgtggcccggcggtgagagactgtagaagctgtaacttggcacaaagatctgtttaacgttggtccttaggaagcctggctcctctcacacctagttattcagaagggaccattagacattgctgtggctaaagacactggccgcgtccaggtggccggtgtttgctggccctcagtcgcggtgcttctgagctcatgaaatgaactctccctccccagggaagacatcgaaatacgatttgattgggttgaagttgtgagtttactgaaaagaagtgcaagttcatggctagggttgaaatgtcccctacagcttctgtcccatggcttccatgaagccactggaagatctgggaagtgaaaataaagtcgtcagagacagttaaaacatctctacactcctcagacctggctgtttcctcgcctcatttccatgtctccttcccagaaaccgttttaaggaggggaaaggttgttggtaccttgatgcctatgaggatgggttggtctcatagtaaatgcatgctacatgctgtaaatgcaaaccttgagcatttcaggctcttggtattcaaagtggggtccagagccagcagcactggcgtcccctgggagctcattagggatgcacactctcaggcccaccctggactttggggcacaagtctgcattgtaacaggttcccaggtgactccagggtgtgcacattcaagtttggggagcactgtttttggccattctctgctcctggagcagtaaggttgcatgctccaccttgcaaaaggacaacattttataagtcatttcaagtggggtggggagttaggagtggcagtgtctaggactaattctcacctggaataaggacaggctctgatgggttaaataccttttgatttgcattgtagttgctttaaaccggcttcagctgaatctcttcctgcaggtaatcacgtgcacacacacaccaccttcctgagctctttgtgcctttctctcagaaggttagcttttctgggagggacctttctgttgagctcttggccaccccgacaggttcaccttgcagatgcagaaagcagagtggacgcggcagccttaagcagcggggctgcgtgagctccaagaactttcctgtgggctttcttgggagcctcaagttggagctggagtctccttggtttacaaacccccgtggtgtgagcgtacagagcaggcgggtccactcattgtgctccaaaagtgagtgtgacatgtttggtcagcagcaggcttcaatttggctctacggggattgcagaattggtgtgtaagttatctttaaattggccgattgttgagcataagtataaatttcctctgtttgtttgggaaggacggtccttagtaaggatgtgatggccagccagtggctccagtttcccgtggaggtggatgctggcccttctctcgggccagctgtgcaccaccagcccatccagccatctggactatatccgtcagttcagtcttccactcgctaatctttagctggtacttgtggctggaatgattctcagtgtggtcagaaatcatccatcctgtgggtatgggatagagcggagctgcaggaatctgccctgactggctgctgtctttcaaagacttgctttcatgtgtacgttcttaacaatgaacaccggtgcacagctgggcatggcggcacacttctataggcacagctactctgaaggctaaggcaggaggatcacctgagcccgggagttccagaccagcctgggtaacgtagcaagacccctgtctcaaaaaaaaaaaaacaaaaaacaaaaaaacggaaagaaaacctacacacaaatgaggccctggccttggctagtgatataaatcagaccaccctgatacttacccactgcagagaccacagggagctctgacaggacacccacaagctgctaccagcttcctggacgtaaccctttccacctattctgtcttcacgcagagttcatggtcctatccctctttgcaaatttagctctctctgcaagaagggtacctcttcaagtatgttttccagaaaaatcattcttttccccaccagaccagctctttcaacccagaaaaattaaagttgtaaattcttccatcatctgtaatctcagtgtcatttgcagcactgctagctctctttgatcctaggccattgcgatggaaatgacaggcatggctctggaatagagcagcttgtgttgggacccttgattttcctgtgaagaacagaggagtctttctggccccttcccctcgtatgatcctgtgattctgcaattttaaggctgctgctacaggcaaaggcacaccattaaaatccaaacagagcccccaaaaccatgctctcagcagcatccagatggtctgaatgcaaccttcttatccctttgaaggaacatttgggagatgggactctaggttcggggggagacccaccctacgaggttctgctgcggggctaagccttgttcctcttgtccctccagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtaagttctcttggcaagttggagtgcttacagtgagtgcctcagccctctgggaatgagtttcttctccctttctcagaaagatggcttagattgaggccagattgttccggatcccagggtcccagcctcacccatcggcgaacaatttgagcctggaggtaaaccccagtcccttggcagccttcctcggacactggctttctaatctttgcacagaaatagcagttaaacccctctctggctttagagatctaaaaatattatttaagaacgaggttccttctcatgatgtcttgttttaactctgaaattctgtggtcacatgtcttggaatccaatgaacccatccagttccagcgtgtacaacagagtaagagaaagacttggttttatactgagacattctagaaatccaggagttcttctaggcattctgttgctacagaagcactttttctggacactttaagtcgagcagtggtttctgtctgttccgcttacttaagtgaacataagcatgatttgtcttttaaaaggtaactgttttagtactcaggtagaatttgtgctttttccttccctacatactttcctacttaaaaaaaaaaaaaaaaagaggaagggagggtttccagttcaaattaatgcagaattgaagtgcaaagtcattacgttgacttgtagacattttaaaaatgagactgtggagctggccagacatggttaaattttaaagctcactagcatcttttcatttctgcggctgctcagccacatctttcgaagttatttgcaaatttatttttacacttttctgtgggagcatacaggcttcctgttctcggctttgctccgcaccagtgaaaggtcagctgccatcgttctgtcgccagcctggtagcagctcggcctggttaactaaggtattaatttgttattttccttttctgctggagtacgcacccctgggacgggcagctgagatgctgaatggtgtcctgtttatgtagaaatccagctcatttgagcacggacctgctagggtcttattagacagacagttggccaaaacccaacatagtcttgctggccgaatggatgcaggttcgaatttgctaagttatgggacagtttataacatggactgcgtgcaggcaggatggtgtctctcaaccctggaagtaggacttgcagctttatttgcattacgaatcacgtcagcgtgtgatctgtatgccatgcatgtgtgcgtgccttggctataaaatgctttttctttcttattttaaaattctcttccctgagcaataatatgtgggtaagaagggtatagtttggagaacggtaaaagagaaaatatactttgtcttggtcactgcccgggaagtctgctctgacaggaggggtgttattttcagctctactagagtccagcttttgttctgagtcctcttagacgtcctccagggagacgagtgctgctcaggatagtcgacatatcacagtcccagcattcaggcaggcctgtgatggcgatcacaaccctgtccgcctgcattctctgtccctctgagtctgaggaatgtgagcaggtgtgtccacctggagcgagggatgtcctgtggtgacacatgactctttatagaggagtaaaacctaaagaaagcatctctcaccagaacaagagggtatgttcgttcactgaacacgagctgtgtcccaggcgtggcactaggactcaggaggggctgtccaccttgattcagccatccctcccagggtaggcccctctgctcgctccccaggacccccttctctgaagctggagaaccagctgtgagcctcacatgctcttgggagcgtggcctcctgcccagccacccctagtttctcctcctggccaccatttaccaagcccaagtacattcaggtgcctggctgtgatctgccgagaacccctgaaatctatatcatggtgtccatttgcatatgaagatgctggagtcagagagggagcatttttgtcccttttcccatgccctcagctgccctccccatgttgaggtaccccagccccactgaaacgaacaaggaggaaactggtctctgttggccttcccgtcacatcttcctgtgtgtgacacagaccagacccccaccttccctagacagttggcccagctcaaacgtgtgcaaggaaggtgctgagttcggaagaggatctggattgctctcactgtgaaattgattctcaaaggttaggcaaatcggctactggagtcctgtggtgggtgggtgggtgtgactttcctattcctgccataacaaattatcacaaacttagcagcttaaaacagcacaaattgatatctcatggtcctgtaggccagaagtccaggagcctcagccgagtctctgctttgagtctcacgaggccaagaccaaggtgctggcagggccgtggttccttccggaggctcccgggagaatctgtttccttgcccactcgggctgttggcaaaactcaggtccctgtggttctgggactgagtttcccatttccttgtgggctgtcagctggggcccgttctcagcctttggaggccacccacattcattggcttactcctcagctccctcttcaatgccagcagcggtgggtccagtccttctaatgcttcctctctcaaacagccttgctgccttcctcttccaaggtggagggccctgtggtggcagcaggtctactcagataatccaggataatcttcctggtttaaggtcggctggctaccaaccttaactctatctgcaaagctcattggaataacaccaggggacaaagatgatggggcgacaatcccacctagcacacctgaacccacacaggctgaacccccagcacccacttcccgtttgagtccaacgggagatacacgtcagcctgagtggtagtgaggtccagaatccatcccacacccagcctgggccagtgcctccgaggagggcaggcagagcccccagctagcggtacctgccttgttgccctgtgcagtaggccttgggcggtcaagaacatgccaggttgatctgcttcttcaggaggacgtcctggtggagaacccagcttatgacctactggctaaaggcagaaactctctctgagccacctgggtatctctagctgctctgaagtcagggggtgacttaggggtagctagtgtggactctgatggttttgccgtgggtactctcggctgttggtgacaggccacaaagtccggcagacccagggatgagggcttgtggggtgcgtcttggtttcatgttgttttaccattttttccacatgcgcttctgcagtagagagggaaccagctgatctattattatcaaagcgtacggtctgtgctcccagctggccttcttgcccctgcctgtcttcctacaaagtgatttagcagggagcaccagatgttgtggaaacctgtggttgccgagatgcatttgcctaacaccttatttgttcccgagacccagggtcacgcttgccagttagtggcacctgaagtagcccagccttctccacagagtgagttagcctgtctgccatcactgcctcactgtgcttctctctcccccaggtcaccacggatctgcgtcagcgctgtaccgatggccacactgggacctcagtctctgcccccatggtggcgggcatcatcgccttggctctagaagcaaagtaagttcccacttacctttttctaaaaaaaaaaaatgtttagattgtggtaaaatacacatgacattggccattttcaccctattgaagtggacagctcagcggcattaagcacattcagtgagtcgtgcacctgcaccaccatccctctcccagagcttcgtcttcttcccaggctggaaccctctgcccgttaaacagcagctgcccaggttagtcagctcaggctgccgtaacagagtcccacggactgggcagctcaaacaacagaaatttagtttctcaaagttctggagcctggaattcctggatcaaggtgtcagcagggttggtgtcttcttggcttgcagaaagctgacttctccccttctgctgtgtcctctttttataaggacactggtcatattggattagggcccaccctaataatctcattttatgttaattacctttttaaaggccttatctccaaatataatcatattctgaggtactggggcctaagacttcgatgaatacattttggaggggacatagttcagcctataacactccccattgaccccccgccctagcctctggcaaccaccattctactttctgtctctatgaatttcattgctttaggtgcctcatgtaagtggaatcacacaggatttgtccttttgtgcctggcttatttcacttcacataacgtctttaaggttcacccgtttgtagaacgtatcaaaatttccttcctttttttaggccatcctgatgggcgtgaagtggtttcttcctttcttaaagcccaagtctcctgccctttgtaggacacaggggctggctgggccagagtccaaggcctgcctctgattctgcacctcacagcaaatccacactttaggttgcgctggcttccttttaggaactttcatttataaattaacagtcaagaaatctcttgagttgcgtatgtgttgttggttcagaaagaaaagcaagttaaccgcacatggagtcatagagtcaaaaccaaattgtactttagtcaccaaaactggcagagaacaaaccagccctctgcagtagtcatctgttgtagatgagttttcaaataactcaaaaagaatggttgggatgcctcaatgcttgtaattacgtgtgtttgcatgtggatttgcacaagacaaactgagcgtaacactcaaatgctaccaatgtaacaaaggaacagtttgatatttttgatttccaggccaaaatgttagcttctgtgtcctgaggctctttttaaaaattcttcataatgagttgcttgtgtggaaactcacattcgcatactttacccttccttgcgctgtattttcctccattccttattggaaacatgcaaagagctaaatggaaaacaaaccctgctccggggcgcattgtccccttaaacttggtcagtgggcatgtgaaagctcagacggtcatcttcctcatcatgttagctcctcctcagacacatacaggggacggatcaggcaaacatcatttggaacaatgtcagtctagagcgctcgacacttacaggattggtcaaggaaggaacggttgatgtctgggaatttgaaaacctgtgttgagcagacctgtagcctgggatagctctcgcctgtgcaggttggccccaggccgccttctctctctgttcactactgctgtggaaggaactggggcaaagccagatggttctgggtggagatgctccctgagagtctggggagggcccccagacagcgtggggccagaatgaaggaaaacccatacgtgttggaattctctaaagggagtcccatggttttgggacagtcttggtacttttcaaacatccgttcttcatcaaaaaacattttcaacatcctctcttagacatattttccatgcggttatatttgtgattttattgctagagtcaaaaataaaatagattttttcataagaaaatggttcctaactttctcactccctggacccattctgtcctccactccaaaggtcatcccggcacctaaattcaagatttccaggaggactggctgtagccgtcttcgagtacgccctgctgacacacagcagtaacttgccaggttgcacgggcagcatggggtgtggccatgtcagcacttgtctaaactccaaagcctgcacctgtgacctctctaccagggtgcacggccatgggctactcgaggcctcagaatctcccctaacagtgaggttggcgtgtgggccgcaggaaggccagtggatgcaggaggagaacaggtgtgcctggcagggaaagtcctggagactgagccactggacacggacggggagagacggtgaggaagccagtgaccagccaggagcagcaagaacacattggagaagtcaggggaggccagggctggagcctggagagtgtgagcccagggaaggagtatacccaagacttaacgccatgggtgagcttctcgtaggaaaacaggcaaagagggggccgagggtgggagtgtgcagagcagccgccatacaaaacagtgtagcgcgtccttgaaaaaattaaacagactccccagacgatcagcaatcccacttgtgggtgatatccaggattgaaagcagggactcgggtagataccggcccagccatgttcatggcagcatggttcacaacagctgaacggcgggagcaacccgagtgtccatgatggacgaagagatcagcgaagtgtgctctgtacacacgtggaacattcagccttgaaaggaaggagattcggatacagattatgatgaggtccctcaaggacgttgtgctaagggaaataagacaaatcctgtgtggttccacttacacgaagacctggagccatcaaactcatagagacagaaagtagcgtggtgcctgccaggggctgcagaaggagcgatggggactgagtgtcccgtgggacagagtttcagtctggaggtggtgaaaagttctggaggtgggtgtggcggtaccagagcaatgtgaacgtccttaatgctactgagctgtacctttacaaatggttgaaatgggaaagtttgtgttctgtacgtcttcgcacacccacacacagagtgggccactggagagacgcctgtgacatcccagcaggtgccactggggaggccggggcagctgggtacttcagctctctctcttctgcgtctccaggccccctcagctgcagcagctcccccgattttacttagtccgtgttcctagggtcacattccctgaggcagcacctgtggcgcggcgtgcgttcctagtaaacacgcaccgagagcacggtgtgcgttcctagtaaacgtgcaccgagacaaggctggggcttgtgcttctggtcacctgcatcccaacgagccctgggaagatggtctggaaggaaagagtatgtgtttgtgatattagggagtgagagtcttggactcgagagatgttcgtttattcttggttaattttctgattgaatagaaagtcctaggtaggcatcaatttaaccgactaaaaaaggaataaaagatctataaatatttatctgtcaaatggcggccggaaccatgagcccatacatctttcttttcactcagctgtttgatagggcaaaaatatattcctttcattactgattcacatgtaggtgttatctttaccatgttttaaagcagccttgcagaaagcttgtatgttcaaatatccaggttgcatagcatttaatactgattagaagaaaggaacaatgctcttattttatactattctctgtgtacagatagtatgaaaaatactatatttcatcgaatccaagatgccataaagttgtaagatgcacctttttatgtaccacagaaaccagaagtgctgccattatacaatgcatccatatctcttagaatttttgtaactattgaagagttcttttaggctgagagttatttagacctggaaatgacactgtgaatagacaggaccaagttcagcacctccaggcaatgtaacccgttcctggttgctgtgggcagaggggcttataagaggtatcagatcataagatggatctggatttcagaggtgttaaaaaaaagaaaaaggtgggccaggtgtggtggctcacacctgtaatcctaacactttgggaagccaatgcaggaggattgcttgaacccaggaattcaagaccagcctgggcaatatagcaagacctcgtctctacaaaaaatgtaaaaaattagccgggtgtggtggtgcacacctgtagtcttagccacttgggaggctgaggtaggaagactgcttgagcccaggaggtcggggttgcagtgagccaagatcacaccaccgcactccagcctgggcaacagggcgagaccctgtcttacacacaaaaagcaggggtgagcaaatgtgtcttagaaattttaaaaaatcatctgtgtatttagttacattagtggcatgttgtattcttttgatgaaatgtttctacttccccaaaaagaatattttgcaaatttagaatcatatataaaatcttgaattataatctacagccagtgggtccacacaggatggaatctcggccaatcgtggtttgaatgtactcttatgcactgttgtatttgcttaggatgaagaataaccccaagtatttaataaacatttactattatgttaagtgtcttgtattttcagaatttcccatatggctctgggcaaactcaggcagagcttggcagcaaggctaggctttaatgcttatgaattttgggtcacccattgaacctttttttccctcaggatttagttgccggaaacttgtttacaaagaggtggtgaaataaacccttgccaaggaatgcagtccttagcctgaggggcttgctgaagttcagacgtgggttggctgccgaccccctgcctctgagtggcctgtgtggctgccgttgttgagctgtgtggactctagggtgtgttgtgtcattgcagcagccagttaacctggagggacgtccagcacctgctagtgaagacatcccggccggcccacctgaaagcgagcgactggaaagtgaacggcgcgggtcataaaggtgcggcagtggcgttctggtggaccattgggtggccctggaatgtgtaggaaggggtgtcatgaattccttaaaaggactctccaaatagcattagttgttattattaattgtgtgtcacaagaatttaaaacgcatgtgcagctatttaagaaaagtatcccggaagctcacagtgacattacggaagaaccctcaggtcacaagagtctggggtctcctatactctataactttggccacaccgagacaccacctataccaatatttactcatagttctctttaagccaggagcaatgacgtgtgcctatagtcgcagctactagggaagttgaggcaggaggattgcttgagcccaggaatttgagtctagcctggacaacacagcaggactccatctcttaaaaaaaaaattacttcccccactacttttttttgacataaaaaaatgtattttaaaaggaaactgtactacatctagttaatcataggtttgatatgtagttacgtattttttctaatgtgcattaaaacaaatccataattattaaaataaatgttgtttgtgtgccacctgagggcagcttgcatccttagccctgagtagctctgtgattttgaaacttgccttcagtttcctcatctgtacaatgaggacattgagatagttttgtaagttactttctaactgtaaaacttcttttggccagtccctgtgttataaaagtaaatcataggacagtggggcctctaccctcagcccagcctggtacagacctaggtaccatgaaatcaacccagggtcagggcttcgttaggctggctgttggcggcctttgaagcaggtaattttaggacagtgctactggctttgtttgcctgacttctttttttttttttttttttttttgagacagagtctcgtcttgttgcccaagctggagtgcaatggcacgatctcggctcactgcaacctttgcctcctgcgttcaaacgattttccttcaaataatccctcccgagtagctgggattacaggtgcctgctaccacgcccagctaatttttgtatttttagtggagacggggtttcaccgtgttgcccaggctggtctcgaactcctgaccttgtgatccacctgccttggcctcccaaagtgctgggattacaggtgtgagccactgtgcccgacctgtttgcctgacttcttatcaggtatactgaaaaatatttcatttggccgtagtatttatgttagggaggaatttttttttaaccttttctgaagctcaggtctaactaatttgacactaagtctgatactactatctgtaaaatataggtcaagcatagttaccctaagtgccgagggacattccttttaataaggaggccatcgattgggctagttcatctttgttttgcaggaatgtcggtggtagtggtgtactgtaacaagagctgacccacattttaattctggcctaattaaataggagaatagattgtatgcagttcttgaccttgcctcttaaattaaactttgaaagtctcctgccctggccaaattaaatactggaccgggccagttcgcaagcctgtctctgtgctgtgctgttttcccggaatgctctgggaactcagcagggaaagaaaatggcaaaaaagatgagtacagccttgtgttattgcatttcgggcacgtggtaattgtgtgaactgagaggtctcagattttgtttctcttgtctggtcttagattcagggagcatagatgctgacaagcccttttaatgtaaaggaacctgtctttgtctcaaaaaaagaaactcctagaccttctcagcacttctactctgtaccaaagcgggacgtgtttcctgacccacactcctaaatttagcagaaggagttgggttcagagagagtgaggcagctgggacctttgagcagccctcagggggacccgtcctgcagcctggggcccccaggagacctcgagtcttacggtccctctgtcctccatggggcccggcagatgcaagagccagccttgctcccttcctgggagaggcaggagagcctggctctgaagggcctgtcttttcagttagccatttctatggatttggtttggtggacgcagaagctctcgttgtggaggcaaagaagtggacagcagtgccatcgcagcacatgtgtgtggccgcctcggacaagagacccaggtaaggctctgctgtggcatcggtgacttctcaggcacgtgggtttggagctgactctgttgtaaggtgtggctgggggaggtgttcacacatgcattctgtgcacatgtgcgtgtgcacgatgcatgcctgcacacgtctgcgttttctcttgtggattgtacagctgggaaaggaatcacttcttaagccaccactgttttgaggcctcttccccttttgtagcagattgctccacgataggggatcagttcctcagcctgaaccactcagcctagtattggaaattcttacccgtgtttagcatgtcagcccaagtcaggaatctgctcctcccagaaagtgaaatggggagtagctgcaggtgtcctttctgtcaccaccggctagagattggagctgtagccccagcccagcctaactggccctgggagtctgcagtgtgaatccaccaggcctgagcaggagcagctgggtcagcctcttctctgttgcaggttgtggggtactgcttattattcacagagcatagcagctttgtgtggcttttatctggctccgtacaaccttcttaaggcttaagcgctgggatttttttaacaaggctcgagcagaagggccctggcttcatctctctcccgtgagcagggcacacccggaactgctctttggagtaagtgtttctaaatctgttatatttgttcattgattgattgattgattgattgagaccgagttttgctcttgttgcccaggctggagtgcagtggcatgatcccggctcactgcaacctctgcctcctgagttcaagccatcttcctgcctcagcctcccgagtagctgggattataggcacccaccaccatgcccagctagtttttttgtatttttagtagagatggggtttcaccatcttggccaggctggtctcaaactcttgacctcaggtgatccacccgccttggcctcccaaagtgcttggattacagatgtgagctaccgtgcctggccaaaatttttatttaaaaaaaaaaaagcagccataaagtaaatcagaaagcaagaaccctagcccactaggagaggaaatcagattattccaattctgccatcgcagctgtttttaaggagaacggtgtttctctgggccttgtatctgatacagaacggagtgtgtttttcccataactacttgttccctttggaaaacgtgtttgaaaaagaaacagtgtgatgactgaaagtgatatatttctttatcaacaaatacaggtcactctctttagatgctcttccttgaatatgcctctactcttgtaatacactcttgccacaaatagttgagaaaaatgtgtctggtggagggctcgcatatggtaggagtgcagagagtgtgtgttggctgagcagctggatgaatagccacagaaggatcttttgaaaaatcacctttttctcccgtggctaattgcacactgaccgctgagtggtcactgcaggccccgacaggtcggccagacacctgacaagcctcagtcttgacttcttaaggcgtcggtttctctgaggagccttagactgtcaaatttgaaacaacgtgggagagtctctgagataaaggaggttttgccttctctgtctttgctggaaaacgcctgcagcctggaccctcagaggctaggtgagggaggtgggctcctgggtctggttcctgacctgggggctgccctctgccccggcgcctccgctcgtgtccccgtcagggcggctcctgaatgaagcattcttctcctgccagaaatcgttttaagatggcagagtggtgcctaggtggcgagtggttgtttttatttttattttattttgttttttaagtgaaagcacacggagtctagacagcacaggttgagggagcccgccgtcacatacagtgtaacattgttcctgtcctttgaggaaagtaaggaccctccaaactccaagaggagaagaatcagacttctgtttctgaagaaaagtcatctttacctttagcagtttcagactctttctgggatattcagccagcctaccgtctcacaccacttgcttatcagatcacttgcttaactctgtaacgtggttgttgcagaggacatacgggcctccagagagaggggtgttaccaagcagagttccatgcctcacgtccacctgtgggtctcccctcctggcagggagctccagccagctctgccactgagcctgcctgcaggtcggggtcatctgcacctgagccgcgagtatccccacagctatgcgagttttccccatcggggttcccagctgctaggatcacgtggccgaaaatgaaaaggaagcgttcccacacagccattttcccgtcttcttctaactgccccctctccgtgcacgtttgtgggtccagctgtctactctcttggcctcattctgatttcttcctctcatggtggaatcctaggacttcctgaatgtcctgaacctgccctaagctgcttcccatggtgaagagcagagcaagagggaagacagagtgtgtgtatgcctctttatacacccctctcgtgtgcatccgtgtgcactgcgtgggatatggtgactgtcttttctcttgaacaggagaggatgctaccctggtgtgaccaaaggtcagacagctgtgttcactggatgttaagcacgggagtcctctagctggggcatgtgtccacacctgtcaggtctatggtgacgtcacacatggtcctgagggagaggggctggggtgttcatacgtccacccctctggtcacgggcaggggcaggaaacctctgtctacccccagccgtgggctggaatatggccatggttcagggagactgtcctcatggcggtgactgacaggaagagtcaaatgggctaccccttctgcatgtccctcctgtgcacccagcctgtgctcccaaactagcattgcatccagggccccgaatgactgcacagagctggtgccccgtcacccatggtgtccccctgcggagctgctgtctccaacgctgccccagtggctggcatcacagccccgcctgcccgagtcatgctcaggcccaaaggcgcggaaaggccaccagcacagcacaatgcgggctgcagaggaaggagctggggcggtgatgccagacccaccagacacagtccccttcaggaggcagctccgtcatttgaaaaaaggccatccatggtgtgaaaaggactagccaagaggggaccccaagtgatacgttggcatttctcacctggacactgcacatctggggactggggggtttgagcctgtctgtgtatggatccacccgaaagataagaagaagtccctggaagggtagagaacatcagggaagaggggacctcaggtagggctgggcctgggtgagaatcaaggagccaggccccctgctccaaggtaccacgggatcgtgctgggcagtctctttactgcctggtgtttaccctgccctagagcagtctgagccccagaactgaggtattgatgtctgagccacctctccaggagcccacacggggtagggcccatcataggctttcaggaaatgctaaagctaaatgcagaggcgagaggaaatcacttaaactgaatggcagctgctgttagcaaaagagagtgacttgctagagtcctccaggatagcactggatgaaagtgccagctgtgcctgggcctctgttgtgatcgtcagaccgtagaccagaggcacgtcgacctactcctgggcacaaatggtttccatctgtttagaacctttgtcaattaaacgaaggtacataggatcatgaccaggggcatctgcctgtgcaaaatgattttaaaatctgtgtgtattaaatagaaagataaagttgatatttttatatcttttcttcaaatgaaaaagaaaattaagcttagtattattccaacgaatgaaatagaggcccagctattaaatattctatttgactcttgatttttctagccagtgcttctgtcgctgctttgaaaatccaggcttctgggaaacagtgtatgatatgcatgactcccacctcagtgctggggacactcacaacaacagggtcttttaaaccaacacaaagcgataacttacctgcacgtctttagtttctgctggtttggaaggttactgtccagacagagcttacagtttagcttggcctgtcttttaatgaactcttcacacacccacaacccacacaagacacttcagacccaaaagccaatgtgttgctttgactatcaaggcttatctgtagagcagataatctttttatagatgttcaggaattaactctggattagccgcatatcacctgcttttctggaatttcgtgaaactagactgcgtatggcggtcattttaaaacaactctatttatgaagacatatggctgtggatgagagataatggattgtgattataaaggcacttactgtgtgccaggcattgctctaagcactttatataaaaatccccaataaacatgtgaggttggagttctatctttatcctcattttatggaggaagaaatggaggcagaaaggagttaggaacttaggcccagaggtggggtgctgtggggctgagctgctcccgcaggctgcttgtctccagagtccaccttgcccccctaggtaggagctcaggcggtactgagccaatgagagcgacctgcccacccgttagaagacctcacctctgtgacctctgtgccaggagctagctgggcgcaccacctccagggatgataaagtacctgaccctggctgcccagagcttcctccggccttggccaggtgccagtgcctaagagcacagctgctggcgtctcatctgcggcaggtcagctgggcaagctggtgaggccaggagcccagcggcctggtggagtgccgtgcggatcagacacaggtcaacccagctctactgtgctcaagcacacagcctgatgtgacgtctttttaggaagccaagagccctcgttttctttgggctgtctcagaactatgcaggtgtctgccaccctcccatcccctcctcaccttacccagcctctccctccagggcatctgacctctgtgtatacctgggtaccacaggaggcccttacttctggtttctcctcttgggctgttgttatacagagcatgcctgggtgtcctcagaagatctgtggggtgctgtgcagtcccgccctgggggtaaccacagtggacccacaacacttttcctgcctgctgctaccccttgtagctgcgagcaaacttaaccagctggttatgttcttgcaaccctttcccttcctggcttagttttgaagcaaacttcttttccccaaattgtaaaggctacttatttctaaaattaggatttggaatttgaatacagttgattctccctatttgtggtactgttccacaaagtcaccacgaacactgaagcgttattcctaggagagatacagggttaagttcctgtgagcctccggtcacatttttgccagcctgtccatatagaccgagctttatgtgtatgggtttaaagacagcttatttaacatagatcattggttcattcactttagactcacagcggacagcactagtgctcgttgctggaaccaagcttgtcttacccgtgtgttttctccttaaggcaggtctctgctttctcatgctgtttgacactagacagtgtttcagcactgcacttggggccatttcaaacagtgaattcaccaacagaaaagcacagagccaggcatggtggtttgcacctacagtcctagctactcgggaggctgaggtgggaggatcgcttgagcccaggaggtcaaggctccagtgagctaggattgcaccactgcaccccagcctgggtgacagagtgagaccctgtctctaaaaaacaaaaaacagcacaaaaatgtgaaaaatgtggcactaaatacactgtgaaacagacacttgtttttatttgagatggagtctcactctgttacccaggctggagtgcagtggcgcgatctcggctcactgcaacctccacctcccaggttcaagcagtggtcttgcctcagcctcctgagtagttgggatgataggcacatgccatcacacctggctaattttgtatttttagtagagacgggctttcaccatgttggccaggctggtctcgaactcctgacctcaagtgattcacccacctcagcctctcaaagtgctgggattgcagccgtgagccaccacacctggccagaaatggacacttatttatggcatgagagctgcaccaacaggcggtgttgccttgtttgacctcagctgggagtgtgctcgttgggggactcattatgttaccactctgcacacatctacacatgacaccaaagtgccgcaggtgttagtttgggggatacaaataaatgtcagccaccaggtgaatatgcagatacagcatatgtgaataatgaggattgactgtatattttattttctcttttactccccttcaggttgaattgtagactgttagaattggaaggcatctttaaagccagctaattcagtcccctcatttaacgtacaggaaaaagtgtgctataaatttaagcatgacatattaaagcaccttctgacccaattaactgtggacggcattgtgtaagttaatgtactggattagctttttttttgaggttaaattttatttctcacctaagtgatgtgctatggtttgatcatcaaaagtaattttggccgggcgccgtggctcacgcctgtaatctcaacagtttgggaggccgaggcgggcggatcgcctgaggtcaggagtttgagaccagcgtggccaacatggggaaaccccatctctactaaaaatacaaacattggccgggcatggtggcgcatgcctgtagtcccagctactcaggagtctgaggcgggagaattgcttgaacccgggaggcagaggttaccgtaagctgagatagcaccactgcactccagcctgcggacagagtgagactccatctcaaaaaaaaaaaaaaagtaatttcatgtgaggaaaattctcagtctgaactcatatgaataaggaagcccacagatgaatgaagcagcttacctcagagcctaacgacagtcttgttgagagcgtgcatcctggaacacaggtctgagaagtgacctagaagcctcttgccaccttcacacgggcactgtgtgccctccgacctgctgttttcctattgcttaatttagcaagtctgtcccaattaactcttgccattccattcactcccgttagcgggtctgtgaaagggtttcctggatgaccttctgctgtaatgggcctcagttctttagcctctcctccccaagccaggtgccagcacagcagctggcaggatgctgctggctcctgattctggagggtctctcaacatggccctagaacattcatgggcccagtgaggaacaaagcaagtgcgttgtgcaaggatccaggttggtccaggaagccaacctggggagagggcttcaaggagggagtgagaaatactgacatggagtagcttcccaggtagaacaggaaaagtggagagcttgaggcggagggtttcagcctgtggcccgtcttcctgcttcccctggcactcggttacttgaaaatatttatttttgctattagatagtattatgcattggaaaaaaaaataggaggaggccaacatatctgtggtctggagttcctagggagtcagcagggtggctactgttggtgggccttcgcctcctcaggagaagggagcgggtggagagcatttgggatgaatggagaacatctgaagtaccagagtaattaacgttgaaatgtggctgcgtggcacgtggcatttgctgtcattagagatcttttccaagtctggccgtctccctggcttcaacaacgcacggtctccaggcaggttttgcgggatcatttaactccgtggactcccttagcgtcctcggaagatggctttatgtacatagaccacagtttcagaagttaatagcagaagacacttttcagttactttggggactttaagatctttctaaatcagttttcatcattaaagtacaatgtaggtgtattcacgtgacagtgataatctctgcacattgtttaacttgaaagataaattacttggcagtcgacttgcattttcagcgttaccttagaaataactgtagggtggagaaccacttctgtttttttcattgactgttctactttctgtcttggagttaattttttaaagtgatgacttttgatagatggcttccttattttcttcctggagtttctatctgaaatacagaaaaatttgagcacaatgatcatgaaacattttgaagcctcctcttttatttctcttcttaataaaagcactctaattggggatgttaggttaatggtttcaatagcaaccacagaagtaaaatgtgtggggagctaactgcatgtcaggaaggtggcagcgtgccctcctatagtagctgtcctgggctcccgcgctgccccagaacttacaggaatgaggagtcctggtggcctgtaactgagtgatttagcagttaagagctttcacataaaaactaattgttacagttagccttgttccaggaggctgctgggctcctagcccccaggtgaaggtaagggcatggctttgaaaaccaaacgaagtgaggccattaactcctgcaggagctgggtgctcccgcccccagccagcctccctgcaggcagcagcagcggggctggcggaggatcacacccaacccagccttctttatgcagcggctggagtcccttagcaggaataaaaaagtcagatgcaagagactttcatactctgaaatgattttttttttctaggtgttcgctctgtgggtggggctcagagtggcggggcaggtgagaggtggggcttggttgtctttcacttgtaattaccctgctcccgttctctcatccctgtgccttatcaatgggattaaagcttcttcacaaggattccaggtctatttctagagcagattgatcacttcccctaccgatgagcaattggttggagtgtggggaccgtgtcttcaacttggttaaggcttttgtgtctgtttccccttgatcttgctattcagcactggaaaggtgttgaagtgtgagagtgtagggttattcctggtttttggggttgactgggagctacattttgaagccccaggggagcactgagtaagtctgccggcatagacgtttctccgtctccacaccttgcttctccctaacgtacccaccttacattcttagtgtggggtgaaggtgggggatgggggacactcacctggagagacacatgggccctgcaggtcctggaactccccagagccttctcttgtgttcgccatctaccgcagcgggggctgctggccagtaaacactagcagtaaagcttgggagaaggcaatgaaggaagtcagcatctctagatcaatttatggtgcatgcaaagcgtgttttcaaatacttacagagtctccgagggaattacatcactgtttataactgttttgattgttttttatgactcagggcccagtagagccaagcagtgtaactcctgagaggctctgagcagaacgcctcatgcctcccgggaggagagtccaggcataatgggaaaagcgctccccgtaataagccaagcaccggtcgtgtggtggggagttattaatgtgctgctgggcggcggtgggtctgcactgaagaatgccatgtttcttcagctgcagatcactggggtgggtcgggggctgagttcaaagaggcatgaaccctaatggcctggaattggcaggatggtccagcctggacacagaaacagccttggggtacagattttggatctgcttggtctggggagtctgcttggtctggggagtgtgtcagaaaattctagcaggaaggagtcttgaatgattgaggctttgtttttaccctcagactccatcccatatggtaaagctgccctgagtttgtaaagggaaccatcgtccatttccatgacagggcaggaaagtgaggggaccctgctttctgcaggagatttgggagcacacaagcttggcaccctcgatcagcatgagagggcagcctccgaactccgagctgtgtccttgactgtgggtccacgcgagcttccattcgaggcagcgaggcctggaggcggaggcagtgaggcctggaggcagaggcgtgggctctggggccccaaatcccagctcctccccgcattagctacaccttgggtacagtccttaatttccctctggattaaatgggttaatccttggaaattctcaggccagtgccttatgctcagtgcacagtcagcttgggaaatgtttgctgattgctgttatttagcattgtgacttctattttcaatgctagtcttcggaacaaagtagtgggattttttatttgtttgtttgttaaaacatttaattatttttatatatttagggggtccaaggacaggtttcttacatgcacatattgcagtgtggtgaggtctggccttttagtgtacctgtcaccatggaggtcatactagggcaactgagaaacgagctggccaaatgccaccgaggagaagccgccttctggtcaccaaagggagcccatccctggggacattcacccaagtctgcccaagaacccatcttttattttattttatttttgagttggagccttgctctgtctcccaggctggagtgcagtggtgcgacctcggctcgctgcaacctccacctcctgggttcaagagattctcctgcctcaggctcccgagtagctgggattacagacacccgccaccatgcccagctaatttttgtatttttagtagacagggtttcaccgtattggccaggctggtctcaaactcctgaccttgtgatctgccctccccctccccccactttgtataagacaaaataattgactcagcagcaatgcaaggcagacagggccatcgtccagaggaatggggcctgtgctgtgcaccccacagcactgcccagcagcctggtctctccactgtaggcaagttggagcggtggcagcaggcggtgcctcggcctcccaaagagctgggatcagaggcgtgagccacagtgcccagccgaaccatctttcaaatctctgtaagcaaattccagaggcataaacgtcttcaggacaggtgataaagttcacagtggagcatccacgtgaggcagtcagaggctgctgcggctccccggggcccgcagggccctgaggctgcagtggggatagagtggacgggcgctggagctcctggctgtgtgggtgagacttcatgcttccggtgccaagtgctgagccctcccttctcccccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggtaaggcgaggcaggcgtggggatggggtctgggctcactgagattgaccctgcacaagagcttctgtccagtcttgggcccacagtgtctctgcaaggccctctggcgttggggactcccactggttctgctggcagcttcctttctcttggagacccttgcatgtaggccccaaaaaccttaaaagttgctccctgaaaccttgccttccaaaaggtcctggaaaactttccttttcagagagaagtgacaaaagagttgttgtttcgttttttgttgtttagcggagggatttgtggaattctggctatgccttctttgcttagaagtgcattaaaggtcatttaatcctattcagttggcttttgaatcgagcatgtgtaccacagggagcactgtttgtccccccaccagctctcccacccagtcgtgggctgccctgcagaacctgcaccagcaggggcctgtcccgggaatacagacaggctcgggtggtatgtggggaaggtgctcccaggctgctctctgccaacttctcttgcgctcaggggctgggaattccaaagcttcgcacatggttttttgggaggctatggagtcatttctttaacaaacttagaaacaaggggaaatacattgatgcaaatatatgacttacaggtaattagaatgaaggtgtttatgggaacttaagaggggccagggtattctggtaccttctgtctctttctagctaagaggtagagagagtaaagaaatttcatggacaaatcagcatttccagcttctctcaaaaaccaggactggcactgtgcccacatcatctgcaggaagccccccaggaccaggcctgctctgtcttctggggtgtggtccccttgcccactctgggcccacttgactcctttggtgacctgcctgaggctgtggcccttgtgtaggctatagggagctgcagagattcagaaacaggggctagcgaaggctctcagatggaaccaggcagaagttgggggttgccctttgcttaacccttcccctccccaccactttgtatgagacagggtaattgactcagcagcaatgcaaggtagacagggccattgtccagaggattggggcctgtgctgtgccccccacagcactgcccagcagcctggtctctctgcagcaggcaagctggagcggtggcagcaggtggcgggcccggcaccagctttgtcctcggtgcactggaatcaaccctgaggcagaccctggcaccaagctcagcccatcccacattctcctttcatagcacgagtgtcacaggggcacctctccctcctgccgggaggcccggccgtgctgtgcctctgcctgtgggaggtctcacacgggcacgagcagttcggtgtcagcggacgagctgcagcttttgatgctatgttgctccccgtggtgttttttattttatttttttaaccttaaagattttaaaagtcctcatttctggcatttcttggaaagttggaagctgtctgacaccagccccgtgttcctgcgtgcactgggccggagctgagcaggtgggcgagtgtgtgtccatgtgctccatgttttccgtgctggcagccctgaggccagcaacgggctctccgttcactccagccgcacacctagtggcacccaggtttgtgacccctgactcagagccagagctgggtgcaggcccaggtgatggcccaggttgacggagagcctgtggtgaggctgagaggctggggcagcaggtagcaggcaggcgggtggcagtgaccctggagagttggcccacaccctgctcttccactcctggctgggctcccaggagccagtccctttgcctctctttattcctcatctctgaaaatgccacttcacttatctgtaaacattaggactgttataagacttgagtgtgataatatatgtatccctggcacaggggcctggttgccctacgtgtcctgcttacgtccggctacctgacccacaagaaccttccgctgccccagcctcccctctcccgctcccctggggccctgtttcccttccctggaaactttcctcctcctgctgctgcccagtgttgtgcccttgggataatagagggcaggtcctgccaggcctattgggagccaccccttggctgggtagtgctgtccttgcgccatcaggcattttaaaaactaccctagcccaggaagggtggctcacacctgtagtcccagcactttgaggggccaaggtgggtggatcacctgaggtcaggagttcgagaccaacctggccaactcttgtctctactaaaaatacaaaaattagctgggcgtggtggcacgcacctgtgatcccagctacttgggaggctgaggcaagagaatcacttgaacccaggaggcggaggttgcagtgagctgaggtcacgcctctgcactccagcctgggtgacagaaagagagtctgtctcaaaaacaaaaaacaaacaaacaaaaactaccctgaggctactccagctgtcatctgagtcttgggactttggtttttttccaaggcagattttgtgattgtatcaagaatttgtgttttaggatcaatgacctcctatcctactgcacatcttacttaatttagcagctttatcagtttgccaggttcttcactaagaagccattgatgtgcctcagcacctcagcccttaaaagacagtttgtccttgttctgtccccagtgtgttgggttcagcttggcatcgagtgtgaaaatcagccttgacctttgccatttcttagaagaaagcacaggatgcttccccctcactcttctccattgcaaagaatgttccctagataaacattttcctacattgagtgttcagagaacccccagattggaaattgaatcttacatcattcaaaacttatgtatttcaatttctgatgaacaataaagatgcctatgttaaaaaaaatgtttattccaaaatcgagatagaaaattagactgtgaagaaagaataagaggaaaaaacctggaattgattccagtacagaaagagtcacttctgaggatggcactgggtgcaggaagagattggatgttgattagttgcttcctgtttctgcctgaaccaagtgtgaggcagaaggcccaggggctcaagggtacagttgggaaagaccttcgagttgggaagggtaaagggaggctcatcaggacttgcaaggagggtactgctgggggtgggggagctgtctcctccccccgctctccacgggcccctcccattcccactgaaaagcaaccaaccctgccattgtcatctccctcaaatgcccctgttgagactggatcagccctgcaggtgaagggacagaactttccccacaagcttgagtagctgctcctctttccttatttgtgtctcccagagaacagtgcacacagctggcttgaaatcaaacatggaagtttcattcttgcacaaacaagcactttcaaaaggcgtccttagtgagcactctctgggcttcggtgaaggtaccccagggggacccccgcccctgtctgctttcgtgcatccgggcactggagttatggtctctgtaagattgttgctgggtgggaaggagccagccaccttctgcaggaaattgtcgggactgggggcttctgttggtgagagcttgtaaacatctttcactgggttatatgaaacctgcctgcctgcctgccttcctctcagaatgttaaggaggttcaaggaggtgatggaggagagagtctgtgtaagagcttaaagacgatcacatttcactgtgccctttgccctcgggttggctggggccagacccccgctaccctgggggtacggtccagccaggtcatacagtcccccgagagccctgcttgtgccagcccctccgcccagccactcagtaccagcaccttcatttctgacaccacacctccaattgcaggttgctggatctttccaatgaagggtttacaaactgggaattcatgactgtccactgctggggagaaaaggctgaagggcagtggaccttggaaatccaagatctgccatcccaggtccgcaacccggagaagcaaggtcagtggctcttgggaatctcatgacagcttttgtatctcaagcctctttttacctctgggccttatttaactacggagtctctgataattctttgttttgtgttttagaggtagaattcccataacagaaaattcaccattttaattatttttaagtggacagttcagtggcttttagtacatccacgatgtcatgtaaacgtcagcactatctaattccagaatgttttcatccccacaaaaagaaaccccatacccatgaagcagccactccccattccctcctcccctcccagctcctggcaacctctaatccacttaccatttctttggatttgcctctcctggacatttcatatagatgaaataatacaacacctggccttttgtgtctggcttctttcacttagcatgatgttttcaaagtttttcaatattgtcgtatgcatcaaaacgtcattactcgtatggctaaacgatattccattgtacggattgatcacattttgtttattcattcacctgtgatggacatttgggttgtttctaccttttagctgttacaaatagtacagctatgaggattcatgtacaagtttttatgtggacctatgtttttgtttctcgtgggcgtatacctaagattggaattgtcaggtcatatggtaactctatgttgaacgttttgaggaacagccaaactgtcttccacattggctgcacccttttacattccggccagcaatatatgagaggtccagctccttcacattctcgttaacacttaatattctctgctttttaaaaaattataagcgttctagtaggtgtgaagtggtatctgtggttcttcaattgcctgatgatgcaccttgatgcacaaaagttttaaattatgatgaaattcaatttattttttcttctgttgcttgtgctcttggtgtcatacctgagaaaccattgcctaacccaaagtcacagagatttactcctgtgtttccttttaagagtgttatagctcttacatgtaggactttgatccattttgaattatttttgtatatggtgtgaggtaggggtccaaactcattcttttgtacccatttgttccagcaccacttgctgaaaaatgcattctttacccattaggtgatcttgagactcctgttgcaaatcaactgaccacagaagagaggttcgtttccacactctcgattctgttccattggtctgtatatctatcttggagtcagtaccatattgttttgatcactgtagctttgtagtaagttttgaaataagaaagtgcgagtcctccaacttggtggttctttctcaagattgttttggctattttgggtcccgtgtaattccatgtgaatttgaagataagcttgtacatttcttttttaaaaggtagttggaattctggtagagattggatatgtagatcattttggggaatatttccacattaacaatattaagtcttccagtccataaacttgggatagttttctgtttatttagctcttctttaattttgtttagcagtgttttttgtagtgttgagtatataagtctttcgcctccttggtgaaagttgttcctaagtattttattatttttatgctattgcaaatggaatggttttcttaatttttcttttggattgtttatttctctggtaattcttgtacctttttaatcccttttacttaatgatcaatcatttatttaactagtctttattaagtaccaaactctgatctaggtaatggggttacaaccaggaaagaaaactggaataatcagcacatcttattttgtagttacccacaaaggtctataaacgcctgtctttgttctctgggtcgaatgcatagtaacgtttacagaatgtgctgggatcttgcttttctatgggcgagtttcctcaaggtttgctttcactgttccgtcgttccctgtgcccttttctgtgaagatgcagtctgcttcttggtcaccctgggagtgcgtgagaaccttcccctgccctggttcttttccagttctccataaacaatccaaaagcaaaattaaaaaaaccattccatttggaatagcacagttttaggagaaaagaagagtgttgacttgccttacgtggaaaattgactttaagtcatcaagtcatctacagggatctgggacctcccccagttgtattctttctggttttaaaatagtaaataactattttaagaaagcgttggctgggcgcggtggctcatgcctgtaatcccagcactttgggaggccgaggcgggtggatcacgaagtcaggagatcgagaccatcctggctaacacggtgaaaccccatctctactaaaaatccaaaaaaaaaaaaaaattagccaggcaaggtggcaggcacctgtagtcccagctcttagggaggctgaggcaggagaatggcttgaacccgggaggcggagcttacagtgagccgagatcgcaccactgcactccagcctgggtgacagagcgagactccgtctcaaaaaaaaaaaaagtgttataacaaatcctaaaagtacaaaaatgtaaaattttaaatgacctgaaatttacacattttaatagtggaagctcctaaattctttcttttaaaagccccaaagtgtattggccgagtattaaaagtcaaggtttactcctcatgccagctgcatcctcaagcattcactgcttcgtgggcacaaggcagagttctcatgccagcctgcatggcctgcttgcctgggaggctggtgctgtatgcaggagagcacatggaggctggggctactgctcttgtgtcctcatggcatagccctggaaaccgggcacaccattcaacactctagacctgtgatctttactctgtatcatgagccgaatacaacgagccctacccatgtcccagggcagctttgaggggacagtcaatcccccatggaactgtgcctctgcaggcagcctttctcatgcatctcacgcattcttctctttccccttcctattaggccaacatgcgtgcactgatgcctctcccctgagtccacatcccctccagccaccacccacttctctgctcccctttatggcaaagccggcagaacaagctgcctgccatggccatcactggctcactcccagcccactcccatccactgcacaaaataccggggctcgtcagggtcccccaccgtttccacattgcccaagcctatggtcccatctctgtcctccccaggttgttaaagccagggtctatggttctaacaaactaagcaccctctctggggaccacagggtgcagtggttaagactgggggctcaggagcccttctacctgggggtagatgctggctctaactcttacaaatacctgtgaccttggcaagtcacttagcttttctaggccttggtcttcttatctagaaaatggggatagtacgcaagttactgggttgcggtgggatgaaatcaggtaagacaggctggataccgagagcagggcccggcacacagcgacgttggcagctcaccccctctagaagtgccctcttgcacagctgcagtgatgccacacctgggggccctctccacctcacaggctgccccttgtgcatctcgttggctgatcctctcgcacatacccctgcacgcactcctgggtcctctgctctttgttcccatccagggatctcatccagccccgtgacactgagcaccttgtacctgctggtggtgcccaaagctgcctctccctgccctcttgcacccagacctgctctgcagcagcctcctgcttctgggcatgggtctaactggctctgagcttgtgcaccttagacaaactcccaaactgcctctttcttgctttccacattaatgtaaatagctttgggctgggcatggtggctcatgcctgtaattccagcactttgggaggccgaggcgggtgaatcacaaggtcaggagatcgagaccatcctggccaacatggtgaaaccccatctctactaacaatacaaaaagttaaccaggcatggtggcgggcacctgtagtcccagctacttgggaggctgagggaagagaatggtgtgaacctgggaggtggagcttgcagtgagctgagattgcgccactgcactccagcctggatgatagagcaagactccaactcaaaaaaaaaaaaaaaaaagcttcaccttgcactccattgcttggccaaatcccaggagtgaacctttaattcttctttgtctccttcaccatctgcttccagaatatatctcagtctgcccactgcctcagttcagtcccctatagtgtcttacctcctcattccactggcccccctgcctcaacccctactggctagagccactctccacccagcatccaatgatccttttaaaatataattcagaaaatgatgcacccctgctaactttaatgacctcccacagctcttagagcaaaacccaaatctcttagcctgacctgcacatcctgctagcacctctccaccgtgaatcatttcctgcgcctcatcattgacctccgttctgttcccctaacatgcctggtcttacctccatggggccttggcacgtgctgctccctccttggggacagctgtccctagggcttcccatggctgcagctcagacctggcctcatggaggggtcttatctgaatgcctgtggtggatgtcctacccactctcccaccttacactcctacagaaacataaaggcaggggatgagaatggggaggaataaaaatttgctgagattctgattccacatttagtgggaggggtgatggattatgtcttactcttagcactgatagagacatataaactcaaatatcttcctataatagagagataatcaagatttaaaacaggatgccaaccttccagatcactagagggaaataagagtgaagagaaattgatcaatatgccaaaaaaaaaaaaaaaagagagagaaagaactataggcaaatttgaatagggatacggaagtcttaaataaaacattaggaagtggaattcatcagtttattcaaagaatactcccctccaagaacacagccttcactcaacagatacttattgagcatttaccaagttctaagcactggggatgcactggtgaacaaaacagatgctaagcttacattctggaaggcagaggaggccgtgaaacaagattaccaggcaggaagctgttgtccattagatgatgagaagctctaaggagaaaaatgaagcagggcagggtgacaagggcatttcagggtgtaccgggaaggcctcagggaagggacatttgagtaaagctcaaagaagatgagggggtgagctctgcagacatctgggaaaagggcattccaagcaaagcgttcaggggatgctgaggcccccgggcaggagtgtgcctggtgtgttccaggggatgctaaggcccccgggcaggagtgtgcctggtgtgttccaggggatgctaaggcccctgggcaggagtgtgcctggtgtgttccaggggatgctaaggcccccgggcaggagtgtgcctggtgtgttccaggggatgctaaggcccccgggcaggagtgtgtctggtgtgttccaggggatgctaaggcccccgggcaggagtgtgtctggtgtgttccaggcacagcagagaggcccccgaggctgcagggggcagtgggaagaggagcagaataggacaggaccaggcattgagagcatagggaccagatcgcactgggctttgtcagccctcacagggacttggttggaagtcactgagagattttaggcagaggacagaggtgatctgaacttctgtgttaataggctgacagctggtcagaatagacggaagtgagggtgggagaggaacaaaggcggggaagccagttagaaggtcattgcaatatcaggtgaaggtgactccgacggggcagcatcagtggagtgtatgaagcagtcagattctgaaagcagggtcgagagatgtgtagatggatcagatgtgggctgtgagaggagagagggggcatggatgacttcagagtttttgtcctgcacagtagaagaatggagtcctagtttcctagatctggaacattgcagggggggaagatgctggagagaagatcaggagcttggatttgggtgggttaaatcaaagatacttacacaagtccaggcagagatatgtacctggaggtgagagggaagactgagctagaaatccaaattcggattaggtatattaagtatcgtcagcctttcaagctgtatgagcaatggaaggagatctgtttatataacagtgattcacacgtttggagcctgttgcgtgtgggtgctgagcgagctttaggcttgcagtggtgcacagcacggaaccgcatgccctgcacacctgtgcacctgccacactgcttcctgcccagccagatgctgccatatcagctccctgcttgctgcctgcatggcactcagcagctctggccttggccttagcactgatgggcttgccatctgcagccttccttccttccggtcctgctgtgccctgagagcctcctgctgcatggtgtatgataggtgcccaataggtgttggcggattaattagtccagttggaaccctctgtaaccaccacatgaccagatgctctgtgtgctacagaggacacaggattagtggatacaagaaatacttcctgagggtagccccaaatgaagtcttgacacaggtcgatctccacccctcagcgtgggtagaaactggatctttgctttcagaaggttgagacgggtgcagaataaacaccttgtggtaccttccagctctgaccttctagggcctactggaatttggggggcggggacacattctccagtgtcatcacagagagtatgcacattcctgcaagggcgtctggagtcagttcattccatgcaagctttaccctgtagacaactgccactcctgaatgtggtccagaaacagcaagtacaggcatgcgtcctgccacagctgacgcacggcaagccctccctgctgtgtgtggggaggacgggcgccttcctgtcacccacaggctctgtgcatcctccccaagcacagtgagagctagcctgggagcctgggtcccaccagcatctctccacagtggaaatccatgtggccctcacatgggacactgcagttgcaactgagtctccccaacctgccctgctcacttcattccagggccagcctctgagcttgttgttcagcatggcggctggatcctcccagggtgagggaagggagtgatggagtgaagccaaaaggggtcagaggggctcaaacaaaggccaagcggccctttccaggttggcgtatgggcccagtgcttttgaggttgatccaggataagccctcttcagcctccagatgaatggtacctcttccggctgttcctgaaatgtcaaaatgggaggtctgcgtatcctaacagacatgtctccgatgcattttgcagaggtcctgccatgtgccagatgctatgccagtgctcgggcacagagaggctccaagacacagttcctgcccctgaggagcccacaggctagttgggaacatttcggatttcaggaaccaatagtaccatgcacaagggcccaagggccaccagtgacccagaggagtgccccaagttcagtggagcaaacagggatttccggctgaaagaaacaaggaagggcttgtgaggaagggtctgcctaaggccagattctcaggagttccccagtgtcactttgtttttttttatcttagtagcatagaaaatacaggccattaggagatggcgactgccccaagggtacggctgtccttttgtagaatgaagtgccaggcattgcccacatatgacctgccttactccgcctacccccaggggtgagacttctcagggctggccttgctccccaggccctgggagggaccacagaggggctcagcagtgacgagccaggcttccccacccgatccactgggcaagcgacggggatgtcaggccgagacagtcctcagcgatgacctgccctaactcccctccttccaggggcaggtctgggcccttccatgagtgcagagcagaggtgggagcttcctggccaggccgacataaggaaagggcctgctgcctctgggaggatgctctggtgcccacagaaggcgtcagtgtggatgggggcctgcagtggacgggcattgaggtgtggaggagagtctgagaagatctctatcaaccaccagagagccaggaagcaccccctaggaggaagggtgaaaatccgtgtctacccagagctcaccaaggcactggttatgctgtgcccaaagacccgggacccaacgtaggcattgttcgcaataagacctacccccagagcatgcctgtgaggccacgccaggtgggcaggacggccgctggccgaggcttctcatcagtgcatgggtggagagggaagcccagcctgcctgcacgctatgacgctattgtgtacacagggaggcaggaccagccccagcactgaatgttcaggtcaagctgatagtgcctgttggggacctcagcctgggaaggtgacagagaagacctaggttgccctctagctccaggattcagagctctagaggccgggaaaatgcagggctggtcagccaggaaaatgcaggtctggtcagcatcgtcagcatcgagtcagctgcctgtcagcctcgtcgatgccgaggtatgaactgatctcaaatgggcaggatcttccactccctggttgtctggtgagggtggcctgtgagtgcacagtcaccaccagcctcagtgccaggcacagtgcagcacacacacacgcgtagaccagaaaagcaggcagtcctcacttctctacaggcattccaagaacctgtgcttggggcagggtgcttcgtttctgtggtgttcatttcaatctcctgcaaatctctgcaagttaattgctttaaaagaaaatgaaaagaaaaaaactgctccaatggtgttctgtgtaaaagtgctttaaaatctatgctaagacccaggatttatgaagtaattaagtgatctgactgatgcgctagctccaataatacctcctgtcagattgaacgtggcttaggtaattagttttaaagccatttttaaaggttgagtagcacatcagtcatccattttcctcttcagttcccaggccaaggatctgggtcctcccaggatcactctcttccaggaggcaatttaggaatggaatcgagtgtgaatcctgctttgcagtcttgcagcatttgcagatactaacagctcttcatttattcctgcacacctatattatttatttatttatttatttatttatttatttatttatttattttgagacagtctcgctctgttgcccaggctggagtgcaacggcgcaatctcggctcactgcaacctctgcctcccaggtttaagcgattcttctgcctcagcctcccaagtagctgggattacaggcatctgccaccacatctggctaatttttttttttttttttttttttttgtagttttagtagagacagggttttgccatgttggccgggctggtcttgaactcctgacctcaggtgatctgcccacctcggcctccgaaagtgctgcaattacagggtgagccactgcacccagcccagcacacctttattgaactctacttagctccagatttgggaacactaggaccttgcccctgcagtgcacagtgtgggtgtggaagagggggcagcttccaccgtgggtgagcttgctactccagccgttacgcacagagcctgcaaggctacgaacggagctggcaacggtgcaggcagagctggggcgatggctcgtcctgcagaacatctgtcggagaagtttggctgcatttaagagagttgccatccaaaatgcccgagattttaagtttggacccagaatgcagaaagtgtctattctctgagaaacatgtatgcttcattctcccacgtcagacatcagacaggcctggggttggatcctcctgcctccgcttttcctgtctctctggcctctgcgctgggtctcctctcctgtaagatagggctgtgcagaagtgagacccagaccaagtcactgaagagaggagccttcccagcccgcccttcttgcctcggagcctacgttggtggttgcacctgaacgacaaggcagagcctgtgcacctgccaaggtcaggccagcctccccacccagggccacatcccgctcggcaccctcaggtgcaggaaggtccctgcacctcctcatgacctggggcccccatgggcatgccggatgcatgcaaagtgctctgcaggaatcgagcttggctttgtcagcactaaggggcatctgcatggtgttctcctgttcatgcagcacacacttaccttgtctgcacacctgccccatgccgggtctgctgggtaggcatgggtgtgaggggtgtttccttgttcttcacttcttccaccccaagagcccagctgagtgtgccctgcaggcagtttgaccagggctatgtacagggcccaaactttactgagttggcctagccctccctttgtaaccaggagcctacctaaggtgctggggcacctcccacagtcttcccctgccagggagaattgtgagacatcaatgtctaaatagaaaaaataatcaggcatgctttccaatcttctctctataattgacaccatgtatcttatttcatggttccaaagggttttacgtacttggtattcacatagtaataaatagactgtctgagacaattgatggcactttaaaaaatcctgtgtcactcttgaactctgagaattcactttctccctgattaaaatttcttttttctctgatctttcatctgtttccaaaagagcagcaacccacatgtgctgtgtttttccagattatttcaacagcattatttccagattcccaccaatctaggaaagaagtccaatttatcaaaagaacgagagaggaataggatgatgattagcacctacgtgttctccagcaggcactgggtgctattttatctcgctgttacaaatcagtatagaatcagggtagatgataataaggaattaaagtttcaggaaaagttattcttgctagtgatgcatatcatggtatttacaaatgaagacatgaccacgatgcctatgatttgtgctttaaactattccagagggtgggggtgaggagtgggagagtaggaagagggtgggcgaaaccagattgagaaaaggttggggattcttgggactgtgtgatggggcacggggactcattgtactgttttctccattttatgtttatttgagaatttccattacgtgaagagtttttaaaagcacatgtatgggaaacatttcttccgaagaggtcagaatgcaagactgtctgagagatttacatggcacaagtaaatttaacgatgtaaagatttcattgctttacagcaaatacacttcagttcttcacttgtgaggagtaaatgctcaatgtgccgtgggacacgtagagacagggattttacactttgtttaaagtgtaaaaagacacgtagtttcttttacgtttgactgaaggtgctctagacagttactggacgtgtgtatgggagtgtgtgcttgggtgtatatatgtgtgcatgtgtgagggagagtattgtgtataagtatgtatgtgtgtatgtgggcttgtatgtatctgtgtgtccatgtgcatgtctatgtggatatgtatgtgtgtatatgtgggcattaggtatatgtgtatacttgtacatgtatctgtgtgtgtgtgcatgtggatatgtgggtgtgtgtatgtgtgtggtgcatattggcttatgcttccttttcaagacccagtgtaacacaaggctgagctctagagcggcctgcttctcagatccatcttccaccactggtcattgcggacctcggcaggccatttccatgctccgagcctccaacctgtcctctgcccagggatggtgggaggattaaacgaaacagtgcccgagaagtgctgagccttaccagcatgaacatgattctcttattgtgagtgtttagattctccttttgtggaagagggagctgagtccaagctcctccacccagagcctgactgagctcacctgcctggaaggggcagagcctggtgtcagggccgtcttccaagctcagggccaccctcacctcaacccaacctggtgaggtctccacgcctctccaaggcagtacaggcagcccatagttgatctgatctctttagccctgtggccagtggttttcatgtgtctggcttcaggatatttctggttggatttttttgtttaaagtgttgtaattagaagataaaaattaaatgaaatattaaaagctgggagcctctgctgggtgccagccagggtcggggtgttgaggaatgttgctgctgagaggctgcctcacttggctgaaatccaagagagcagcaggccttctgagaacttgctttgaccagtccacaagagcaggggtccccatcccacctaccggtccatggtccatggactgttagggactagactacacagcaggaggtgagcggccagcaaacacttcatgtgtgtttacagctgctccctgtcactcccacttctgcctgaactctacctcctgtcacatcggcaaaggcactagattctcataggagtgcgaaccccattgtgaactgcacgtgccagggatctaggttgcacgctccttatgagaatctaatgcctgatgatctgtcactgtctcccatcacccccagacgggaccgtctagtcgcagggaaagaagctcagggctcccactgattctacattatgatgagttgtatagttatttccttatgttttacaatgtaataatgatagaaataaagtacacaatgattgtcatgtgcttgaatcaccccgaaaccatccccactgctccccaccggatccccagctgtggaagaattgtcttccaataaactgattccttgtgccaaaaaggttgggaaccactgcagtagaacatttgaaatgcaataggtacttggaatagatgcttggttttaagggtttttcctatagactatgttcctgaatgggaggattcagtatcactgagatatctcttcttcacaaagaagggttagccgtcactttaacacagtcctcatcaacatcgcaacaaaattaaaggaatgcaaggaaaacctattctgaaagaatgggcacagataatagctagagaaattctgaaaaaatgaatgcaggtgtttaactgtgttttttaactataataaaatgatctggcactggtgctggaatagaccgatcaagggaacagtacggatagtccgttaataaagccacagagatatgctaaggatagcgttttaaactggtgggaaaagactgaagtgttgaataagagttattgataattggccaaccatttggaaagaaaataattatcttgatgcatacacataaaattagaaatttctgtctggcagaaaacatcataaaattagaaaaatattcctgtaatctcagcactttgggaggccaaggcaggtggatcacgaggtcaggagatccaagaccatcctggctaacacggtgaaaccccgtctctactaaaaatacaaaaaattagccgggcgcagtggcggccacctgtagtcccagctactcaggaggctgaggcaggagaatggcatgaacccgggaggcagagcttgcagtgagctgagattgcaccactgcactccagcctgggcgacagagtgagaccccgtctgtaaaaaaaaaaaaaaaaaaaaaaaaaaattagaaaaatatttataaaatattttggacaaactcaagtgattcacagatggccttttcacttctgtctagcccatgggttggaaaactttttctgtaaagggtcagatagtaaatgtttgaggttttctggtctctgagacaactactcaactctcccattatagtgtaaaacagccatggaaattatgtaaatgagaggccgtgctgtgttctgacctcactttataaaataggcggtaggtcctggccttagtttgctgtccccactctgccctgtttacatgttcagttgaattgagtcttctgtttcatggtagttaagagggctgtttatttggctgttatatgaggcatcccatcctgtccccattttcccaccacccatgaagttatattgtcctgcttgctggtaaatatttaacaactagtgctctgggggaaattatttatagatattgacatatcacataagttcattataaattttactgatataaaggatgttagccaacaatttacaaataataaaatatacattgcttgtattataaattccatttagccagttgattctcagagactgctttcattgatttttgccgaattctggttccataaccagccgatggctgccatgcatgaacagttgtctttccagcgtaaatattgggtaatatttttgccacagaaacaacaaagacatatgtcagaacttcattcactcaccagggatgggaacaacttccttgctaaattggaaaataattttcaaatactgaaagaatatctcttcagttttgtaagctgttcacagtgtaatacctacagacatgaaacatttttaagttatacctgcagtattaatgctttctccatcactttcttaagcccagaaaatcaacagtaaacccagcccttgtttgtagcatttgtcgatttccatatgggaatatcccgccatggccaatttcaagcttttcacgtgacgtcactgaagacgggttggtaaaagaggggtccagtagccaccatgagatagtgcttcccctgtgtagatagaacagatgtgagtaaccctgaagcacagataatgacaaaatatagtgagatcatgaggaaggggcaatttgtgaatattcattacctttgtttttagtataatttattcaattgtaagcttctataatttaatgtttaataaagactgtgtttaacaaccagctcacaaaggttctgaaaatgttcacaatcagttccgttaagccagtgctggtcggctgcagcgcaccactgcatattgggaattgaacgggtagagggttgtctttctcttgggacaagcacactttaaggggagcgtattcattgcaggaccaaggctcaacgtgcactgctccccacccgtcccagctcctctttatgcttgcgggggccagccactctccagtcctccccaggaatatacgtcgcaaccaggcattcttttttcattggcctcattcttcccagggccggctcagaggccccccggtctaattgccattggtttaactgctgtttaataaatcaaactatttttctgactaaatcttgctaatcagtaaatagtgatcatctgaattctccatatgctaaaaagtcatttttccaaggggtaaaattaaagtaatatttggcataaaaaaattctaatacacaggcagacacctttatgtctaatatctcaactgtagaggttagataatcacagagtgctatactgtgttatagccttaaaatgtagagtgcttacagatcactaagaaatatttaaataatatcactaaataggccaaaatcctgaaaagcaattcgtaaagaaaacatacaaataaccagtaaacacaagatagtcaacatttgtagtatccaaataaaatataaactaaaggccaggtgcgttgtctcacgcctataatcccagcactttgagaggccaaggcaggtggatcacgaggtcaggagttggagaccagtctggccaacgtggtgaaaccctatctctataaaaatacaaaaattagccgggcatggtggcgtgcacctgtagtctcagctactcgggaggctgaggcaggagaattgcttgaaccagggaggtggaggttgcagtgagccgagattgtgccactgcactccagcctgggcaacagagactccgtctcagaaaaaataaaaataaaaaaaataaacgaaaacacaagaaggcaaaatcatgatagaaagccaacaagcagcagttgcagagatggtagaacaaatgtgtgaaacgaatctgtatggcactctgcactcggggccacagagtgatgtgatttaaagaacgggaatgcaggggcagaggagcctgggtcccacgctggctgcaccggtgacgggctgggagacctgggactgatgactccctcatcagcgtcttaccagcacctggtggacatgaaatttctcacgcagcctgtgtaggttgtcacagaagcccaggctcctctcccctctccctacctgccactgcaagtgtgtgttttaccacagcctttaggaattggtccatttgctctctgggaaaattccagcctggagaagctggtagagacctgcctccatgcctctgaggaaaatcaaattggctgcgacctctacagaacccaggaatttggaattcactgaatccagggttgctgcgctggaggcaaagctgggctgctattgggttggctggccctaagggaaaactcttctgacttttgaactcagcaggtacatttctattcttcctttcttcttcttaagcaacacttttcccgagaaaaacaaacaaaactttgctaaccaaaagctttgtgttgaaactgccaggaggagatgataagccaagcattgccttggctcctcaggacttttgcaggcccccggggcagagccattcaggaagttcccacagggcttggctttctttggagctcagcccagtgcacctgactctaccctgtgcttctgtggaatcccagctttggttctgtccttcccagaaacctgaaagttgaagccaagacaggatcaaggaaggtctagtcagaactgtggtgcttttgccaaaacttgcagaataagctatcggggcacagatcagttacgaaaaccaaatctgacccgttatccaggcgacttgagtgagaggagcaggagggtggcgggaggagaccaggctgccgcagacactggagctcctgaacgggatttggacctcagggtggtgtttagggagagcccagagcagagcagctggcaggcgtggtctgagttcagctggccgcttcctggcctggtcacggaatctctcagtctctgtttctgcacgtgtgtgatgggaataatagtgtctacttcaacgggcctggggagattcaaatggaggaaggtttcatatgaacaaatcctttatgaggagtttcaaaggtttcaggattacaatctttgtccatagtgcctataacatcagaaacaccaagaagtgtttcttgatattgagcttccttgaagccaattacacatgtcagttacatatcgaattctgtgttctgccttgtgctgtgacggtgtctcacgaaggtgctgctatacctttggaagactccagaaagcccagggaagcaggttcttttcaaacatgatagttcacacttcatacctcgaagcatgtattttgatgacgttttactccgcaaatgtcacactggccccactgcgtgtctccccagactggcccagccctgctgtcgtcaggccttgcctgttgcccagtaaagagatctagccctcacttccttgcctcggctcccccagcctcccccacggtgaagcctgggcgttggaatggctgctgacgttcccaccggggaggagcagcggaggcgcaggggccggtccgacccagcgggaccccgggggggcgggggttgtggcttttccctccacttccaggtgaggcttggtatcaggcctccccagcatctggctgcctggagggggcaggtaacacaacccagaaggaaggtttacccaaggaaagacaggacataaagtgtatgcccttcctgtctgagggcacattggtctcacaaggcctgtttggaagacttcccccagctaagcaaccaccccgtttctttgtggagctgcagccagcttgaaacacagctccttccatttgtcaaccccgggcgcttcctcctgctgccctccactcctgttgccctgggattgcacctcccaataaagcttcagcccatgggcttcacttcagtcccttgttttccagggaacctggactaaaacacgtgttccggtggcagattgaacaagagctttggtaatctctgtgaaatactgcagagggacagatgaccaaagccaccacatttagaactttggctgcctttggaagtccagagctggatctctcagctcccgcccccagaggctcagcactttggacatggctcacaaacagttgttgattgactgcatgaatgcgtgtgcgtgcaagcatgaaccttgtttaaatcaagagcttacataattttaaccagttctgtcttcagctgtacatactcagtaaaatgtttaatgaaggggaagagattagtctcttctgtgtgaccatgttttccctttattcatcctaaaaagttccatgaattcttgatttcctttcagtggccctttcaacaatgtcttttttcccaagagcataactgttctcattttattgctagccatcttgatctgtgttttattgacatctcttttgagctaatcttcatttctaagataagagttgagattttgcaatctgtgttcgatggctcaatctatcctgtgcttgatgctagaaaggaagacagatttaaagcacatgccttctgtgccggctttcaagtttgtcactaaactctcatttctggaaagtgcaattatagagtatcactcccacttccttggaaacagagctgaagaacttggcacactctccaaacagtcaccatacacactgttgtcaaaaagttccatttttaaccccatttgcattaatattgcagtcaatctctttacctccttttctctttcacggggccgtgacagtgacgcctttccccaaaactctcctcgtttgagaaaaaaagaagtatgtatccccacttatctcggggagaaatgcaaccaactgctgctgtgcacatttatgaatcacagtattgtttagtcggttctgtatctccagtagaaagcataacaaaaagatgacctttgtctcacctcatagctaatttttgcaaataaaatactaaacattgatgaaaatgaaaatgacagatctgaggaagagggagagctctcttgaaacccctttcccagatttgccctcagttttaggaatgaggtacgcttgggcattcctgttgcctgcatggttcggcattctggcagccaggttcgccccagaatagataagtgtgtttgattttcgaacatttgactttattacctatttccagaaacacttcgtgttcaaactacgtctctacaggcatttctacttggtctttttctcccctgacatttcacagagtcctaactgtgctgcatgtataacttgttctttctttttgttacttgcatagcaagcatgtttctatgtcattaaatatcctttgtaagcagcattttatagatttttataatacttcaccaacagaagcaccataatttatttaagcatctctctattgttggacatgtagattgctttccattttttcctattatgagcggacagcttagtacaaaaagccttctcctgaatttaaaattatttctttgggattattcaccagaagtaaaattactgggataaataagaggtggaaaccacaaatatgcctgcctttgatacatattgccaatttgcttttcgaaatagttgaactgatttgtagtcttaccaggagtgggcagttctggaggaggtagatgatacccttccttaacttacattgtgatcattactaacaaaggtgaaccttttttcaaatgtttgtgcactgtgttttttcttttgaaaattgccctttctggcgtggtggctcacgcttgtaatcccagcactttgggaggccgaggcaggcggatcacctgaggtcaggagtttgagaccagcctggccaacagggtgaaaccccgcctctaccaaaaatacaaaaattagccggtcatggtggtgggtgcctataatcccagctactcaggaggctgaggcaggagaatcacttgaacccgggaggcggaggttgcagtgagccgagattttgccacctcactccagcctggatgacagaacgagactccgtctcaaaaaaaagaaaaaagaaaattcccttttgtctttcgcgagagcgctcagtgttgctatcaagctgataagtatgtagtctgtgtaaaatattggtaaaatattggtgtaataaccctgtgtgtgtcgtaattcatataaattttttttctggcctgctgtttcacttttgactttttaaaaataattttaaatttcccctccagagttttgataattatttccttttttaaaaaagtcccaatttgtttgattttattttcttcataatctgtttgcctttttttcagtctaaatattagtgtctctaaaaaataaataaaagatatataaaactttttctaagttgctaacaaattactccaaaacaaagtcaagatcaaaatgttaaaagatgtcgtggacttttatttccaacaacagagaagacaagtgtcttgaaatctccctcccacagaaaagaattttaaatgttggttgaaatgttcacagccaaagaggtgaacagaatcatggtccggcttttgcttgaaggcatctgcttcatctgtggagcccacctagcagaccacataacactgggacctcaggggcacccaaggaaaggagacacagacaaagctgtgtaactagaacccacaaaacaagtgcttacaaacaagtccaataacttcagtagtttcactaaaggcatacagactcgttgctccccttgagagacaaaaattgtcatattggatttttttaaaaaatgtatttaaaaatgtatttgggaggctgaggtgggcggatcacttgaagtcaggcattcaagagcagcctggcctacatggtgaaacctcgtctctactaaaaatacaaaaattagccgcatgtggtggtgtgtgcctaatagtagtcccagctactcaagaggctgaggcaggaggatcactggaacctagaaggcagaggttggaatgagccaagttcatgccagtgccctccagcctgggcgacagtgagactccatctcaaaaaatacaaattaaaaaaaagtattttctgtagtgccaggtatatttcatttacccaccagatccattctccactcctccaccccacagactcccttgcctgtggcttatagttgagttcagccaaggggaaactccagcaggagaggagggagggaggagatatttatttatgagttagtgattctccagtccttcatcagccaaacagaaatgttatggcaaaaagcgttattggagcttcatatgtagctctgtgtatgtatcaatatgtagagggtctatacatattggtaaaaggtttagttcagttctaaaagttccacctctaatcttttatgcaatttataacacagccttaaaatacatatagagcaaaaacttgttaaaactacaaagagaaaatgacaaactcacacaggagggagagatttagcatacctcggatatatttgatagataaaacagcaaaaattcataataatagaagatgcaaatatctcaattgacaatttaggtcaaatggacatattggaacactgtgccaaacaacagaataatacaccaaattttttatttatttatttttttttttgagacagaatcttgttctgtcgcacaggctggagtgcagtgacgcaatctcggctcactgcaacctccgcctcccacatacaagtgattctcctgcctcagcctcctgagtagctgggactacaggtgtgtgcctatattttgtatttttagtagagacagggtttcaccgtgttggccaggctggtctcgaactcctgatccgtgatctgcccgccttggcctcccaaagtgctgggattacaggcatgagccaccgcgcccggccaatacacccacttttcaaacacgaatggaagatttatgaaaattggccacatgtcgagccatttggcaagcttcgatggatttccaaggattggtagcatataaaccctattctctgacattacacttaagttagaaatcaaaatcaaaaagataattagaaagtttccatacatttgaaaattgaaaaatacttctaaataatttatgtgttaaaagaaaaaaacataatttatattagaaaatacttaaaactggatgataataaaaatactacatattcaaataaggaagatacagctaaagctgtagttagacaactttatggctgtaattgcatatatcagaaaagagaaaatcctgaaaattaatgtgctaagcatccaacttaagatgatagaaaaaaaccaacaacataaagaatgaagaaagaaggaatttttaaaatagcagaaattaacaaaatagaaaacaaacatatgtagagaaaattaaaatgccataagctggttcttgaaagaaactaataaaattgataaacttgtaagtagaccaaggaaaaagctgaaactatatgatttcaggaaagaaaaacgcatgattatagatcctatatacattaaaattatgtgacaaaggaattctaagtgaaatgaacaaattccaagaaaaaatacaacttaacaaaattgacacgtttacataaaattaaaattgtcctattaaagaaattgattctataatttaaaagaaaactcaaggccagagcaatttaccagcaaattctgccaaacatttaaatggaagaaataatgtcagtgttctgtaaattcttctagatagtagaaaaatagggaaacagtccccactttgttgaatgaagccagagtttggttttttttttttttgagacggagtctcactctgttgcccaggctggagtgcagtggtgcaatctcagcccactgtaacttctgcctcccagattcaaacgattctcctgccttagtctcccaagtagctgggattacaggcatgcgccaccacacccagctaatttgtgtacttttagcagagacagggttttgccatgttggccaggctggtctccaactcccaacctcagatgatccacccgcctcagcctcccaaagtgctgggattacaggcgtgagccaccgtgcccagctgaagccagtgtattcttgataccaaatcccaagagcacatatgagaatggagaattttcagccaatctcactcaagaacataaatacaaaaattctaagcccaatatcaagaaaactaaatccaacagtattaaaaagatgaaatactctgttcctcttttcctgccttgttttagattaatcaaatatttgtcagcattccactttatctcctctattggctttttagctgtactttgagtggtgctctagggattacaatatgcatccttaatttattacactttacttagaattaatattgaacagctttacacttctcagataaaaggatctaataacagtgtaattccatccccctccacttcctcatttgtgctgtaatggtgttgtatattttacttctgtatttgttacaaactccttcttaaaacagtgatattactttttgctttaagcaatcttcttttttttttttttttttttttttgagacagggtcttactctgtttcccaggctggagtacagtggcacaatgtcagctcactgcaacctccacctcccaggttcaagcaattctcctgcttcagcctcccaagtagctgggattacaggcatgcaccaccgcgcccggctaatttttgtattttcagtagagacaggttttcgccatgttggccggactggtcttgaactcctgacctcaagtgacccatacaccttggcctcccaaaatgctgggattataagggtgttgtcttttaaataaattaagggaaacagctactcttcagtgtgtttactgacatgcttaccatttctagtgctctttattctttcctgtagatctgaattttcatctgctatcatttcccttagcctgaaacacatcctttaccatttcttatcaaactgggcttctggcaaggactttgctcagctttgttttctttgaaaatgtctttacttcaacccatttttgaatggtattttcactggatatagaattctgggttgggagtatttattccagcactttaaaaataccaaatttttaggccgggcatggggactcatgcctgtaatcccagcactttgggaggccaaggtggccagatcacctgaggtgaggagttcaagaccagtgtggccaacatggtaaaacctcatctctactaaaaatacaaaaattagccaggcgtggtggcaggcgcctgtaatcccaactactaatcctaactacttgggaggctgaggcaggaggatcacttgaatccaggaggcagaggttgcagtgagccgagattgcaccactgcactccagcctggataacagagcaagactttgtcaagaaaaaaaaaaaaaaaaaccccacacttttggccaggcgcggtgcggctcacacctgtaatcctagcactttgggaggctgagacaggtggatcacctgaggttcggagttcaagaccagcctggccaacatggtgaaaccctgtctctactaaaaatacaaaatttagctgggtgtggtggtggcatctgtaatcccagctactcgggaggctgaggcaggagaatcgcttgatcctgggaggcggaggttgcagtgagctgagattgcaccactacactccagcctgggtgactctgtctcaaaaaaaaaaaaaaaaaatttgggagaagcacataaatgccttaaaattaaaaatataagtcaaaaattcaaaattcaatagatatgttagaagataaacttgaggaaatctcccagaaaatgaaagggtggtgggggaaagacaataaatattggacccagtaagaaattttgttagaacattgggaggtgggggcgggagagggatcatgtgagtatgtggaagatagtgtaagagaactgaattctcagcttcctaggtgagacatcactggacaatgtctaacatcaagaaaccaggacatagcatatgagtatttttgtctagcaatgtaagggcaaatgccagaaaaataactcaaagtgttaaaaagaggtggggagtcagggggactccaagaggtagaatggagtgaaggaggactgctttctttgttataaaccttgtaagagtttttgactttccagacatttaatttattactttggaaaagctggagcatcttaaaagatagaatgaccttatagatgccattaagaaaagtgctgtgttgtccattgtacacacaggtgatcattctttcccgaaaggatatttgtttaggattcttcgatccttttcctggcatttaaaataccatctttcagggtttttgtggctataggagcacagggaagccttgtatctcccctttcttagcctgggtctgagagttcatgtgtgtatgtgtgtgtgctcaggtaagtacgtgagtgtgggtgtgcatgttatgggtgccttgtgcacacatgtccatgtgcatccatggacgtgtgtgtacatggggagcacacatatatgtactctttttcttatcctcctttccaagccattcctaaattcctttttacctttctcttacttgccataatgtgaacttaaagtgtattttaataatgtgtttattgagtaaaggttgatatttctgtttgtgtgtgtatacatatacatacaatatacacaaaaaattactgtgtgtatgtgtaattttatatatatatatatatatatattgagaaagggtcttgctctgtcacccaggctggaatgtagtgtgcaatcacggctcactgcagcctccaactcttgggctctagcaatcctcccaactcagcctcctgaatggataggactacaaggacacaccaccacgcctggctaatttttctattttattttttgtagaaacggagtctcactatgttgccaggctggtctcgaactcctggcctcaagagatcctcccacatcagcctcccaaagctctgcgatcacaagcgtgagctactgtgcctggcccctacacggtatttttaataatagctttattgagatataattcacatactgtgaaattcaccccttttaaggagtaaattataggagtattcagtatgtgaattataggggtgtttttgtatatttttataaatggatggaagtaagcttttttattccttccgcccaaacctctgcattaacctttgtaacttgaacatagccatgggtggctggttcaccaaatctcagaaggaagaaacttccactggtgttttaaactgaaacatatttacgtgatttttctagggctctcttacttcactgtgtttcaattaaggaatttcttcctgcatattttaagtatggggacatagggggagaattaattaaactctatattgttaataacttctcctatagccaggaaaacccaggaatccaaaagtattagctcagagtccttaatctaatagaactttcccccacccctacttgctttgtctccaattgtaaatttccttcacaaggattttaatgcttaactcaaaatgccaggcataggaaagcttcattattgctggtactttcctgttggcaaattcaaccatagtctccccttaattctggttctttctttgcataatgggaataatcctgtttgttcattatgaatttaattcattgaggggaaatactgcattgaagatagtgaatgatgataaatccatttactggcagcctcagttggcactagctgtggattatcctctgcctctcacaatgacattccctggccttcattgttgacatctggaggcagcctgctggcagtgctggcccaagtgtttaaacaggtggatttgtgattcttctacaggctcaggaatctgatggcaaaaaatttgattgggcatcttttaagaccccctccttttagaaactaaggaactcatggtgctagttgggtatgtacaacagtaaacttgaacaggcttgtagagtatcttgaatagtaaataacacattcttgctaagtggtttgccgaaagcagggtcaacattctaaaatctgactgcctctgggtggcagttctgttgagtgtagaccctggtctggcctgggttgtccctggacacatctgcctgttcttcctccttgcttctcctgcacccatgtggcttaccttcccaaagagaatgtggcctcttgggggtgactgagtgtggaggggccggcctggggagcctgtcctggcacaagtgctgctgctgtggggggccgacactgtggacgcaatgagaggaggtggatgcctcctgaaaactaaagcctccaagaagctcattcctgtgtgtctctgccttagtctgttatcctaagtcacccataagcatctgactctcctgcctcagttaagcttgggctgtggtttggagaagggactgtgtagagggggtgattcttatcaagtaactgatttgcccaggtggcctgtggtccctcgcctgggtattttgcagtcaagcctcatgggacaccaaacactgtggcgggatcatgtggcattgccgttcatgatagacataagtttacagttcaagataagacattaacgtgttgtatcacctgacccagtggttccactttcgggactctattgggaaaaagtaatccagactgcatcaagtaatatttctgtcagatttatgtatttcaaaaaagggaactggactaaacgttctgtcataacctatcataagaggttgttaaacaaatggtcacgttcacagggtgaagtattttgctgtaaaaaaaaatgttttaacagattcattcattcagcaaacatttattgagtacctactgtgtgcccaaaagttgctacacactgaagctaatgcaccaaacaagagagacatgttccctgcccccgtgatgcctctaggctgaaggaagagaaaacagtgaacaagaaaataaataacgtcgaatgcgattaacatgatataatgctaagtggaaaaagaaagagaaaacagggtgctgtgtgttttcaactatgcaagaaatacacatgcataggaaagagcccaggaggaaatatgccaaaagagttataggtgatttatttttatttttctttaaatatctcaacatttaataatttttattctaactagggaaaaagtaattttaaaaaagaatcactcttcaaatttatgccatacactttatgccataggtatggaattctcatttttacgtcttccaaaggcaggaaaaccaaagtgactcccttggttgagaaagtgaaaaaagcatttaagtactagaaaggggagataggccaggtgcagtggctcatgcctgtaatcccagcactttgggaggcacgcggatcacaaggtcaagagaccaagaccatcctggcaaacattctgaaaccccatctctactaaaaatacaaaaattagccgggcatggtggcgggcgcctgtagtcccagctactcaggaggctgaggcaggagaatggcgtgaacccaggaggcggagcttgcagtgagctgagatggtgccactgcactccagccgggcaacagagcgagacaccatctaaaaaaaaaaaaagagagagagagataaatgtctcccagattaccattgtctaaacctaaccttaggtcaagtgtcacaaatcgcacctattagaaaaggaaaggtctcttttggaggcacatgcaggaaggggttgctttggtcccactgcttcttccctgctggcgtttttggagctcccagctctcagctccgcaggttgttagctcagtcagtgcctggcccctcataggctgtcatgagtatcttgcagatcgagagaaagaacaaaaatacaaaccatgtgtgagcaaaacaccatttcattccactggcccttgttacaaatgcagctaagatctgcttctatgcatcttagacgtctcatcccttgttcctagcaaatatctttggtaaatttacaagtttataaattgcttttaattttatcaaatcagaaatttgtcttgctcttaattatatgaaaaggatgctccgtttctcatataatgagagaaatgcgacgttaacctttctgagttatcggattggcaatgtaagccatagctgcaggctgcaagggagcccgttccttttgacgtgtgacatgtgacgtgtgacgagttttacgtctagtaatgtagcctacaggtacacatgcacacagctgaaatgacgtgtgcagtaggtttcccttaatggacagctcctgcgtgccagtctctattctaagtgctttaccatcatgaagtcatttaatctccaaagcaaccctgtgaggtagacattcggagacgttattattatccccacgttacaaatgaggaaactaaggaacagagatgaagtaatttgctagcaggggcaaagccaggttccagaccctgttgttccagggcccttgctctgctcacctcaagtagttgctccctatgtgaccaaggatagagcactatttgtgtagtcgtgtgctgcaaaatgacatttccatcagtagcagaccccatattcaatagtcattgcataagattctaatgtcgtattttgactgtaccctttttatgtttaggtgtgtttaggtacacaaacacttatcattgtgttacagttgcctacagtattccatacagcaccatcctgcacaggtttgtggcctgggagccgcaggctgtaccctatagcctaggtgtggagtaggggtaccatctaggtttgtgtaagcacactctatggtattcacaaaacaacaaaatcacctgcatttctcaggaggtatccccatagttaagctacacatgactataattgccaaagtttataaacaacctaaacgtccatgagtaggggattgtttaagtaaacaacactacatctctcctgtgcagccatggaaggatcataaggatacactgttaatggaaaactcaaggtgcagaaagtgctagcaggtgtgttaccaaaaaggatggggaaacatatgttcatatttgcttgaataagaataaaatgcttcagaaatgatacacaagaaacggggaaccaacattgcccatggggagggagacttcgtcatatgcacttttatacttttgcatttctgagccatccttgtatattacttattcagagacaaaaatcaaaaccccgagtactactgctttttaatggggttttttgaccatacaaccactttattcatagattttaaacattaaacttttaaaaagttttaatgtttatatatgaacaggtaacatatgttgtggttttaacaaaaagtcaaacaggctgggcgcgtggctcacaccagtaaatcctacactttgggaggccaacgtgggaggatcgcttgagctcaggagtttgagaccagcctgagaaacatagtgaaactctatctctaccaaaaatacaaaaagtagccgggcgtggtggtgcacacctgtagtcctagccacttgggatgctgaggtgggaggatggcttgagcctgggaagttggggctgcagtgagccatgatcgtaccactgtactccagcctaggcaacagagtgagaccctgtctaaatacacacatacacacatacacacacacacacataaagtcaaacagagagtgtaataataatgaagtctctcttccattccagtccagcctcctcccatgaggctgcctgtctgctgggtccctgggaattcttcctgctctctttttccacacagtgcacaccactgaccctgagtgtggagcagcccctcttgtttgtcccaccaaaactatatctgaaaataaaaatccagttttggtgaccaggccttttgtgggtgtttttggagacatcctctataattgaaataaacttcaactcaaatgatagcctctagagcccttggtccctgtcctaccatcatcacaaccccagccaatctcagtgcaccacttggtggttaaagtgctcggattcctttgtggtcggaatgtggctgtaactggaccctaaggagctgaggagagtcagaggttcctcaccaggcttgttttctgcacctgcagtggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcgctgtcaccacacacgtaggctgggttaggaactgtgtcagggagggggagctgctgtggggcttaatgaaccgagccctgtggaagaccgtgtgctagaaatgctatgctggggatgctgtttcatgtaggagggccttgcttacctcttccggccctgtccaggctaagggaggcttgggcagtacagaatctgacttgggacagtgtgcaggctccagccttttgcaacctagtacttagccagttgaggctgtggttaaaatgaaacagggctgccacatgccacattgtgtaaatgggtcagtgtcgaatgccatttcgaatcgcaccagtggggccagtcccgcctgtctttcacctgcccgcccacccacccaggatggtgtggattacagcctatgggcttatggtatgaggatgagcaggagctcctgttctggaatttagaaacgctaagagatttccagaattggaacaaaaagtaaagttgtactggcagaggggcctgcattgcagaaacagtgcataggcaggtatgtaaagacagacaggctgccatttagagccagcgggtggagtagcgagcatgggcagaggtaagtgttgagaaaacacagtcaacagcaaagaatcagagcagtattcttcctccccgaaaccattctgattgccaagaaaccccatggcaggaaaggaagaggaagcagggatttttcagccaacagagacattgagccagcaatggccctgtccccagcttgggtcgcaggagacagtcatgagggcccactgagggggttcacagctgaacatgtgtgtgcatgtgtttcctattgagccaatccaattagaaacaaacattgaaaggctggggcgtccgggagccccgtcagcatgagcagctgtccttgggcaggtcacactggcccctggccccctcaactatgtggggtgatgaccttctaaacagtaaccctgctctgaattctggggatgccgtggttaaaaaaaagaagaagaagaagcttaaaccagtggccagcagcagagtcggcctgcagataggcgttaattaattgcatagatgctctttgacttacaaattgcaagttgacttatttcgatgatattttcaacttatggtggattcatcccaacatagccccatcattaagtctaggagtgtactgaatgcatctggcttccacaccattgtaaagtcaaaaaattgtaagtcaaactgtcataaattggggactgtttataatgtgttttataacatcaggaattcacctggaaattgctaccaggattttcactttgcttgatacctgagaacagacagctgcatgggccatcgctccctgtggagctgtcggtggggcgggaccccagctgcccccatgttggctgggagctctcccatcagcactgtctttcctgtgtctgtctgtctctgatgtcccccatggagcctggtgtctgtctactcatccccctgctttcaaagatgttcttcctccacccagcttctgcagacatttgggtttttaccagcactgctatcccccagaacatccctcactgtcctgggctagctgtggaggagagagcccaagactgagtcttcccatgatctaggatcaaggatccaaacagcaggactcctccatgcaacccagttatcacacttggatgctgtagggcaagactcacagccaggcctggcaccagatttacccaccggatatcccaagacgggaaggtggctgctgctaggcatcggggaggcagcatcgagggaggctgcagtgagatcagcagggcagaggacagcctccaggacagtggagagtccagcccggctgacctccatcccagcagggacaggaagcggagggcagctcgatagaacaggaataaaagggcactggcttgcaggaatgagacactgggggaaagcagcatgtggcctgggcaataggtgcacagctggccagcaggtaaccaggaagtgaaggtagcaggccagagcccagctatcaggggaggagccaggcagcatctggcttatttctgtgagtgacagaggtcttggcacaggcaggtaactctgtgggtttggtgccttccagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacaggtaatgagcctgaagtaagaggagacggccagcttccacgagctttgattgtccagagtagctcttaaaatgtagggctgctcctggcaaaggtggggctgatggttgtgtgtctctcttgcctgggagtcataataatcatggcaatttgcactcacacagctcaatccaccccaggctctgctaatattttacagaccagtaagtatgcttcaaaccagtaagtattttccaaccttcccagctgggagagcagggtctatatgcccaaccagaatggggtcttgccccctggtaagttagccacttctaggagcaccccctttccaaaggcccccatctcacagctcagcctcctgactccctcaagtacatccactttcagtccttgaggtcaggatgtgggaaggacacagttactcccaaggatccaggaaggttgggttcaaggagcacagctgggaaaggacttcgtggcagagatcctgaccagcctggaggcctagggttaaagacccagagaggatctcaagagatgatgtcagcagatactgatgcttcacagatgccttgaaaatcttacagcatctaaaaaggccctgcatgaatcgtttttctccaatcatcccattgccaaggtgggccctggtttggggccgccagttcactccacaaggcggccaaaaccacagctgcccagagaagctccagccactgagctggacatggcttttattcgtttgttagactagaagctgttcttctccctctgagccctcctgtagcaatttgtgtgagaagaggtatttctggttggacatattttccttagctaaatactacggctaaatgataaatgatgggtgatatctaagaacactgatgctttaagttatctaatatcttctgtgaaaaacaaataacaaatggaaaattccaccaacacatatcaagtataaattacggtcaattccattttaaatttcttctactattcctttaaaatagagcattgaattatgtatggactaatctgctctgtttccccctgtgatttataaactgtggcaagattcagtaattattaataaggaactgatttttttcttaaaatctgctactgacttcagccttgcacaatggaacctcactgtgataccattctgcagtccagcagtctactgagcagggattaggtggagagagggggtctccatgggaaggagatgcattcctggctctcagagaagccccctcaagtctcaggggtgagtgggatgggcagaccagagacagcaggagagcctattcagagaccaggacagagtgacagaggaggtgagaaccagacggtgccagagtatggaagccaaaggaggaggacgagccacgttagagtccaatgcaaggtcaggtggatatgagacggggtgtgcggagccggccatggtcatggtgcatcaggagtgacgggcccaggccagtggaggctgcacctggactctttgggcaagagagcagttgccaagaaatagaggaagtgagcgagggggacgagggaagcctagggagtacttgcaaatggccagggtcccaggacagcagcaggcaagatggtccctggagaggaaggttgaggaccagagcatctggctgggagaaagggcagcagctgcagtgggcagcgtggggcacaaggaagatgtcagtgctgtggttctgaaggtggacaactttgtggtgacagccaacctgctaggccagagccgtctggtggccaaagtgcaggtggaggccaccccagggactccgcagggtgctgagttgagagcagaccctgggctgtccccccgcccagagactgggattcagcaggtgtgggacgcctgggggtctgcacctgtagcaaccactcttaggtgcctgcaggcaccgtgggcttagggagctggcagataatgaaaccagcgaggatgggggcaggaggcagggaagagcttgggttcctgcaagagagtggctgggaggccaggacattactggcatggaaacacagggaagcctgggcctcaggaaagaagccatggttgagcaaaggaagctgagtgggctgagatcagctcaggacactgtggtcatccacacaggactgcaagggaagccaagaacccacgtggcatcgtctggaagacggagttccagggcagctccaccggtacaggagacagttcacaggatgagggtgatgtctggagcaggaccatgtgtgctcacaggctcagcacatccgtgcttactcgacaggctcaagcagaggcccagaagcctcaggtcgcttgctcagggcacagcagtcaggaaggaaaccagacttgttctcagtgtactcttattctcgtgggcacctcttgtctgcaattaatcggcccaagtcttgcatgcctctcgggtccgatactgctccagtgaggttctggtgtgctgttcttggatggcgtgaacggtggagaagatggtgataccaaactctcctgtccatcggcagttggtctgagcgcgcaacggcaaagcacatggagaactcccaagttgcttctaacatttatttgtttgtgtatttttttaaatcctggatttcctccacaaaggattgaaggtggagttttcaaataaacccgtgtcagtttaagcccatctagagaggcatcagccgctagccaggctgttcagcacgtgaacggagccccccttgtatgaagagacccctgctaggagttacgggaagtgacacaagaaggcagtggggcttggaggaactgtcacgctaattgaggcaaagggaaaagcagacctaagtacaaattgcaacacaaacatcatggttgcccagagaatgagctgcagctggaccagaacacgctcaggcggtggagtgattgggaccacgtggacagcaaggtggatttaatttaagaacgcttcatgggcgagaggaacctggatatttggcttttaaacacaattcaagtggacagccatactggggaggtttgtttacagatattcatctaggcatctccacccttggatgggcatcgtcttaacctgaccggtgggtgacctcagtgcagtgtgggggccctgcagctctgttgaatagcccccaaccttgcactgggctccttgcaaaattatgaataagctttccactgcagagagacccaggaacaggggtggggggtgtgaagtccatacacccggaccagcagctgggagcactgcttcaggaccctccccaaggctgtcctcctccgaggacatcctagaacattctgtctggagatggtgaggacatctgcactttccctgttcctagccaccctcctctcatccgctcagcaaatagtgattgagcacctgctctgtgcctaatgccaggaatctagcagtgaacacaccgaaccaagccctgcccgcccgtctcccattccgtgtctagaaagagtgaaaagattggtctgccgcctccctgtcgcactcctgccctcatcttcttaagatgaaggaaattgttcactttatcaagcaagacagacctgctgcctcctcagggagaagacgctgcaggaaaaggcaggagagaagtcctcaagtcaccacgacagccccgcgttcgctgggccagctgcgagggtgggaaggcgagagcccagtggctgagctggagttttgggctcaatgggtaatttaaagcaatggtgcgagaaatgaggattttggaggctgtcctcatagatgacccaggatgaggtgggcaaagaatccaatcagatgggaattgatccaaaatattatagtaaaccctctggagctggggggaggagtttagtaatgagttttagaaatggtgagtggcatctggaacccaggataccagcaccgcccaggaacagcatctagagtgtcctcgtggatacacacagctctgaaaggggttcacagtgggaaccgggacacgcaaagcccccccagtgaaaactagggaaataacaccagagagccttcggggagggaagccagcctcactgggtctaacactggcaaggtctggagacttcaagacgagtgaagagggctttgcgtgccccagcaaaaccccactgtgggcagcagagaatgaggacttttgtcttttcctcaagtccccaccaaatgaaggtggccagcaactcactagtctttactcttgagctcactccccatcccctctcataactcacacctcggaggaggaggtttttcttccagtaactcaaaagccttcacatgccccacttagtccctgtgtgtcagagctgtcggggtcccctgggccgtttcccagcgtaggagggacaggtgggcagtaggcaggagtccaccccagctgtagcttcaggcgtcactcctgccgaccagcgtggggaggacccctgcagcgtgccccgcccccgcctgacgggtagacctttaacactggcttcatctctgggatacctgggaaggacctagagggtgaggtttgctggcgtctactcagctcgcctgcagttctcagttgtttttccaacaacacaccagcctccggagtgagaagctggggacccctgggaacttgagggaagacacagctgccgtcccaccaagggctccaaggaaagcctaaaggggatgttctgaaaggggctcagccctcagcacagaaaacagcagccccccaaccctaggacagcactgtctagctgtgtccctgccccaccctagacctggccagcaacagccccaccaggcggtcctgagcatgcggagatccatccccattcccaccacagcgagttgcgggggggctacctaattcctcctggctcatcagcttgccagcagctcccctgacactcagcaccccctcttgtgttgctctgtcctccacgtggaagtcaaaggtgctggctggtcccagcatgatgactggtgcaagtgagtgaatgaaacagctgttccagcctctccctccccgctacccctccaggctctcacaagtcccatctcctccctgctccgggtggcgtacccaccctggatgtttcactccttctcatgccatccctgtctagagtgctcagactgacactggagcccagcgaggctcagctgtgcctgttacccgcagggacggctgctcccgccttgtcgtctggccgtccagccccagcggggcctgggagcgtctcccaaccctgccaagctgcgatatcctgacacagggatccgcgggactgcagtagatggagaaggcgtctctctggatgaaaggcaatgcttgtttctttaaggtgtgtgccatccggagtgtggtgacaaaggctgtgatggccccaatgcagaccagtgcttgaactgcgtccacttcagcctggggagtgtcaagaccagcaggtaatgcatgtcccgcagccctgtggctcaccactcagtgactttccagttgtatccttagcccctccatgtcctgatgccccagttaggaagtaacgtagcacccccaaacaatcatcacactgaagttaactgctttggagtttttaaatttttagtaacttggcattcctatcatgcaagtcatacatgtccattacggagaaattagaagctgttgcacgttggcgtccgtgcttataaagccttttctatctgtgttgttaaagagaagtgggtcatgttgggcgtgccaaggctgccccagagggcctggagacggatgcgattcaaggccctggtgctgtcctcacaggccagctcaggggacatggctcttggacaggctgaagcctgttgatggtctttctttcagtgtctctggactctggctgggtgtggggctttcacagaagctctcctggcacctccccagagagcccatgaggctgagtttaccccaagggaggatatcaggagctctgacctgggaccccacgtatatggccagttgcccggttcaggctgacccttctgtgatgagtgtgccctcctgtgtggcctctgcagtcaggccctgggctctgtccacggagctgctccagctcctggcatcaccactttctcagattctcttccctgccagtcctgcagctgccctgttgtccattctcatttcacaaacttccctgagcacccattatgccccgcatgtgccaggcctcagaggccacgatgacaggacactgctaggctccccaaaggcctgggtgacagatgcacccaccaaccactggtgcacacccatgagggctcaggcacgggtgcggccgtgcaaggtcaagccgggtgcccatgtggctctcgtggcgtcctcgagctcccagccacagcgcactcactggccaaagtgcaaaggctgtcaccctgctggcctcactcactgcccacaagactcactccctgagggcgcccgagagagggttttgccagagccgacagttccaaaagtcaaatacgaacctcacgatgcccttgggaaaccatgcgcaccctcaggaccttccagcagggccagctttgaaaagaaaggattcccaggttctatgcaaggcctccagcctctccacctgtgtacgtaggaacctcagaactgcactcaccaagacaaagggcatcatgtttgacattcactcctgaagccttcgtttcctcagaggaaacaaaggggcaggcctggggctggggctgggttggcaaggccctcaccctcctgcctttgctcctacaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtaagtggcttgtttgtgggtacaagaactgatgagccagccccaactttctgggcccgtgtcctctctccagggagaatttcccagccttctgcttccgtgtattttgttgttctgagtaaggactttgaacagggaaggaggcagagatgatgaaatcaaagcacccagacctgttagttaatagcacttccccacagacctggccaggagaagttccaagtgatgctgagagacatcctggctgtccagggaatttcacccacctgcaacagagtcaacgtccactactgagcaagggcagagaggtggctagggccagccactcttgaactcagtctgatttcaggtatcagaagaggaggtcctgctgtctgtgctgtaatttctcctccaggaaagactatgccatcggcttctctgtaacacaggatgtgtgcgctgggcgtgggtcagggtacatgggattggtggtcagagctgggggagagccctcctcggcagagctgcggagatgaaattgggagtcagatgtgggcggaaggtttgcagacctccagacatgaaaaggagctgctgaccaacgtcagttgggctcggaagggatgggtttgtctttgccgggcatttcacaggtggcaaccgcacccctgaacactagacaggcagtgttttcctcgtcctacagatggggaatcaaagctgagcaggggcaaaggccacaactagtcatgatggaggtgggactcggactcagagccgcaaggccaggtgtcttgctgtcccaggagggtgggggctggacaggagttgtaggcccaagaccccatgccatgttttcgtaattcgcctcgccctgggagacacaaaagcagggcttgggttaaattgacaggggatagttctcaaacacattaaagaagctaccgtttggcactcgtggtcttccaggtagcaggcctccccacggccctcctctctgggcccttactgctcaggatgggtcattgatccggcctgtcatggcactgccgttacccctgtggacaagacccagcaaatcttaaaagacgtataaagccatcaaataacaagacaccccctttttttttttttttcgagatggagtctcactgtctcccaggctggagtgcagtggcatgatctcagctcactgcaccctctgccccttgggttcaaggaattctcctaccacagcctcccgagtagctgggcttacaggcatgcgccatcacgcccggctaatttttttgtatttttagtagagatggggtttcaccatgttggtcaggctggtctgaaactcctgacctcaaatgatccatctgccttggcctcccaaagtgctgggattacaggtgtgagccacctcacccgtcccagactccctttagcggggaaacaaaaagtcatgcaagacacatttcacagcctttgcaaacgcttgccctgggctgccagccagacctttgcaaaggacggaggcgccttcatccccacccccttcccaagggcacagttggccgcccttcttcaccccgacatcctcactcagcacctgctttatggcgtatgatgccacctgtgggggccctgagggggacacgtgcaggtgtggcaagcagctgttagctcccaggcccagagcaccccagccacttaggagtggtgcatggtggtgtttcatgaggcgccaacccagataataagttatgacattgcaggtgggagttggggtgacccaaaacttccccaagaggcacgatgactcgccgtaggttcctgtctcaccatctagagcagccagatcttcatacataggtttccctgagaaagcaccgtggtgggcaagcggcagcctcaggctctccaccccccacctgcccacacccggccactttcatgaagatttccacctcgttaaactctactcagcccaccaggaattggcctccatccctgttgaaataagcagaaccacctcagaggcctggtggttgtctgaggaccgtttttacctcagaaaggggaggtgagaattctgtgaccccacaccaggtacaagcggcctctggctgctttatttccacccattccggaggtggactcggggaacagcccacccgcacccccgctttgaaatgccgggggcctgcttgcccagatttcattcctgtcagtgtcgtcccttctcttttcttatctcgctatttttctccaggtcagaaaaattgccttaaatgccacccaagctgtaaaaagtgcgtggatgaacctgagaaatgtactgtctgtaaagaaggattcaggtaaaaccccctcgaaacctgaggaatgtcagggcggtggcgctgcttggagtgtgttatggatttaccacgttggtgcatttctcctaaaagctgaactgtcagaggcccaaagccattgagggtaaagattccgagtcctggaaatcgtgtgtccacttaggatggaaagggagaggatgggcggaatctctacattttacacaacatgggcgaattgggcaaagcagcacttgatcacatcacgtacagcacagggctgtgcccagatccgcctcctttcgctccagcacctccacctgctccagttcccctcgctgtctgggccggggatgggctgtagcggctcacccaccctctctcctctgcatccctcggtcttctctttttctcccagctcctgacatcttcacggcttcctgagggtgctctttacgttcctggttctccctgttcatcaggctcagccccataaagctcagcatgcattttctttaaaatcattctactgggttaatgattgttcttggaatattttgaaatgtttcttcagcccatttaatgcaaccaaactgcatttaatgcaatcaaatatacattacctgttcctccgaattgctgtctaaaatcttagaacattctgttcaaaattttttgggggacactcccatagtagggagactagcaccatggtccgcactggaaggatcacctcatgtccagatgcaggttctgatgcagcaggtctgggcagagcccacgactctgcatttccgcaggctggcagtggtgaggatgctgcggtccaggcagggagctgcttttgcagggtgaggcggtggagggctgcaacacacccccagccccgtctcccttctcaaatgctgtgaggactggaattctccatagaagaagtttcttttttggagtaaagaacaaaggaagaaaacttactgagcatatcttctcttattccaggggcttgcaccagtgttgcctcatttaatctttgcagcaacctgtgaagtagacataattcttactcgcattttacaaacaggggagatgaagtttccccaggaggcactatgctactgccttcatttccttcagcctgcctctttcttccagatcagagtactggggagaagaggaccccaagcagctaggagtccaggagagggaaggcaaagcaaggctcccaaagtcatgcatcacatctgctgtcatttaaacctgttggctggacaaggcaggattaggagtgaaaggatgaactggcccaggaaagggatcccccaaagataaaagagttggaagaggaaggaggcattccgctggcggcctgggagaggccagctttgatgtcccaggctctgcaggtcaggcagcccaggagtggatcctcaacccaggctggtagctgggggcatcaggaagaggaggctctgtgttcccagctccctggaacctgcctgtttcccagcagagaagtgctgaggggtccccgggaatgcatttatgcatcccgtcccatcctgtaggagagggaaatcggatactcaatgtaggaatggtgtgctaaagagaaaacgcctcctgtcggtagccccgccacatagaggcagtgcttccgtcactgacgagctttcagagaggcgtgcaaactccagacgcatcgccagccgtcagccacagagagcttccgtttattgcccaatatcctcttaagctgtgacttctaatcactgcagtcatgttaaagcagcaagagagcagccgagccgccgcctctggccctccatctcttcagggggatcaacacaggaaaggtttgcaggggagtgtcagttataaagacatgatttaactgccattcgcagtgggcatggcaccatgaagaggaagggcgccgggtgggtgtccgccatctatgcagaggagcttgccaacatacagacgtcttcctgctaaatgcaggtgtaagagataggaaaaaccagtgttttctcctactctcacacacaaaatacaacacacttcacctctggtagccaaaacgtgtgggtttttccccacacaccaagcagttctccagtgaaccgtaagatatacgtaataaatatatagctcaggctgaacgcagtggctcacgcctgtaatcccagcactttgggaggccgaggcaggcagatcacttgaggctaggagttcgaaaccagcctggccaacatggcgaaaccctgtctctactaaaaataaaaaaaatagccagacatggtggtgcacgcctgtaatctcagctactcgggaggctgaggcaggagaatcgcttgaacctgggaggcggaggttgcagtgagctgagatcgtgccactgcactcccacctgggtgacagaatgagatcctgtctcaaaaataaataaataataaataaataaatagctcaattctgacgctactagatgtgtcagatcctacaaattgagggctcagcccaagactgccccactttgatgtcaatcacgagtcccacatggtagcctgtgcttctgagtgaccagccataaatcggacttgccatgacccctccttgggttcgattaattggctaaagcagctcacagggaaagactttacttacatgtgcccatttattacaaaggatatggcacacagccagatgaagagatgcggagggtgaggtttggaagggttgagcgctggaccttccatccctatggggctgggctgggctaccctcccaggatgtggttgtgttcttgttcaccaccccagagctctccaaaccctgaccttttgggtttttatggaggttttgttacatagccatgattgattacatcattggccattggtgatcaattcagccttcagcccctctcacctcccaggagggaagtcagagtagtagggctaaaaattccaaagctctgatcaatggttggttccctggcagccagcccctgtctagaggctgcccaggaacccccagctatcagttattaaagacatttagcactttgataattccaagggttttaggagctgtgtgccaggacaaagaccgaacatatatttccttttttttttctttttctcttcacatatttcttattataaatcccagtgtcatagcaggagtctccgggtctgacagatgcaccccagagcccttgctcagtatggcaaacccatctagaacatgtacgtcacagactgtacacagtataatctcaggaactaaagagataatagtaggtgatattgattcacactgctgtgtgccagacactgaaatgtttatgggtattagctcattgagtcctccaagcaactttatgatgtagaaaccaattaacaggaagggaaacagatgtagaggggctggctggcttgcttggggtcgaacactgggaaggtggcagaagccatccacgtgggtggtctagctcagcatctgtgtctctgtccagcactcggctggctggagtgaagtgagggcacaaatggggcgaaagaggaaggtaggggctgcatctgacaggcctgctggggctccagagggcgtcttatttcaagttcattgcgaagctgcagaaggttccaaggtttcaagcaagagaggcaagagcgggttggggttcagggccagccttgtagccgacagccccgtcacacgccataaatgccaacacttcaagagggacttgacactgagactgagctagcgtgccaccagtgatgacccacacagctccacttctcttcatggggtttggattcgagttggagaaatgacagtaagaaaaagctatcactgggtcaaggacggagcctggcgcctgctgcctggtgatgggagctttgcttcccagggccttgtaccccttcctgctgggcccccagcggactgcgggatggctttcccgactttccttagctgagaactttcggtgacacaaagaactgtgcctcagccacttacatctcctcttgggaaaggtgctagagggcaagtcataattagacttttggaatggatgtggaaatctgcctctttcttttcaacagccttgcacggggcagctgcattcctgactgtgagccaggcacctactttgactcagagctgatcagatgtggggaatgccatcacacctgcggaacctgcgtgggtgagttcaccgcctgcggaggcctcgggccagcgtcacccaagcgtaggctagctgccttgaacccgagaaagccctaggacttcgtgggcttctgcatttattgcagcattaaaatgcaagggcaaaacaaggtacaaaggccctaccagggactgggggccgggagagtggggatttaatgtttaatggttacagagtctcaacttgagaaatgacaattgttctaaggatagatgctggcaatggttacataacagtgtgaatgtacttaatgctgctgaactgtgtacttaaaaatggctgagatggtagattttatgtacattgcagtggctcatgcctataaccccagcacttagagaggcagagatgggaggacagctcgagcccaggaactcaggaccagcctgggcagcaaagctgtgagaccccgttctccacaaaaggaaaacgttttgttggaaattttttttaaaaccatgtttttaaatttgaaacaaaatcccaaaacaatgcaaaggcccactttgaacacgcagcctgaggttctcattagaaacccagccaggcagtggcttatttcagatggggaaagggataagagatgctcaccactcataagccatcttgtctcagagctcagctcttgctgtggaacggcgcggacagaaacacaacaccataaacattgagagggctttgggagaggcgggaatggatccaggtggggatggggatgttttcaaacatagccttagttctttgtgcctatcttcacttattttgaacattttttcaaagaggaaaagaattctataaacaattttacatgtattataattgcccacaaagatgatggcacagatgtctcccaggcacagtttttatgcagaatagcagagaattcattcattttattggattttgttttgcagagctatttgcacagtaagttgaagtgcaccatcagtctgtgggctcggatatgttttgggttaagttttctcctctctccttcctgtccttggtactttggtcctttctaagaaactcacatcatatgagctttttctgcagtaatactttaagaattaagtctctactggccgggcacagtggttcatgcctgtaatcccggcactttgggaggccaaggcgggtggatcacctgaggtcaggagttcaagaccagcctggccaacatggtgaaaccccatctctactaaaaatacaaaaattagccaggtttggtggcaggcgcctgtaatcccagctactggggaggttgagacatgaaaattgcttgaaaccgggaggtggaggttgcaaggagctgagatcacacccctacatacttcagcctgggcgacagagtaagactctgtcaaaaaaaaaaaaaaaaaaacagaattaagtctctgctaaaccagtttccatgatactactgtgcctcagaaatcctgcagaatgggcacacccctccccacgtggccggccatgagcaccccatgcagctccctgccgtatgtcctggaatagacaggcctgatgaacaaggctgtggccaaggccagtgtcctcctatgattgccaggctgacctcagaccacccaggggagacatgtcctcctcagttccctcctggggcagccctcaaggccacagtgctcagcatctggatgggttccacccgctggcagctcagcagatttccccagcagtttgcctgtcgcctttttgtctattatttttattatttctttgacttatttagcccagatggattaggcagcatcactgatgttgcttatttaaatttcgtagtcacttgaatccataacattcaggcatacagttttgcaactctttgatttcaataattcacttttctttctttgagtccccagattgcctgatggcaaaaagctttatagagtcccttggaattctcatctcaaaccagtgacttctccatcacttcagctattaaattcattggtgagcaggtccacagctctgggggtctcccctgcgccccatgccctctggcctggggttctttctaagctcctgggaacgtgtacatctatcccctggcagcctcttgggagagagacctcattttcctcctctgagtcactggaggcttcttgttccatgtcaggtgtggacctcattggaggcagctgttctcagctgcctacttcctgtgccctggagacccaggcccacctggcattcccctccctgttcccattcagtgaccactgctgtccaccacccacccaggggcctgggcacagtcgtggggagggtcggagtcaggcatgagtgcttggggtagggcatggcggaatctgtccccacccttggctcacagtgccccagtgcacttggcaggcaactcgatcgagatgagcctctcatcctcctgagtccaggtgccccgtgtgtcctggcatggaggttgtaatccttcggggctgctggcacagctgggttaatgcagtggccccgtgggacgcgacttacccacctggggcatggcatgtggattagcagctgacagcctgcagggcacacacataccaagttgcggggcagtgccccaagcacctgtgacggtcagccctcaagcatgagcgtcctgtgcctgagacggcactacttgaaacagcaaatgagaaacaccacaacagaccaagagagattcaaaagaaaggaaaacgctttctgttttagtccctgtcgtggcacattcttccagctttctgaacaaaggctccatgttttcactttatactgggccccgcaaacaacatagcaggtcctgtataagcacagcccgttctgctcttattgctatgattgtgggtgcttttaaagtgttcaaagtctatagagacttgcgacttaatggaatccttaaaagactttcactgagttatgaaattcatattttttagtagttgagaaaataggtcgcttagaaaatcaacccactttaacagcttttttattgcggtaaaatacacatcacataaaatgtaccatcttgactatttttaggcatacagttcggtggcattaagtgaatttacatttgtgtgccaccatcgccaccacctccaaataaatgtgttttaacaactttgaagcttaatacattgagcatgaaacttaagtacaaacaagaatgagctttctttcccacttgggaggctccacaggtgttaaggaccctggtgctggaggaaggatagtggggaagacgggttcagcaggtgaggcgtgagaggtacaacggcaggccctgaacagctcccaaaccccactcagagtggcaccccgcctggtgtatgagacccacccaccagatgctcccagagaccagtgatggggaggggcggcattggccaaagcatacgagcagcctctgctccagaacaacataaaccagacagagtcccgcccccggggcacagctcttccaccgcacctcaggaagagagggagacacctgccatgaagacggtggtcctcaagaggccccttgaggtccctacatctgcctcctgctcaaaaccctgtggccttctcggcttcactcttcctgactctccaaggaggagcttctcctgcaggagctcagaattccctcccaggcttacggctgtggttctgaggtgtgaagccagccccagagcccagggccttgtgcttgagccctccaggctccggaacctctgcaaagggattttcccttgatgcagcgagaggccccatctgagtccagagcagactgcaaggcctcgatctgcgaccacaatcgaactgaagcagctgtgaggaggtttacctgggcattgtgattatcatagagcccctgagataatctcctccctgcctgtaaccctctccgctgtcagtcagtgactacttcactgcccctctctgacgtcccatcagttgctccctggagacacctggcccagaggaggtgctatctagtcaactagtccaacatctgacccaggtcgacaggtcctcctcggaccctgagccaacctgaaggttttcctccatgactcgtggccctttgctcagaactgttgtgtcttcgagtctctcctccctgccctataaacccttagtcttaggcatttgtttctctgttgttgaaaacgccctggctgtacacaccaaacacctgtcaacaccattcccaaagatctcttctttcatcttcccccgtcatcttctacagcgttctgtgcaatggaagggccacaaacgcaagccacgggtgcaatttgaagttgcctagtaaccatatcttaaacagtcaaatgaaacaggcaaaaataattttagtaacatatcctattcaacctaatgtgtctaaaatattgccatttcaacatgtatccatacaaaaaataaatgagctgttttatattttttatatgaagactttggcactggatttccaagtgttcagggagcagaggtgggcctaggcctgttggaaacagggcccatcatcgtggcacggccagtgggcaggtgtgctccctctgagatcatctcatgcctcgatgtccccgtctgtgaaatggtgatggcgatgcccacctcctgggagtgggtgaggacggcccagctcacagaacctgggaaatggcagctgtggtggtggcctgggggctcctgaatggtacccctgatctcacaaggccctgaagcaggcctggggcatggtcttctgccagccatccctgatacctgcttcttttcctgtgtctctcagggccaggcagagaagagtgcattcactgtgcgaaaaacttccacttccacgactggaagtgtgtgccagcctgtggtgagggcttctacccagaagagatgccgggcttgccccacaaagtgtgtcgaaggtacggtcctcctggcggggaacggcaggcagctgtgtccagcaaaggagtgcctggagggcagagtctggcagcatcttccccaggggccggggagggcatgttgcatcaccccactgtggacaggagcccatttacagagctgctgaggggccttcgtccctttgttcactggatgcatatttgttgggtccctgctgtgggcagacaccgtgcagcagcgggataagatgggaagcagaatagcaaggtgctcacaccccattggtggactacgcgggacgtccctgcccatgtcgcgctcagcatgcatcctttgcactgtcgataatcagagaaaccatgttttgggttaaaaaaaaatttttttggagacacactctcactctgtcgcccaggctggagtgcactggtgtgacctcagctcactgcaacctctgcctctgggattcaagcaactctcatgcctcagcctcccgagtagctgggactacaggcgtgcaccacaatgcccagctaatttttgtttttgttttcgttttttttgagatggagtctcgcctgtcgcccaggctggagcgcagtgggcgatctcggctcattgcaagctccgcctcccagattcacaccattctcctgcctcaacctgccgagtagctgggactacaggcacccgccaccactccccactaattgtttgtatttttaatagagaccgggtttcaccacgttggccaggctggtctcgaactcctggcctcaagtgatccacccacctcagcctcccaaagtgctgggattacgggtgtgagccaccacacctggcctaaaatattttttttagttagatacttagagaaattaaaaagatcctgacaatttcctcattctaaagctgttctctgcacagtccacgcacatctattttcaccctccatatcctcctcttgtgcttcctcccatgtgtccctccacagagtcaccattcttatttgatggccctggacccttctgttgttggacatgagctgttaaaggaggagctgtttgctctggtctcctcttttctggctgaatattgccctatgttgggagatcatgaactcaggacccagaacagggcagggcaacctgtcttattcagggtgggagcaacattgaggagtttgaagggacctgtgagggtgtgacgatggggtgagctgtgaggggtgacgatggggtgggctgtgaggggtgacgatggggtgggctgtgaggggtgacgatggggtgggctgtgagggtgtgacgatggggtgggctgtgaggggtgacgatggggtgggctgtgaggggtgacgatggggtgggctgtgaggggtgacgatggggtgggctgtgaggggtgacgatggggtgggctgtgagggtgtgacgatggggtgggctgtgagggtgtgacgatggggtgggctgtgaggggtgacgatggggtgggctgtgaggggtgacgatggggtgggctgtgaggggtgacgatggggtgggctgtgaggggtgaccatggggtgggctgtgaggggtgacgatggggtgggctgtgaggggtgacgatggggtgggctgtgaggggtgacgatggggtgggctgtgaggggtgacgatggggtgggctgtgaggggtgacgatggggtgggctgtgaggggtgacgatggggtgggctgtgaggggtgacgatggggtgagctgtgagggaagtaccaggcgttagcctgctttcacagtgctaaaaagaaatacctgaggttgggtgatttataaagaaaagaggttgaattggctcacagttctgtaggcttcataggaaacatggcgccagcatctgcccagcgtcttcactcctgatggcaggtgaagcaagggcagcacatcacatggcaatagcaggagcaagagagggaaggaggccgggcacggtggctcacgcctgtaatcccagcactttgggaggccaaggtgggcggatcacctgaggccaggagttcaagaccagcctggccaacatggcaaaaccccttctctactaaaaaaaaaaaaaaaaaaaaatgcaaaaattagttggacgtggtagtgtgtgcctgtaatcccagtcttacaggaggctgaggcaggagaatcgcttgaaccaaggaggcggaggttgcagtgagctatgatcgcaccatgcactccagcatgagcgacagagcaagactccatctcaaaagaaaaaaaaaagtcaggagttgccacacacctttaaacaagcagctctcacatgaactcactcatcaccaaggggatggtgtgaggccatttatgagggatccaccccatgatccaaacacctcccaccaggccccacctccaacactggggatcacatctcatcatgacacttggaggggacaaatgttcaaaccatatcggggggcttccgtctgaaaaagactgaaaatgagggagccctcaaaggcttgtgtcagagcaggggaggggtgcccatggctggctgccagctgggtaccgattcaccacacagtggggtctgcctcccaggctgtgtgtaagaaccactgtgggttgtaacctattcccctagaaacaaagccctacagtgagcccatgagggaccaccaagcccttgcacttgtctgacccacagcagagggacctggtggcggttacgtatctcggcaagcatcagccccttctactgcgttgctgtaatggaggaaacttgccacccgcttgcaaggtgcagccttgctgagtcctgcacggggccctgggcacagttgtctgaagttaaacccttcatggtaaccagtcagctggttctcagataattaaatatagcaatccagggagaacttggaattaaacagtgataatcactttcatttgtcaaatgccctggatttcagggcatgctgatcatgcccacagctgtgcaactggacccctgcaggcagccccaccgcaaacctctctttgcccctcaggaggcagcaggcgggcagccccaccgcaaacctctctttgggcagtggaggacaggagtttcctgggtacttgttcccaggtgaggggcagctttcggccctgcagaggctgacagtgctggggctgacacaccgggtcttggagaagcaccccccaggaagagcgtcagtgtggacgcctcccaaaggaagcaaggccttggtccgattggttctgcggggtctctccccacttggacagcctgagctgagaaccacaggcatcctccaggccccagaatgctggtggacgccgtggccgtccgctgctgctgtgccaggcagctccgagggagcatgtggccagacgggctgcgttggaacatgcaggtcaggacgcaggcctgctgggttggcaactgcaggtggaagccgaggcccgacgctgagaacaatgcctgataagttccctaagagaggggccgaggcccgacgctgagaacaatgcacgataagttccctaagagaggggccggacaccctcaagacctagtgagaggacccagcaagagccagcctggacaacttggaagaaaaacaggcctctgtggagtgcttgccagcgggggaggcaaactcctcatgccctggccctgcctccacttgcccccaggctcagcgggggcagagactcccaggggcacagcttgaaggggcacgccttctgccaatgcgcatgctgcgtccaggctggagcatgaaagcgtcagtcttctgcatcccactcctgaacaggcaggaggctgatgggagtggcctctgcaagggagcagggacagagggctgcatccggcatccctgtccttccagaatgtggcagggcaaagcggccatggtgtttgggggaaaagtaggtaccatagatggttgcagaaccagaagcatcttaaaagccaccctgcccaaagctggtgctgcccacgaggacccgctgctgggcacggtaatcctgacggaaagcaggagctacacagggtctcccagggagagccgtctgcactggcctaacggggacgggagcatcacccatctccctgagcagcatggtgatggattatttccccagacctccagaggagagcccagcctggccaccaccttgccctgaacctcgtgagaccctaggtggagagcccagctgcacctgcctggacttctgcctgcatagcggggagccgctgagtgggtgttattttcagctgctgagtgtgtggcaacctggttagagcaatggaaaaccgaggcccctgccatcctgctgagctgggtgaggttgtatttgaagaagcaagcaagccgtaacctcctggctgtccaccgcagcgcgctcctcaccacagttcttcactgatgaagcagccctcagccgtggcctgggggcactgggcccctgggtcctccagaccactgacatctctttaaatgactcagctcggccctggttctcgtctcaccagtggcattgtctgtaagagaaaccagagggtctgtggggaaagtcataacctgtactggggcatcagggtttggtggctgggccaccagaatgtgcaagggcaggtgtggggagggggcagcatgatgggggcagacccatggggcttcccacaagtgcacaaccccctctggcaagtcctctaaccccatcctttcctctggggcggcctggatgggaatattagaaaggctcgtgggtgtgagtttgcctgtggggtttacacatttacaattacagaccaagggcttgagctctaggctcagcatcctcagacacactaggaataaaacccacctcccacccaggctgaagcgatgctgcacctggggctccagagcagcggagtccgtggtgagaccagaccccatcagagggctgctctgcaaagagccccacgaggaggcctggtgtctgagcgtgggaaggcttcacacagcagggaggggacatctgtataaagcaaagaactgccccccagggaggcccaggcatgagcacaacaaagctccaagccctgcctatggggcctgttccacccttaactggcaacaatggggaggtgggcagctgatgcaagcactgtggagaccgagtcaccgggctctggactcaggacaggcagcagcatagccggggtgcactcacggccccaggatgggaaacgtgctccttcaagcactcggcccgcatcggcaagtgctttctgtagagggcacaatggtcagtcgttcaggcttttggggccacactgcctctgtcacagctactcagctcagccactgctacacaaaagattgtcaatgaatgagtgtgactgtggtccaggataaatgctggatgtggcccttgggctgtagtgcaccaaccgtcccctgaggtcacgtttaccctgcattagaaatagccctggctggtgtccatctctgcgcaggctgggccaggaccgtccgagaggggcaggaattgtggggcatctctcccactccccgagggtaagcaggcatggccacatataggtgacagcagccttctggtcagctcgagtcaggtgtgtcacatccctgggtggagtctggcctggaccccaagcctacagccatcgcagcccggcagccgctggagagagaagactgacacagctctgggagccgtgtggtggggtgggggctgggtgccagggcccaggagggtgtccaggtgagctgcgggaagcctcggaggcctggcccctgatcctgggcttgctcctgccaactggccatggctgtctctgccctcccagggcaatagtgaggtcagacaggagaaaagacatgcagacactcagcccctgtgtcagggaatggtgggcgacacagcctctccacagaggaccgaggctgagggggtgggaaggaggtgcagggaggtgagggttctgggaagggagcccggagtggtggagcctcttccccagacttcagcaggaacggtatcttcccacaggtgtgacgagaactgcttgagctgtgcaggctccagcaggaactgtagcaggtgtaagacgggcttcacacagctggggacctcctgcatcaccaaccacacgtgcagcaacggtgagcagcagctgggttaccctggggctgcctgtggaggagctcagctggccagctcgtgctccaaagagaaaagcaaagccacataggcatggcggctccacagacaggcgttcgtgcccctgatccgattgactgtctgggattcctctagctgatatggaagacagctgccctgtctcccagcttccctctaggcctctcacatcgatcagagaggcatcccagccactgctgatctgtttattgagtgactcctaaaaatgattttgtccttgtactggtcccactgccatgccataggccgccggtggcccggatgtgacgacataccataaaagaagcctgacctggggggtcaaagccaggaagcctggagggtctctgctcaggacgagggggacagagcccagagtagagcacacgctcagcagcagcaatcccagctctgcagggatccagcatggacctgcatctgtgctgcaggagagccctggctctgccataggatgggggacaaggacaagttgtaaaaacagaaacttaaaagggcaccaaagctaagtgcccagtttgggaattccaggcaccaaggagggttggcaggactcgggcctggaggtgcagtgcaggagtcattgtagacacacgggcagggaagggggctctggcccagcaagcagcagggtggagccacattctgacagccaggagaggaaggctctctgctccagtgtccagggtcagggcaggtggtccttgggtatgaagctggcactggccctgtccaggcagagcatggagcttgtggagggccctgggatgcctccttgccttgttactggttattatttttggggggtggcgggagggttgtctaattatgtcccttcaaaggcccagaaactacttctttgggaagtcacctgcccaggttatgtatctagcccaaaaaagtgtggttgccactggagggcctcccaggtccacggatgatgcatcctcaaaggcctcttccccttgctgcagcggtgtcctcagcaagtcctgtccacggcggctcccttccccccatccccactcctccctgtccgccccctccaccctggaagcagcttccattccctcctgcctccaggcccgtcctccggcctcccctacagtcttcctcctaagctccactgccagcagttgtccagaaagacaggtgcacatgtgccccacaggcccaggctgggtgttctcctgagatccctcccacaccacccccacatcctgctcatgaatccccttgtcactgagactcagcaagagccccatataccagtgccctcccgccacacagggctcccagagtcaagtgcattgcaggagaggggcttcaagggctgccatcctgctgcccacctctgtctgtgtccctcttgcccagggcaccactgatgcccagcatatgtggaatgattgaaacaatatttatttatgtatttatttatttatttttgagacggagttttgttcttcttgcccaggctggagtgcagtggcatgatctcagctcactgcaacctctgcctcctgggttcaggtggttctcctgctttagcctcccgagtagcttggattacaggtgcccaccaccatgcccagctaatttttatattattagtagagacggggtttcaccatgttggttagactggtctcaagctcctgacctcaggtgatccacccacctcggcctcccaaagtgctgggattacaggcatgaggcaccgcgcccggccttgaaacaatcttcacaggcaccgaagactgacctttccctcttttgcctttcctgatgcggggccccagctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggcacaggagcctgtatttctttccacggcacacaaaatgaaacatgagtgctgaccaagtgttaagtggacgttactttaactgtggtttcagatctgtttgatgtcattacgtggaaggtcttcttttgagctttagcaaatgttgatgtaaggaagcaatggaggaaatcccagatcccaaccccagaatgtcactgggcaaagagaccccttcagaccacgttagcctcactgggaggaggttctagagcctctccagatgtaggggccccttccatctgtcacgggggagctccccagagcccagactgcctcttcaccggttgctgccaagtgtgattgaattaggttacagcttgtcttctatgcagtggctgaaatccctgaacccatggctgatgcactccttgggatgtttaccatggcctctctgtgaagtcagaagcttgtacttgctaggaatcctttggctgcaagtaaaggaaacgcaccaactagaaatgacttaggtgaaaacaagagtgggtgaggggcgttgttttgagaatccagagtggattcagaatttcagggaggggtgcagcagagccttgggaaagctggagccggcattaaatgtcacctggaccctctctgtacggcagcactgcccttctctccatggccgccttctccagttgatgggacaaatgacaagacctccagcatcttccaggtaaaactggtacaaatccaacccctcaggccaactttctgggtctgtttcttggctcttcttttcccagggacaggacttggtcagcctgccttacatgggtactctccctgtgtcatcagctgtggctacaaggacaggcttgtgcagcagaatatggctgcagggagctctgcagcagaggaggggagcagtgtgcagctctcagaaggcagggcaagtcacacaacccaacagctggccaccacaagcaccaattgaccagagttgtgcgtgtgaggcagtgaaggaataagtgtgtttgggatgaacattcaaccccttgccccgcccatgagaccgaccttgaattaaaagtaacttgttaagtgctgctggtgccaggcagccttttagaccctagagcccagataccagcaaatccgagctgcccactgagagcttacagtctaccatgtttgcagctgaatcagaaataaactcctggccgggcatggtggctcacacctgtaatcccagcattttgggaggccgaggcaggcggatcacctgaggtcaggagttcgagaccagcctggccaacacagtgaaaccccatctctactaaaaatacaaaaattagccatgcgtggtggtgacacctgtaatcccagctactcgggaggctgaggcaggagaatcgcttgaacccaggaggtgaagctgcagtgagccaagattgcaccactgtactccagcctgggcaacaagaacgaagctgcgtctcaaaaaaaaaaaaaaaaaaaaaagggaagaaactccctttatctcccaaagggagatacaactacaggaaagccaaccaggcagcctcgtcgagtggctaagccaggcaagcccagcttggggctgacaagtcgggtggggagttgagaagttgttcacaaagtcctaatgactaaactccaccttgttgaaagagaccaactacatataatgtctgctcacaagtggtccgaccttgaggttaaaattgtctggactctggcaggatatgtgtatggattttaagtgacaggatcatggatcacctcctctaaacctgtcatttcccagacaaggacactgagacccacagaagtgaatgccttgcctggggctgcacattggcaaagttgctccccaccgggcccagggaaggaagctggctggctgcaggaggggcgtcgttctgcagctgcccaaatgcagccatgatgcatttgttttaaactagctttattttcagggggtgatgtttacctgaccttatccccaaattctttggcacctcacagtggaccccatgtgtacatccccatccctcccaggccactactgactttgtatcttgcgactcttcaaaggactggtgagaatggcactttgtacagaagacacacctgaaatgggagggggggtggacagaacttaaaaaaataaaagggccagccacagtggctcacacctgtaatcctaacattctgagaggttagaagcaagaggatggcttgagcccaggcatttgcagccagcctgagaaatagagcgagaccctgtctcaatcaatcaatcaaaaacgacagagatagatagatagatgatagattgatagatgatagatagatagatagatagatagatagatagatagatagcaacatggtctaaatgagtctaggagtggagtgtccttgaacttggggagaccaccctccactgcatttgcattattgatactatggctggagagggccttttgcctaaaagcttggagtatgttggggcccccgagagcaggtgagggccagaggttcagatcagaggatggaaaaaggaggtggagaacaggaaagaaaaacattttaataagaacaagcaggggtgatggaaagtatacaccaaggccattctctagcatcttaaggttctgcccagccagctgggaggccactgggcactggctgctggggggaaaggaagaatctgctcccctaccccagccttcactgttgctttcctcgcacgaaccccagactctatccttcctggttggctgtttaagtcctttcctgacaccccaggctttgtggcttatctgagcacagaacagcatccttagatggtacagcactgagcacccaccttagatcctaggattcagtcccaccatccaaagcccctcaccactacagaccagccacactaagggtgaccagatatcttagactcccttttgaaacaacaggaaccaaagtgcccagggcagagaacatcctgttgccaaaatagtggttctcaaccagggatgacttttgtcttccaggggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccggccaaaagaaatggaatcaaaaaagaaaattgtttgcaacttcatagagataccctcaatgaataaaaccacatatggtttgacttctgtccctgttcctatgctgaagggaaacttgtacaactttccctttttaaagtaaagagataccaccccactcttttttttttttaaacacagcaacagaagggccccaagttaaaaccagctctccagcctaaggactccacctggtggtcctctctggaattaaatgaagttgaggttttattttgtttaattttttcattattcagttattttgtttaacatttttagttattttgtttaaatttttagttattttaacttttaagttattttatttcttagttattttaacttgttattttaatttttttagttattttaactttttaaagttattttaattctttagttattttgtttaacttttttagtttttttagttaaacaaaagttgcagtgaccggggcaggtgtgatggctcaggcctgtaatcccagcactttgggaggccgaggcagggacagggggcaggggaaatcacttcttaggtcaggagctcaagaccagcctggcaaacatgacaaaaccccgtctctactaaaaatataaaaatcagccaggcatggtggcgagcgcctgtaatcccagctacttgagaggctgaggcacgagaatcacttgaacctcatgttattcctcatgaggcggaggttgcagtgagccgagattccgccactgtactccagcctgggcaacagagcgagactccatctcagaaaacaaagaagttccaagtacaatacaaagaaattccctcccaatttgagagtaagttgccgatataccctatgaccgccccccccccgccaatacttcagtgggtatttcctatgaacaacgacattctccggcacagccatcagactcaggaaattaacatcggtatgttattaccatcaaccctctgactgaattctagttctgccagttgtcccaataaagttcttagcaaaatggtctggtttagaaacacacttttcacttagtcatcatgtctctttaatgttcttccatctggaacagttcctcagtctccttgcctcatgatgtggaagcttttaaagactataggccagttatttgtaggctgcccttcgctgtgcacttgtctgagggttcctcacgttttgagtcaagtcatgcatctttgacacgaatctcacaggctgattctgtgttctgtctgcattctagcagggagtacacgatctgttccattattggtgatgttaacgatcattggttagagttttcttccgggctatgaagtgatgcctgccaaagcatatccactaccaccgctgttcaacattgtgctaaagatcccagccagtgtaacagggcaaaaaatacagaaccagtataataattggaaaggaggaaataaaactatcttttttttttttttttttttttttttttgagaccgagtctcactctgttgcccaggctggagtgcaatggcatgatcttcactcactgcaacctccgcctccctgattcaagtgattctcgtgcctcagcctcccaagtagctgggattacaggtacgtgccaccacacccggctaatttttgtatttttagtagaggcggggtttcaccatgttggccaggctggtctcaaactcctgacctcaggtgacccacccacctcagcctcccatagtgctgggattacaggcgtgagccaccacgcccagccaactatcattattctcaaatagcatggttatgtatgtagaaaatccacaagaatggttacagataaacttaagtaaatttcacaagatcgctggatgtaacgccaatatacaaaaatctgctgtatttaaatatatcaaactaatgattagaaaatggagtttttaaacaaaaggtactatttacagtagcatcaaaatctatcaaatatctagacaatctagtaaaggatatacaaggccttgacacaaaatctgcaggatgctgctgaaattaaagagtgcctcaataaatgtagggctataatatgcccattgattggaatacttcatattgtaaagatattaattctctccaaattcttctacagatccaacacactacaaatcaaatcatgggtgctttttcacatatatctataatttatgttcacatgcaaaggattagaataatcagataactactagataatctgagaaaaaaatgggagctttttttgagggacaaataccaagtctttttctaaagcttgtattctgcaaggatagctgactaaacccatggaaaagaacagctagttcagaagcagaggccctcacatatttggacacttgatttttgaaaagagctgctctgcagagcagtgggggagaagatggtcttttcaataaatggtgctgggtccaccaaatatccatatggggaaaaatatatcttcttccctaccttagactatgcacaaaaatctaggccagagagactgcagatctaaatggacaaggtggaagaagaaagcttttagaagaaaatataattttggagtaggcaaaagtttctcacagcgtactcgaaaactattagctgtatagggaacggttcataaatcagactgtattaaaatgaagaacctctattcatcaaaagataccattaagagagtgaaaacccaagccacagggggaagatactcactacagacatagctcacaaggttcctattgaaaaaatataaagagctcctacaaatcagtttaaaaataaagcccaatagaaaaatgggcaaaacacctaagcagacacttcattaaagaggttatccaaacaaacataaatatattttttaaagttctcaattgtgttagtaattagggaaatacagttaaaaccacaatttcataccattacctatctaccagaatggctaagattaaaaagacaatactaaacgttagcaaggagtttaagttggcaaccactttggaaaactatgtcctacttaagctgaacataagtaagccctatgacccagtaattccatccctgggagtatatcagtatatgtgttcacataaagatatatattattgagtttgtaggtacactatttataatataaaagagtgaaaattacccaaatgttcatcaacagcagaatggataagtaaattgtaaaacatccacaatgaaataccatattacagtgagaatagattaactacatctacacacaaacataatgtttagcaaaaaatatgcaaggtacttcatttgcataaatacaaaactagataaagcaaatctatacaagatggcaggataatggttacccttggggcaagggtggtgactagatgaagacaggaggagggcttctggaatgtggcaatgtcctgttcttacgaggatgctagttggttgggtgtgttcagtttgcattcttctatatgtatatcatacttcaataaaagttcaaggagaatcatctccgggtggattgcagaactaaatgtgaaaagcaaaacaatcgtctagtagaccacataggaaaatatgatgggggtaagggaagatttcctaaggcacatgcacatgcacacacacccaatccactaacctaaagaaaataattgaactacataaaacttggaaacttctcagccaggcgaggcggctcacgcctgtaatcccagcactgtgggagtctgaggcaggtggatcacttgagctcaggagttggagaccagcctgggccacatatcaaaaccttgtctctacaaaaaatacaaaagttagccaggcctgttgacctgtgcctatagtcccggctatttgggaggctgaggtgggaggatctcttgagcctgagaggtcaaggctgcagtgagtcctgatggcaccactgcactccggcctaggtgacagagtgagaccctgtctaaaaaaaaaaaaaaaaaaaaaaaaaaaaaatctaatcatcaacaccattaagagtgaaaaggcaagccacagagtgtgttcatatccctaatatataaagaaattccacaaatcaataagaaaaaaggcagacaactccataaggaaaaaaaaaaaatgagccagggactcgaaagaacacttaaccaaggaagctatcagaatgggcaccatacacatgagaaggttctcagcttcattagttattagagaaaagcaaagcaaagcagtagtgcaataccaccacacacccatcagaatagctgaagttatagagttaaaatgccaagaaggctgaagctggaagccatgaaaacccttacacaccgctggagtgtgtatattatttcagcctcttagcataactgttgggcattacttattgatgatagatataccctatgtcccagcagtcccactccaggacaaactcatgcaaacgtgcatcagaaccacgtaccagaaaattcatagtagcattactcagaatagccctaactgaaaacaactttgatgtctatcaacagcagaataagtaatttatggtataatatatacaatggaattctcttcagcagcaaaagcaaacaaaccatctctgtatgcaacctggatggactccagacataatatagactccatgaaactaggccaaaaaaaaaagcatactgcatgattctatttatagcaaaagcaagcaaaccgaatttgtagtgttgagttcgcggttgccttttgggaaagagggaggctttcagaatagcggtgttttggatcccggtgtcggctacgcagctgtgttcactctggtcattaatcactgtaaattcctgatatgcacacttttatgtatatcacatttcatacatatgaatattcagaagtctaaaggtcacaagcttaaccgcaaaccctaccgtgcccgaggccgggctggacttgcggggcggtggggttgtcccggcgacctgccccaggcgggccacctagcccgggatctcacactgtagcccggagccaaggcccaggcccggggcgggcacctgaactgctggacccttcactgaaccccacgggttcccgcgacggctggtggagggaggacagtcaccgcttcccctcccacctcgaggtgcgctaatgcatgagaaagttcccctcgggtgtttccacattcgccttaacttttaaacaccaacgtctggaatcaggggtcctccagactccgaaacacaccctaggaaacaacccagaacgagacacatcccctgtgcgcgcgccacgacttccggcaagaacgcccccggaggcgtggctcttcgattgcttcggcctggcggtcgagctgcgcgcgcactcggcggctgcgattggtgctgcctggcggcggggcgcggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccggggtgagtccgggggcgtgggcggccagtccccaggcggcaccgagccgccttattttccgcgctttgccgcgtgcaccgaaggccggagcttggcccgcgggccggttgtctgggctccgaccgggctgcgcagggaacgccgggcctgattcttgccgttgttgccagatgagcatccggttaagctcctgggagccttctgttagcgccgtgcctcttgacaggcacgggtgacttcattacttcctggtgcgtcctcgtggggccctgttaggccttgcttggctgtttcgccgctggctgtttgagggcccggaagagcggctcattaatggttgtaacgcaagtgcagggcgcgggattggttcttaatacttgccgccagatgatattttgagcgtagataggatatgtgttcattattcctaatgtgagggaggaaactaagtccccgaacaaccgcgattgtttcctccagtattttctacttagtagctttaattgtctggcgtttcccctatatgaagacgttttaaaaattgaactgtgtcacccaggcttgcaccgccgggtgctgtgtgtaagttgtggaagcgctcgcaattattcagattcctgtactatttcaaccttagcaagacttggtaagatactgggagggcagctagctagttggcatttcaggagacggctttaaaagggacgtgatagagcaacttctctgaggataagaccatgctgtcgtagcctgagatttgttcccatggggacctatggcctcggagcagcatcgctgcgggatctgcttagatttcttgccgacctttgggaaatcccactgttttgtgttgtgttgtgttgagatggagtctcgctctttccgccccagctggagcgcagtggcgtgatctcggctcactgcaaccgccgcctccccggttcaggtgattcctgtgtctcaagcctcccgagtagctgggaatacaggcatgcgccaccacgcccggctaattttttgtatttttagtaaagacatggtttctccatgttggtcaggctggtctcgaactcccgacctcaggtgatccgcccgccttggtctcccgaagtgctgggattacaggcttgagccactgcgcccggcccaactcaccacttttgatgatctctgccatttctctttatggagcatgtgcagtgttgagaatacgtattttgatgcagtacgtgtagtacagctctgaattgtgtcctttaactttgggtaagttctttttttagtagaccttgcttcttcggaatatttcttttcttatagtgcctaacacaataattatgcccaaattagacaaattaacatttgagtgttcacagatttattactgtatttaaaccattgatcttcaattctgaattggagctgggggaggggagggagaactgtcgtgatatgttgaggctgttctgatgggttctaagaatctggcctgtggagatgcaagagtggagaactgtcgtccacaatgtttgaacgccgtttgggcactgagactaagcagctccaagtgtaaactcctgttgtgccgattccgcttaactagcccaaacgacttaggacagtgtgaggcaccttgtaaatgttcttataaatgttagctgcctatatcagccattgttattgtccttgtccttgttgtcatcagattctaagcttcatggcactggggacttgagactcgttcagcgttttctctctagtatcttaaacagcggcaagtcatgcgtgacccgacataggtgctaggtaatacttcctgaataaatcaaagcctggagtcagatactatgaaatacagctaatgctttaaggggcaactgtttagttatattaatacctcttgtgtttttttcctccattttatagggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatggtacgtgtctgtaggggaaagtaattttttcccctagagtaaatgttgcagtgtttcctgaagaagttgtagcacgtgctactggttaaacctacatgtttctttttctttttctttttcttttttatttatattttgaaaaaatattttttccataatggaagccacattcaatacatgttttttcttaaaatgagaaatgaacttcacttttcctatagagatccagagattaacctggcattagtctagtcttacttgtatctgttcagaaatcatgtatttttattttcatggttaagtttctaaataaaaacatgttgctttgtatacattttggcttctaaaacaattatcaaaggggtcatagtaaaaggatatataaaggtaacaattatacttttgactgagcgtctctgcttttttttttttttaactgcaactaatttctagactgttacttattgaaattgagatcttttttgaccctgccttcatcagctctgtgtaaactttattggaaaaaaagcacttggtgtatagataatgtctttaaaggtactgggtggtgagtgggatttccttcagatagaaatatttctcataggttaaccattcccctatagtatagttgttgtgtcttgtacctgagctgggaatccagaattatttgtatttctgtgctgcctgcacaaaaaatcatgaagtgagttaagtagtttgtgccacccaggagttgcaccttttctcaggttccactagatggtatgacagtggaattagccccaggcagtgtctaaaatcccacttctgttgctgaccctgtggcctcagaaaagggttctttttgctttgtttcctctttatcagggtgttggaagaaggatctctaagtgtctctctgtgatcctctgagcaaggaggtagataaaattgttagcttatttaattttcacttttactaagactctatttttattttagccgtataggtgagggacttgatcaggctctgccctgtctgacagaactcattctcaccaataatagtctcgtggaactggtaagttgcacagaaggaaaatgtatttggtgggtggggttaaaggtactatgtgcttcctacagaaaatttacaaaatctagaaaatgatctcagtatcctctttcttgtctttttcttaattcaggatctgggccttttgggttctgcagccgtatgttgcaaatattttcctacttttacttgacttttgacttaggatgtcttgttagagaagttcctaatttaggtgcagtccaatgaatcaatcttcttctttattgtagcccttttgatgtttaaatttcccctattccagggttataaactcctatgttgttttctacaattgcagtgttcaatatagtaccagtaactacaggtggctacttataattgagatgtgctagaactataaaatacacactggatttcaaagacttaagtgcaaaaaaaaaaaaaagtaaactatctcagtaatttttttatatcgatgttgaaatgataacgttttggataataagttaaatggcatattattaaaattagtttcacctattttaacatggctactagaaaattttagattacatatctgatatgcattaaatcttgctgaacagttccagtctagaaaccttgttttactcttcacgttagatgaacaatccacttggaactgttttcatgctttttaaatttctgttctgtgtatccaatttttaacataattgagatactgtgtattgttttgtaacctaaattcttcacttaaacactggatgcttaaatttatattgtaggccaggtgccatagctcatgcctgtaatccaagcactttgggaagccaaggtgggaggatcacttgagcccaggagttctagaccagcctgggcaacatagtgagaccttgtctctctctataagtaatttttttagaaaagccgggtgcagtggctcatgcctgtaatcccagcactttgggaggccgaggcgggtggatcacgaggtcaggagttcaagaccagcctgggcaatatggtgaaaccccgtctctactaaaaatacaaaaattagccgggcgtggtggtgggttcctgtaatcccagcttcttgggaggctgagacaggaggattgcttgaacccaggaggcagaggttgcaatgagctgagatcatgccactgcactccagcctgggcaaagaaagagactccgtctcaaaaaaaaaaaaaaaaaaaatgccaaaagtggtagcgtgcatctgtggtcccaggtattccagtggctaaagtgggaggatcacttgagccctagccatcagtcgaggctgcagtgagacatgatcatgtctctgtactccagtctgggcaatagtgcaagacctcatctcaaaaaaaaaaaaaaatcgtataacttaattttgtgacttaaccttcctcccgtattttcctgattgttgagaatgaactgtgttcctttccttgtggacaaggtccatagcatccttcagattctcaaggagatgcttgactacaaacataagacagcactggtccatggccatgtcctttctgaagtgtgtgaagtattcaacccgaaatacatatttataggcaatgtgtctcatgataggtgctgttagagaaattagagttgtatttaaagctctttgcaaagatgaagactactgggcttatcagttattgagagaggtatgttagaatctcacagcatggtagtggatttgactatccctgaagttctgtcgattttagttttgtatattttgaagttgccttatttgatacatacaaattttaaattattcatatctttctggtgaacggaaactttttattatgttgtgaccctcgatctctattaatgctgtttaccttgaggtttcttttacctcgaaacaatctttgttttggttagttatatgcatgataaatcgttttccatccaaaatttactttcagcttgtctgtacctcttgtagtttagatttctctcttaaaaactgtatggttgaattttttttttttttttttgagatggagtggctggagtgcagtggcgagatctcggctcactgcaacctctgcctcctgggttcaagtgattctcctgctgcctcagcctcccgagtagctgggattacaggtgggcgccatcacatctggctaatttttgtattttttttttttttagtagagacgaagtttcaccatgttggtcaggctggtctcgaactcctgaccttgtgatccacccgccttggcctcccaaagtgctgggattataggcgtgagtcaccgcgcccagctctggttggaattttttacaatccagtctgaaagctcttttaagtgaattatttatatttagtctgtttacatttaatgtaattactggtgtgttccagtttgtcttctctctgttctggggcttcctgtctgtcccacccgttcttcaatccgttttctctcctttattgtagatgctctccttctgtcattccattttttcttctgatggtttagaaattactctctttcaatcttgagttagcatcgtaggaattaaaacacacatatttataaaagtttaaaattaaatgttaagatcactgtaccatgaccttcaacatttaattttaaactttgacacctttaccctgctaaacaatacagtacagtgaccttcaacatttcagcagccttcgggttgttacatatttattcttttttgaagcccatcactacatcgccattacgttttacactgtgtatgtaacaaatgttaccactttgttctttattcctttttggatcatcttcagtgggggtaaaacagtatcaagctctagagctccctctggtggtttttgtgacatatttgaagatggcagcttgctttttgagaatttctggctctgctctccctgtttttatctgtacttttttttctcattgtgcctcttgcacacacacaccccttccccaccatctacccaatttgcgcctgttccagcagtttctcttcagggcagggccgtgttgggacatgatttctattaagagtgagggcccaaattgctcttgcccctgcagcccttatcacagacccctgtagtcattattggaacatgctggtcttgggcctgcttttctcagtcactggagttctccagtttgtaagacggctcctcgcctcccctctgcttcttcctgtacaaaggccgtcaccctgcaagccttgttgctctcaacatgggttgtctctacttgttcctattttagagttactgcagaatgccttgccatctagcttggttgtagctggtaaccataggtttttgtttttttgctatccttattgcactatgttttatggaacaattggagaagattaaaaattcaccctgcccactgggcgtggtggctcacgcctgtaatcccagctctttgggaggccgaggcaggcagatcacgaggtcaggagatcgagaccatcgtggctaatacagtgaaaccccgtctctactaaaaatgcaaaaaaaattagccgggcatggtggtgggcgcctgtagtcccagctacttgggaggctgaggcaggagaatggcatgaattcgggaggcggagcttgcagtgagccaagatcacgccactgtactccagcctgggcaacagagcgagactccgtctcaaaaaaaaaaaaaaaaaaaatcaccctgccttctttccattaattcgatcatttttaagctatactattccttgtccctgcaaattttatttaaagagattttcaggggcagctaggataaatgtaccttctttcaaaagacagtatacctttgttgttcttagacgctgaagctggcgctagcaggaaagcccacttacaccaagattctggcttgcagttcccagtgtgaataggttgctccagagtcccatcagctttgccattgttttcttttccaaatcatggctcagcagccactttgagattcctgtaggaaagcaatttcttatctcctgctattgagacagaagctgttaatgccaagattttaagaagctcccatgtattcatcggtagaaattatttaaacatttgtgatgtgctagtattgggcttgttgctagagagtaaaaattcagtaaataatgaaaagacaacttgcttcaaaagcactctccatttcagaatctcaaaatagcgtgtggtattcgcgttcttacctgtggctattgcttgacagggtgatctggaccctctggcatctctcaaatcgctgacttacctaaggtatgggaattacatattgtgacaaaatgaagccctttaaaataacattacttttaccagccttgaccttaatgtaatcagataattaaaaaatgtggcacatatgcaccatggaatactatgcagccataaaaaaggatgagttcatgtcctctgtagggacatggatgaagctggaaaccatcattctcagcaaactatcgcaaggacaaaaaaccaaacaccccatgttctcactcgtaggtgagaattgaacaatgagaacacttggacacaggaaggggaacatcacacaccggggcctgttgtggggtggggaaaggggggagggaaagcattaggagatatacctaatgtaaatgacaagttaatgggtgcagcccaccaacatggcacatgtatacatatgtaacaaacctgcaagttgtgcacatgtaccctagaacttaaaagtataatttaaaaaaaaagtgccttttacaaagaaagattgaatatatttccttaatgttaaattgttacaatgttgcaatgtgaagaatgtgaatgttcccttgatttataggttccttagactattcaaacagacctcttgagtgctgtgccatgaacaagtttgccattgtgtcattccttttcttgtagtatcctaagaaatccggtaaccaataagaagcattacagattgtatgtgatttataaagttccgcaagtcagagtactggatttccagaaagtgaaactaaaagtaagtagtaatctgttgcttgtgagccattatagagttgtgtgtttttctttatatttttgttactgattattaaaattgtctaaatgagtaaattttaccattagtttgtaataaaagtgggagggaaaatgttacatcacatttttttctaatagcagagtttatgatagaacttttaagttggagctctcttatgtaatgctggctattccgaagttcgcaaagtgctgaggccacggtgagcagtcttaacagtggattgtctgcctagatacgttcccagcggagaacttaatgtaacctactttcgtgcagctccgtgtgttaggatgatttttccctttattaggaattcattattttattattcatttaattgccttcttagttccctgggatcccctccttggagctaggagaatgaactttcttcagggagctctaccaaagaaagaagaccactgtgtcttctcttaatttgaaattgctttttggtattttcaccagcccggagtactgtaggagagttcgcttccatgtcttctgaggaatgcatctaaatgcatgtggtattcctatttccattaactctgtgtgtggtgtcgctgtaggagcgtcaggaagcagagaaaatgttcaagggcaaacggggtgcacagcttgcaaaggatattgccaggagaagcaaaacgtaagacacggatatccaacttaactctacttcaccttcagaaacatgatctgatctgtctggcagttcgtctcctacaaaattaaccaaaaactctgacatattaatgtggtattaaatttgagtgcttatagtccatgtacatcaatggtccacacatcacaagaaatttctaccagcttagcagagcaaatatttcagtagtcagtcttcatgtgataccatgtacatcctattttctatataggaagatgaactggatggtgtttctgaaggagagagttcttgtatcagtttgttaacaaagataagatactacactggttgaattactttcaaaagcttttgaaagtaaaagagaagcaacttctgttggtctaggtctaacagttatgttcttccccctcttaagttttaatccaggtgctggtttgccaactgacaaaaagaaaggtgggccatctccaggggatgtagaagcaatcaaggtaatcatgtgttaggattcttggactggaatgagctaagatgggttcagaacacaaagctggataataaacatgttccgaacattgcagatttcattttcccacagttattagcatacagcaatatttctgtttaaggaaaaactagcataaagttattatttgatcagacttgaaattacacaagctaattaatgtggaggcagctttgtctttctcattttccaaggtgcatttatcacttcgaacagttacttaccttggtatgctgtctcagtgtttgccttaatttttactttcgaagatttgctgtctggcaaatccttttgactgatcagtagggaccctcgttttataatattgcctccttaaattattcagtaacataattgcaaatagttacttcacttagctacgattttagaacatgtggagtgattatttataagaaggcctgcatctcttcaccaattttagaaatttgtggtttggcttctagttttatttttgtgggccaataacattcttccccctacaccaaagtatttaatgttcctgatggagaagttgctgtgaatttctgtaggtgattgacacttagttttctgggtagctgatacttggttgaagttaatcatccatctccattgccctctgtcctccagaatgccatagcaaatgcttcaactctggctgaagtggagaggctgaaggggttgctgcagtctggtcagatccctggcagagaacgcagatcaggtgaacaaatggtgttctttgtatgttcaaattaatgttacactcagagtgtaactcacaaccatttagatgccatgactctggaatgccagagtagtgcctccttacatcaaatctaatatatgaaatctctttaaatgctctttgaagataaagtatttgatgggttgggtgcagtggctcacgcctgtaatcccagcactttgggagcctgaggcgggcggatcacctgaggtcaggagttcgagaccagcctgaccaacatggagaaaccccatctctactaaaaatacaaaattagccgggggtggtggtgcgcgcctgtaatcccagctactcgggaggctgaggcaggagaatcgcttgaacccgggaggtggaggttgtggtgagccgagatcgcacttttgtactccagcctgggcaacgagcaaaactgcagctcaaaaaaaaaaaaaaggtatttcatgaagaaagttaagttacagcactgtggggggttttatgtaaaagttgaagctagaattacttcagccatggagtgcaccgaacactagcgatagccatgtggacttttacctatatatatttgcgtgtgtgcatgatacctcagtagttaggaacacaggctctagagccaagcagtccgaggcccaaatctcagcttcaccagctctgcctttggacaagtttcttcaagtctttcctcatctttaaatctgagataacaatagtagcaaacctcaaaaggttgccgagaggctgagagactgaacacagcacaaggctcaacattagcgagtttttgataagtggtaactgttctgacatctgaatgcctgctttatgctaggctgcatgtggggcactagggatataagataaaaagtactgaaatacgtcttacaagttttgatatgaatgtaactggggacagccactcagactgccgtcttggggaagtttcctagggaaataatgtttgagctgggagctaaaaattaaaaagacatttttttcctttttgagtcggagttt

SEQ ID NO: 1789 - DNA, 63189 bp, Homo sapiens
  LOC388226 gene - 23609134 - 23632322 of chr16; NCBI Entrez Gene ID: 388226; Build 35; sequence includes 20,000 bases upstream of initiation codon and 20,000 bases downstream of termination codon of the gene
tctggctctttattttatttatttatttatttttcttcttagacacagggtctcaccatgtcgcctaggctggtcttgaactactgggctcaggcaatcctccccctcgggctcccaaagtgctgggattacaggtgtgagctaccatgcctggccctggttttgttgttgttgttgttgttgttgttgttgttgttgttgttgttgtttttgagactggcctgcctggttctataatttatttttttgtttgtttgcttgtttgtttgtttgtttgagatggagtcttggccctgtcaccaggctggagtgcagatgccctatcttggctcacttcaatctccgcctcccaggttcaagtgattctcctgcctcagcctcccaagtagctgggattacaggcgcacgacaccacacccagctaattttagtatttttagtagagacggggtttcaccgtgttggccaggatggttttgatctcctgacctcgtgatctgcctgcctcagcctcccaagtgctgggattacaggcataagccaccgcaccctgcacctgtttctataatttagcttacaagttgtgtgtctagggaaagttaactctaaacttctccgaaccttttctgtgactcaatttggtcatagatgaaatggggataatagtagtagttaccttgtaggattgttgtgagaaatatatgacactatgtatgcaaggctctttgtacagtgcctggcccataggaaacgccctgtatctttactgttattattgttactgttattgtttttgttttgggttttggggcatttttcttttttttgagacggtgtctcactttgtcatctaggctggagtgcagtggcacaatttcagctcactgcagcctccatctcctgggttcaaacgattctcccacctcagcctctcaagtacctgggattacaggcatgcaccaccatacccggctaatttttgtatttttagtagcgacagggttttgccatattggccaggctggtctcaacctcctgacctcaggtgatccaccccctcggcctcccaaagtgctgggattacaggcatgagccaccacacttcgcctgttatattattcttctctaccctctgtcattcttcgccatctcattttttttttttttttgaaacagggtctcactctgttgcccaggctggagtgcagtggtgatcatagtcctcacttcagtcttaacctccccagctcaagcaatcctcccacctcaacctcctgagtagctgggaccacaggtgtgtacctccatgctcagtcttttttttttttttttagcagagatgagatcttgctttgttgcccaggctggtcttgaactcctgggctcaagcgatcctcccaccttgacttcccaaagtgctgggattacagacatgagacactgcacctggcccatcttgatagactgaaagagctcattcagataggtcggtggatcatgtgagtccttcgaggcctgtagaattgggttattcagttcagcatgtctcacctttccaaaattctagaagtcaacagaactcacaaggatatctcaggaccagttacacacccccaaatttagaaaatacaagcaaatatcagaaccaaagatgaccattgcagctagttaaaatcaaagcactgattctttcttaaagtagcatttcccaacccaagagcaagattcaagatctcaaagtctaaaataatgttgctattgtcagctaaggaaaagtgtatagatggagagatagaaggaaaaaaaaaaaaagccaggcatagtggctcatgcctgtaatcccagcactttgggaggtggaggcgggcagatcacttgaggtcaggagttaaagaccaacctggccaacatagtgaaaccctgtctctactaaaaatacaaaaattaactggatgtggtggtttgtacctgtaatcccagctaccggggaggctgaggtgggagaatcacttgaacccaagaggcagaggttgcagtgagccaagatacataccactgcactccagcctgggtgacagagtgagactgtctcaaaaaaaaaaaaaaaaaaagagagagagagagaggagaaaccatgtagggtaataaatattatttttaaaaaaagaaaagagggaaagctttcttgcttttggtttttccaagatgccaattgtcctcatttccccacctgtgaactgggagaaatcctccatcaagaagttaacccccttgttctaggggagaggtggagggataagtctgttccctgggtgttgcatctccccactcagagaataatattttatcacacttagactggtagttctccaactctaggatgcatcagaatggcctggaggatttgctaaggcacaaatggctggttcctgactcaatagatctggggtgggaccaggaatttgtaataagttcccaggctgtgcaccagaaacaactcccagccctcattagccagaagagaaatgatttgcagaaatttagcccacttgagataaaagcttattctcaagtacaagctcaagctcaggaagttgtttgatgctcctaggttttcttctcaaagcctgggcatccaggacattttttttattttattttattttatctttacttttattttttgagatggagtctcgctctgttgcccaggctcaagcacagtggtgcgatctcagctcactgcaatctccacctcctgggttcaagcaattgtcccgcctcagcctcctgagtagctgggattacaggtgcccgccaccatgccaagctaatttttttttttttttgagacagaatcttgctcttgtcgcccaggctggagtgcaatggcacgatttggctcactgcaacctctgcctcctgagttcaagcaattctcctacctcagcctcctgagtaactgggattacaggcacacgccaccacacccagctaatttctgtatttttagtagagacggggtttctccatgttgcccaggctggtgtcgaacctctgacctcgtgatccacccgcctcggcctctcaaagtgctgggattacaggcatgagtcactgcacccagcctaatttttgtatttttaatagagatggggtttcgccatgttggccaggctagtctcaaactcctgacctcaagtgatccatccaccttggcctcccaaagtgctgggattacaggcatgaggcaccacatcccgccaaaccagggtattttagcttgattcctctggaagcaaagcctgagatagggcttccgatgcatagggtttattcatttatttcttctggaaacaaatataagggagaaaagggaaacagggtgaggcagggagagagatggagcaaagatgtggtctcaggaaaagtctagccttggtctgatcagtgagggtttgtagggcataggctatagtgcagaaaggttcttcctggagaacaggggcggggcttttctgaggaccacaggattgggtagcttccaggagaggcagcttgcatcatcccagggcaatgttctgaggaagggagacggctatgggctgtaaacagccaacactcactgcagctgggaaatgggggtgggatcccactgtgtctactacgcaaggcaacttatttgactctgcagagattctgctcaatggggtggttgctcagcaagcttgaggctgagatgcaaggttttgcttgttttagtaattaggttttctttttcttttcttttgcggcaagatctctgtcacccaagttggtgtgcagtggtgtgatcacagctcactgcagcctcgactgcctgggctcaagcaatcctcccgccttagcctcccgagtaggtgagaccacagacatgtagaaccatggtttgattttttgtagagtggaggtctcactgtgttgcccaggctggtctcgaatgcctgggctcaagcagtccacctgcctcagcctcccaaagtgctgggattacaggcatgatccactacacccagccaggttttcttttcaatgtttgtatattttattaagaaaattaaacaaaagcattgtgtatgaaatccctcatatttttaccataagggcataaatccatgtatccgcttcttcattggtttttaaccttttatttgagtatcacttatgatgtactagtagacttttaacaactggctctgcaagtgtagctctgacatgcatatttgttgatatttttgtttacataaacaactaggaagagaaaaatgaaaagaagatttttttggaactttactcatttttcaatgacaaaaggaaattctttgttgaatcagataatagatttcaaacacaaggagaatatttccttgattttttgtcattaacagacacaacacttctaaaaaatattttcggccgggtgcggtggctcatgcctgtaatcccagcactttgggaggccgaggcgggaggatcacctgaggtcaagaattcaagaccagcctggccaacatggtgaaaccccgtctctactgaaaatacaaaaattagccaggcgtaatggtgcatgcctgtaattccagctactcaggaggctgaggcaggagaatcgcttgaacccaggaggcggaggttgtagtgagccaagatagcgccactgcactccagcctgggagacagagtgagaccctgtctcaaaaaaaaaaaaaaaaaaaaagtttagggggtcaacaaaatataaatcaagccccaacttgtagcatctgctgacttccacggcagaaatacttgcaccataactgattccaaaatggtaatgtgatgtcactggaatggagttgggatatgattctgtgtaacccaccattacatagtaatagtatttccaccatacagataccatagatagaaagaatcccaagtgtgctcagaagcaacagtaaaagaattagaaaatatattttgagtatttattacttttgtctttaatataatgtatttaattgtaagtgtgtatacgttaattgttaatgatgtctggacagggtggcatgcgcctgtagtcccagctactggacttgggaggctgagatgggaggatcgtttgaaccggggaggtgaaggttgcagtaagacaagatcgcgccactgcactccagtctggacggcagaatgcaactgtctttaaatcaatcagtcaataaagtgttcatgccccctgcatctgtatcaagaaacataatgcagttagatcccccaggagcctccctcaagcctccgccgagttactaccctgtttcttccccactctcccttctccgtgggtaaccaatacttgcaacagcttggaacccttggcttgcttttgtcattccaatggaatcatgagcctgcagtttgaaatgttaccattagaggcctctcgtgaggcaaaacagaaatctgcaggactccgcctctgaaacccagtcccgcaggacttctggccttcttccgacgttaaggagatggttactcatgcccggggctgggaggagaaagtgaaatgactgagctctgtgcgtgggtgagctcttggaggagatatgaggccacgaggttccctgggggagataaagggaccagctttggccttaaaccccagtgtgggccgggagcggtggctcatgcctgtaatcccagcactttgggaggccgaggcgggcggatcacctgaggtcaggagttcaagaccagcctggctaacatggtgaaaccccgtctctactaaaaatacaaaaaaagaaaaattagtcgggcgtggtggcggccatctgtatcgggaggctgaggcagaagaatcgcttgaacttgggaggcggaggttgcagtgagccgagatcgcgccattgcactgcagcctgggcaacaagagtgaaactccgtctcaaaaaaacaacaggccaggcgcagtggctcacgcctgtaatcccagcactttgggaggccgaggcgggcggatcatgaggtcaggaggttcaagaccagcccggccaacaaggtaaaaccccgtctctactaaaaatacaaaaaaaattggccgagcgtggtggcgggctcctgtaatcccagctacttgggaggctgaggcaggagaatcgcttgaacccgggaggcggaggttgcagtgagccgagatcgcgccattgcactactcctgtctgggcaaaaagagcgaaactccgtctcaaaaaaaaaaaaacaaaaaacaaaaaacccagtgtgtcgtgccagtgcattagcatagcccaaatgagcaccaaggagtgtttctgcccaggcaacaggaccgcttaccaatggctcctttatttgaagcctaaaccttaatcggctcattagttcacaccaccatgatctagaagaagcaaaccatgggaaaacatcaaggggaaaataggaggaaggaaatagaacatagagattaagctcgcagactcaggagtccaacagacctaagtttgaatcacagccgcatcacttactagctttgtaaacttggacaaattacttaacctctatgaaacttagtttgctcatctgtgaaatggagacaagaaaaccttccttgaaaattacttagcaattaagtaaatcacatatgtgcagcaacagtgactcttttgaggaggataaaaggaagaccctcattttgtttccaaagacattccaatccactgaatttatgatgtgcagaactggcagggtatgtgaacatgggaattaaaactgctccaggccaggagtggtggctcacgcctgtaatcccaacactttgggaggctgaggcaggaggattgctgatttcttgaggctgggagctcgagaccggcctgggcacacttgagcctgggagacagagagagacactgtccccaaagttgttttttaaaaaacatttctgcataataatataaacagctctttcatttggtcaaggacatatatgcaaatcagtgcatacatgcatatcacatagatacatccaactttatataaatgggatacataatgagagtattttctattttttagtagcttttttctttcttttttgctggttttattccttcattagtataacactccctccagcctaccacaaaacccctgttaacaaaccagtatattacattctgtatttttctccatgctcatataaaataacttacaaacatattgcaaagttttacaaaaataagttcctataaggttgttttctcatcttgcaattctcaatgtgactcaaagaaattcttccaagtcaatgactgtaactctatttttttttttttttttgagacagggactcgctctgtcactcaggctggagtgcagtaacacaaacacagctcactgcagccttgacctcctgggctcaagcaatcctcctgcctcagcctcccacgtaactgggaccacagatgcatgccaccacacctggctaattttttaaattttttgtagagacagggtatcactgtgttgcctaggctggtctcaaactcctgggcacaagtaatcctctctccccagcctcccaaagtgttgggattataggcatgagccaccacgcccagcctcatatatatgtgtgtgtgtgtgtgtgtgtgtgtgtgtgtgtgtgtgtgtgtgtgtatatatatatatatatatatatatatatatatatatatatatattctttttgagacagaatctcactctgttgcccaggctggactgcagtggcacgatctcagctcactgcaacttctgcctcccaggttcaagcaattctcctgcctcagcctcccaagtagctgggattacagccaccagccaccatacctggctaattttgtatttttagtggagacggggtttcaccatattggccaggctggtctcgaagtcctgacctcaggtgatccgcccaccttggcctcccaaagtgctgggattacaggcatgagccactgagcctggcctctaatatattatttttaatagctgcataatactccaaattgcagatgttatatagttcagtcaactatttcttatttatttatttatttagagacagaatctcactctgttgcccaggctggagtgcagtagtgcaatctcggctcactgcaacttctgccttccgggttcaagtgattcttgcctcagcctcccaaatagctgagactacaggtgtgcgctaccacacctggctaattttgttttgatttttgttttagtagcgacagggtttcagcatgttggccaggctggtctcgaactcctggcctcaagtgatccatccacaatggcctttagtcagctatttctcaactgaaggatactttcattgtttccacttgtttgtcactaagaacaatgctacagtaagcacattgatatttctaccattataaacctggtgcttttatttttatccccgagagtggggtttccaggtcaaaggagttatgtattggctgaggcaggagtattgcttgaggccaggagttcgagtttcttgcctggacaatatagcaagatccccatctctacaaaacattttttaaaaaacaaaaacaaaataaccaaataagtctgtaacaatttacatttccactagtaccacgtgtgactgtgctcttctctgactgcaataggtttagccttcttttttgtttgtttgggtttccttttcttgttcttgttctttttactaatttgtttatttttttttagacaatatcttgctctgtcgtccgggctggagtgtagtgacgcaatcatagctcactgcaaccttaaactcctggattcaagtgatcctcctgcttcagcctcctgtgtagctgggactacaggcacacgccaccaagctcggctaatttttttcttcttttctttatcttatggacattttcaaacattttgaatgcaaacagaatagtatgatgaacctccaaaaacgcatggctcagcttcagcaattttcaatattcttttattcccgcagacttctttttaatttttgcaaatttatgggcataaagtgatatacttgctgttacttttttaatcttgtttttacatttctctgactgctagtgattttgagcacattttcacatgtgtggaattgatattatgtaagagcctattcatagactttgcatattttttggttgtttgtctttttcttgtcgatttataggaacagtttgtatataatagatgttaatcctttacttatcttccatgttgccaatattttttctaatctgatgtttgtctatggtgtctattctaaagttttaaatttttatatatatcatgtgtatcattttttcttaaagcttctatattttctatattgcataagaaattccccaccaccaccaccaagtgcaatctggtagtttagaaaattgtttggcaaaatgttctgaagcagaacatacacatttcccatgacccaaaaattttgctgctaagtatatacccaacagaaatgcatagatatgttcatgtacagacatgtacagccgggcacagtggctcctgcctgtaatcccagcactttaggaggctgaagcagaaagatcacttgaggccaggagtttgagaccagcctgggcaacatagcgagacctctgtctctacaaaacaataaaataattagccaggcatggtggtggcacgcacctgtagtcccagctgtttgggaagctgaggcaggaggatcacttgagcccaggagttggaggctgcagtgagctatgatcgacctgccgcacttcagcctgggtgacagaatgagactttatctctaaaaataaaatataaaataaaatagtacaagaatattcatagaactagtcataaaagccaaaaactggtggggaaaaaaactaatgcccatcaacactacaatggtgcagccataaaaaagaacaagatcatgtcctttgcagggacatggatggagctggaggccattatccttagcaaactaacacggcaacagaaaaccaaatactgcatgttctcacttataagtgagaacagatagaggggaatgacacacactggggccttttggagggtggagtatcaggggaatctgcccccaacatttcaacgtaggttctttctattttccgtaagtgtcagctggctgagaaataaagagaaagagtagaaagagaggaattttacagctgggcctccgggggtgacattatgtgtcggtaggaccgtgatgcccacctgagccgcaaaaccagcaggtttttattaagaatttcaaaaggggagggggtgtacaaacagagagtaggtcacaaagatcacatgcttcaaagggcaaaaaggagaacaaagatcacatgcttctgaggaaacaagacaaggacaaaatcagaaactcctgataagggtctatgttcagctgtgcacatattgtcttgataaacatcttaacagaaaacagggttcgagagcagagaagcggtctgaccccaaaatcaccaggatggggtttttccccaccctaataagcctgagggtactgcaggagaccagggcgtatttcagtccttctctcaaccacgtaagacagacactcccagagaggtcctttatagacctccccccaggaatgtattccttccccagggtattaattattaatattccttactgggaaaagaatttagcgatatcttccctacttgcacatccatttatagcctctctgcaagaagaaaaatatggctgtattctgcccaaccccacaagcagtcagaccctatggttgtcttctcttgttccctgaaaatcaactgttattctgttctttttcaaggtgcactgatttcatattgttcaaacacacatgttttacaatacatttgtacagttaacacaatagtggtcctgaggtgacgtacatcctcagcttacgaagataacaggattaagagattgaagtaagagaggcataagaaattataaaagtattaattttgggaactgataaatgtccatattaaaatgaaatcttcacaatttatgttaagagattgcagtaaagacaggcataataaattataacagtataatttggggaactgatatatgtccctattgaaatgaaatcttcacaatttatgttcctgtgccacggctccagctggtcccttcgttcggggtccctgacttcctgaaacagtggagggtgggaggaggcaaaggtttaggaaaaataactaataggtactaggcttaatacctgggtgatgaaataatctgtacagcaaacccccatgacacaaatttacttatggaacaaacctgcacttgtacacctgaacttaggataaaagttaaaaaaaaattagaatgaataaataaattgtggcatattcatacaaagtaatgctatactgcaatgagaatgaactacagctacacatctcacaaaaataatactaaaaaggaagccagacattgaagagcacatgctgtatgattccatttatataaagatcaaaaacagacaaaaataatctgtggtgtaagaagtccaggtagaggttactcttgaaacagggcacaaggaactttctgggggagttgctcaagttctgtttgttgatctgtgcacaaaaaacagaacacaaacaatcacagtcaaacagatgtgttcactataggacctgtgatttttgtaccttctgtaggtatgctatacttcaacaaaaagtttactataaaatacaaaataaattttcccgtctcctagctcctagatagttcatgtaatattgtaaaccatcctcagagaactttattgtcttatttttcatatttacctttaatccattagaatgtattttatgtattgtggtaggcaggcttctaagatggccccagtgattgtcacctgctggtattcatgaccttgtatcatctcctccctggagtggaggctggaactggcttctgacaaatagaatatagcaaagttaggccaggtgcagtagctcatgcctgtaatcccagtactttgggaagccaaggcaggaggatcacttgaggtgggtttgagaccagcctggctaacagggtgaaactccatgtctactaaaaaaaaaaaaaaatacaaaaagttagccaggtgtggtggtgtgcacctgtaatcccagctacttgggagactgaggcatgagaatcgcttgaacctgggaggcaggggttgcagtgagctgagatcacaccactgcactccagcctgggcaacagagccagactctgtctcaaaaaaaaaagggcaggggggcttagaatatgttaacagggtatcatttctgagattaggttacaaaagactgtgacttccaccttgccagcatctctgctttctctctcatctctctctctctctctctctctctgatgaattaacttgcaatgttatacactgccctttggacagacccacatgacaaggaaccaaacaagggtggaccaacacctcttaaggaactgaggcccttagtccaacagcccacaaagaaatgaatcctgccatcaaccacagagtgagcctggaagtgaatccttccccagtcaacccttaagatgagtacagcccagacagacaccctgattgcagcctcactagacttgcagcgctgggccctgctaagccacgcccacattcttgacccacagaacctgccgaagaagaactgctgttgtttaaagccagcaattttgggggtactttgctatgcagccatataaaactaatgcatgtgtgatataagaaataaattttatttcttcctgatagatagaaaattatgccaaggattcatcaaatagtccaatgaattaaactatcatctttagctgagtgtggtggcgagcaccagtagtcccagctacttgagaagctgatgtgggaggattgtgtgagcccaaatttgaggctgcagcaagctatgatcatgtcactgcactccagcctgggtgacagagcaagaccctatctctaaataaataaataaataataaaaatatcatctttgacatttattaaattatcatatatattgatatttatttctggattctctgtttaatccaacttgtatatttatttatttgtcaattcctgtgctaaaattatattgatgctgtagttttgcagtatgttctgatatctagtaaaaataagcccctttctggctgggcacggtggctcacacctgtaatcccagcactttgggaggccaaggtgggtggatcacgaggtcaggagatcaagaccatcctagccaacatggtgaagccccgtctctactaaaaatgcaaaaaaaattagctggacgtggtggcagacacctgtagtcccagctactcgggaggctgaggcaggagaatggcatgaacccgggaggcagaggttgcaataagccgagatcgcgccactgcactccagcctgggcaacacagagagactccatctcaaaaaaaaaaaaaaagaagtccctttcccatgtttctttattctcacacttttcttgactgatctcaagcatttattttatttcaaattttttatctttaatttttatgggtacatagtaggtgtatatatgtatggggtacctgagatgttttgatacaggcatgcaatgtgaaataagcacatcaagcatttattcttgcatataatctttattttagccaatttttaaaaccttggatcaaaagaattatattatacttatattttaatttggggagaatttttttgttgtttttttgggagttttttgttttgttggggaaaattttttgtttgctttttagattttgttttgttttgttttgttttgtttttgtttttagagacagggtctcactgtgttacccatgttggagtgcagtggtgtaattattgcttactgcagcctcaaactcctgggctcaagtgatcctcccactgccaccacacccagctatttttaaatttttttgtggaaacagagtctcgctatgttgcccaggctggtctcaaactcctggcctcaagcaatcctcctgccttggccccccaaagtgttggaattacagatatgagctaccacacgcccaacttaattcagggagaattaacatattaacccctatataagatcttcccacgcaggaacatccctttacatttgttcacattttgttttatgtctttcataagattttaaggttttctttctgtaggtcctgtgcctttctacttaaatttattcctaggcattttcctttcggtggtattatgattggaatattttttgttttctcttcctgttttctctactctgttgctagaatatgagaaaagctattgatgtgtgtatagatctagagatttcagagcccttgagcacaaattgaggtgcagggaagaaacagaattttatttctttataactttagaaaatttatcaactttgtaaaatcttatagaacttcatagactttataaaatgtaacttttattttaagctccctttgtgccaggtggaagaaattcaatccatctggctcctcctagcctttttcagggtgggtttaagttccgtggaggctacacagcaccagcaggcaagagggcatgggggtctggtcaccatctgcaccagcgggtggcccctgagatgccaatggcctctgctgcatcgcctgtccttcccctctgaagtctccctcctccctccctcccccgctctctctctctctctctccctatatatgtatatatacacacacatacatacatgcatatatgtatgtatgtatgtatgtatgtatatatatacacatttatatttgagcacgtgttctctctctgccattttattttattttattttattttattttattttattttattttatgatggactctcactctgtcacccaggctggaaggcagtggcgcgatcttggctcactgcaacctccgcctcccaggttcaagcaattctcccgcctcagcctcccaagtagctgggattactggcacccgccatcatgttggctaatttttgtatttttgtagaaatggagtttcaccatattggccaggctggtctcaaactcctgacctcaggtgatccacccttcttggcctcccaaagtgctgggattacaggcgtgagccacctcgcccggcctctctctgcctttctgttttgagcacgcatgttctctctctctcttttctgagcacgcatgttctctctctttacctctgtctctctttgttctctctctctctctttctttcttttgagcatgcatgctctctctgtctctattttgagcacacatgttctttctctttacctctctctctctcttcatacacatgtattttttgagcacacgtgttttctttctctctctgtctctattttgagcatgcatgttccactttttttttttttttttttttttgagatggagtgtcgctctgtcacccaggctggagtgcagtggtgcgatattgtcttactgcaaccttcacctcccaggttcaagcgattctcctgcctcagcctccctagtagctgggattacagggattacaggcatcggccaccacacctggctaattttttttgtatttttagtagagatggggtttcaccatgttggccaggctggtctggaactcctgacctcaagtgatccacctgcctcagcctcccaaagttctgggtttacaggagtgagccaccctgcccagccgctatctctctctctattttgagcacacatgttctttccatctctctctctatatatatttttgggcacacgtgttctctgtgtgtgtgtgtgtctattttcagcatgcatgttctctgtctctatctccatctctattttgagcacacatgttctctctctctctttctgatttcaacacgcatattctccatctctatgtgaacatgcatgttttctctttatctctactaatcatctttctctctctctctctctcactccatcctccaagccactctcaggcactcaggcatgtggtaaacatccccacccgtctccatgtcacagtggacagtggggacccctctaacgggcccctctgccccaatacagaatgcagcttctcttctggagtcttcctgctttcccaggctctccccaggaagcaaaacgcagaacccctctgctcttggaccccacaaacccacatggggtcccctccttggatgaggggaggggctgcaggcctgggtctcccttccttggggacctggaacagcttctccctgtcccttcttgttctccttcctctcaaagtcgggaaaatcttttccagtctcgtttagtgtctgaaatctttttttttttttgagacagagtatcactctgttgcccaggctggagtgcagctcactgcaacctccacctatggggttcaagtgattcttctgcctcagcctcccaagtagctgggattacaggcacgcactaccacacccggctaacttttgtatttttagtagagacaaggcttcaccatgttggccaggctggttattgtctcaaatctagggtcctaacctgagttttctgaaaactcaaaaactagaagaattttcattttctctttctgctttctcatccatttgctgaggtaacaaaatttagggctgacttgcttgaatgggagaaggactgttggggaaaaggaaactctggagtggaaaaaacatgtaaatatttgaacataggatcccatcatacatacaggcacagggagaagaaaccattggcggaagtaggacagaatgttaacggggtgctgttttcaaacggtggacccatgaatgaactttttaaaaaaattttatttatttattttttattttttttatttttatttttgagttggagtgttgatctgtctcccaggctggagtgcaatggcgtgatcttggctcactgcaacctctgcctcccgagttcaagcaattctcctgcctcagcctcctgtgtagctgggattacaggcatgtgccactacgccctgctaatgtttgtatttttagtagagacagggtttcaccatgttggccaggctggtcttgaactcctgacctcaagtgattcacccacctcagcctcccaaagtgctgagattacaggatgagcccctgcacccagctgattattattaatatttttgagatagtgtcttgctctttagcccaggctggagtgcagtggtgcagtcacagctaactgcagcctccagctcctaggctcaagtgatcctcccacctcagcctcctgagtagctgggactacaggtgtgagccaccacacctgtccagatattttcttatttaaatttttctgaattttacaaagtttctagaatgtatattgcttttatcattacacacacacacacacacacacacaatttattccagttcatttgcagtttgtattttatgcaagtcaaattttttgcatgagaaatgcctgaatccaagcatagtaaacacaatgtacatttcaaaacaatgcagagtgtacaaaatatagagcagaaaggagggttcattcacacactcaatagcttgggttaggttctacaatggcaaacaatcacttttgttataaagttaggagtactgggccaatttaggggtgttggaacagctaagcatgaaagagcaaccaagtaaactaaagacttcataatgtacatatttctttgtttttgttttgttttgtcttgttttttatttatttatttattttgagacaaagtctcactctgttgcccaggctggagtgcaatggcacgatcatggctcacggcagcctccacctcctgggttcaagcaattctcctgcctcagtctcccaagtagctggaattacaggcatgcgccatcacgcccggctaattttggtatttttagtagagacagggtttcaccatgttggccaggctggtctcaaactgctgacctcaggtgatccacccacctcgacctcccaaagtgctgagattacatgcatgagccaccgcgcccagcctgttttgttttttagagacagggtctcactctgttgcccaggctggagagcagtggtgctacctgcagcctggatctcctggaatcaagggatcctcctacctcagcctcccaagtagctggggctactagtgcacaccagcgtgcctggcttattttttattttttgtagagactgaggtcttgctatgttgcccaggctgctcttgaacttctgaacctggtatggcttagtgtgaaataactttcacaaaaatcccaacctgtttcaacccagcctaagacagtggtgtagttccttcagatggtcagctaggaggtccaagcaggataaggacaaggaaggggctgacagagtggaagagagactgagggatgaaggtaccgtgtaggtcagggcacagggataaggagaatgaaagggtgaaaccgttgcatggagaggaggctgcaatcagagaaagggacattggaactaaagtggttctgagtgtgacaagggcccagtgcagttgtggcgtgggggataaggtctccaaagaggtacacccactgagaggctgcaatgctggctaagctgtaccttggacattgaagacaccaaggagagtggcaggatttgtgatggagatgaaggctaggggccaagctaccaagttttcagtaactgtgaggggatgaccaggagggccaaggatgacaaagaggacggggagaaggtggcagagctgggctgcatgaccctcaaatcagcagggatttttttttttttatttttacacaaggatgaaggagacatgaatgagttgaaacttgcaaacagggtggaccttaccttcaaggaccctggcagaccctctctgaacaaaactggagacatctaccaggagcaagggtggtcacggccattagaaggtgcccttccatgcggagttgtcttacatctaaggcataggaatctctaagctctacgaagacagggacctcatcatcttgttcatcaggcaggcatgtcatagcttataataaatgcatatttattggctgggcgcggtggcttatgcctgtaatcccagcactttgggaggacgaggtgagcggatcaactgaggtcaggagtttgagaccagcctggccaaagtggtgaagccccatctctactaaaaatacagaaattagctgggcatgttggcccacatttttaatcccagctactcgggaggaggattgcttggacccaggatgcaaaggttgcagttagccaagatagtgccattgcactccagcctgggtgacaagatcgactctgtctcaaaaaataaatacatgcatatttatttatttattttatttttggagagtgtgtctctctctgtcgcccaggctggagtgcaatggcacagttatagctcactgcagccttgacttcctggctcaagcaatcctcccacctcagcctcgcgagtagctggaactacaggtggacatcaccacacctggccatttttttttgtagagatggggtctcactatgttgctggtctccaactcctggtttcaagtgatcctccctcctaggcctcccaaagtgctgggattacagaggtgagccacttacctgacccataataaatatttattgaacgaacgactgaattcaccaattaatcgctatttcctgatagcccaccgggatccgctggtgcaatgataaagagcgcaggctttgagatcaggcggatctgtattgggactgcggctctcagcctccgcttgtacctgctgtgcagtgaggactccaggaactgatgatgaaccggcacggtcctcggcacgtggcaagttctccataagtgggctcagtaaaatccctctcccgggaaagcgccccaccgtgtttggtggggtgactgggacgcgaggatgcggctgggagtgtgatgagaagggcggggatcggcgaggactccaggctggggttgcaggcccagccaggggcggagccttctccgggtcgggcggggacagagcgctcccttggaggcacccagggacctggccagccgtgcagctgcccaggcgctatggcgagtgcggtcagggggtcgaggccgtggccccggctggggctccagctccagttcgcggcgctgctgctcgggacgctgagtccacaggtgagagccagggaccgacgccaagtccccaaagtctggtcgcggggcgcagggggcggcgtcgcacttggggcgagggcgcggcggggccacgggggcacctctccctccctcacgcctgggtggtcccaactcggccccaacggagtaaaagcctcctgggtttggggagccgccagttgcccccaacaaatacctagctggggagatctgccagcgtggaaaggcaagagtagacagagcaccccgcctcttcagcagggagaggtgtagtctggggtaggggggcacctgggcacgaaagccaggcctcttaaaacttctgggaatcctggcttcctttgaaaatatgattgacttcagggccctctgctgagaaatgagcctgcacgcccagttttgcaatttcagaggctttacaatacggtccccttacccatggctgcaccccaggttcagaacctatgggataaatgagctgggagtgtcagtatctgctcccacggtgccaggaatagcagagtcttacagaaatgcagccaggaggcaaaagtcgcctggcctaagaatccaggtgtcccgcctagaacccccatggggcaaaagcgatcaggtagagttaggcacctctcattcccggcttccacctcatgggtccacctcatggttgccagctaagaatgcaagcccagtgtggccagatcggatgtctctggaaaaattagaaatgagaaagatttgaaatcttggtttttttgtagaaatcatccaatttttaaaaaaattggcagctaattgaaaaatttttaagcactagatggtcaaacaaaattcatttctgggcaaccaatctgcagcctcttctccaaaccgttctccctcctgccatgctgcagatgacaaaattgaagcccagaaagaaagaggggctagcagataatttcctgaccctccactcaacaccagtggcccagccccaaacctgagggtcctgaagcaggatgtggcctttgtaggggtgcggctgggccacccggatgttaggcctcctgctgggagctcagcctcaccctgtttgctcaaggagggactggagcaggtgagtgagcccaggatcgccagatgtaagtacgggtggctccagcccccctcccaagggcaccccccagccttgggtcaagggacccactggagcctggcaccaaaaccagctgggctggtttggggaggcagaaaggggcatcccaaaagaggtagacattgtggcagaggaaaaagaggccaggcataggaatcagagggatggcaactcaagtccttagttttgccacttattatctctgtggctttatgccaatgacctaaccaatgacctaactttcctgagcctcagtctccctcctctgtagaatgggaaaactaataataccagtcttagaatgggtgcagtggctcatgcttgtaatcccaatactttgggaggctgaggcaggaggatcgcttgaggccaggagttccagaccagcctagacaacatagcaagaccccatctctacaaaaaaatacaaaaattagccaggtgtgatgacagacacccgtagtcccaactacttgggaggctgaggtgtgaggatcagctgagcccaggggtttgaggccacagtgagctatgactatgccacttcattccagcctgggcaatagagcaagaccctgtcttatattaaaacaacaagaacaataacaaaaagaaacaaaacaaacaatgaagtcattttgtaaaggcctttagtcttctttggaaaaccagaatgaattgaggaaggaggtaagtaattgggaatttagatacattgggagccaaaacctcccctcagaaccccccagcttccactataacccttctctagggtcaaagagatgatgagtgacaccagcacgttccccaatcacccttcctcccctgctgcatccccatctgggggaaggggagtcatggccagccctgcttgggacaggagcaaagggtggtcccagacccctcagagagctgactttgtctctacccccttgcaggttcatactctcaggccagagaacctcctgctggtgtccaccttggatggaagtctccacgcactaagcaagcagacaggggacctgaagtggactctgagggatggtgagcaagaggtggtccctcctccctccttgggcccatagattggtgaagggatagtcactgtggcatagagaataagaacatgggctctagaatccaataagctggtatctacaggcagcttcactgcttaccagctgtgtggccttgagaaacccaccttacctctctgatcctcaacatcctcatctataaaatggggcaaaggatatgaccctatctgacagagtttttgggaagatggcattacattcacaccaagtgcttgacatcacagtcatgccatagctcagtgaatatgagctgtgcttttcagtggggtctggaggaaactgcttatgttctgtgtccctgtccctgcagatcccgtcatcgaaggaccaatgtacgtcacagagtaagtgaacctggggccttttaaggaggaggcttctgggagatgggggactcatagttgtctggagagagtttgtatgtggggcagggacatgttggaagtaagggaagagaattggctctggatgtgatataggggagggtcttggagccccatgatgtttcctacaagaacaggctcctagtagctgagaaattggaaggaatttggggccttcatgaaaccagggggcaagaacccattggtctccttgtttctctctgctccacagaatggcctttctctctgacccagcagatggcagcctgtacatcttggggacccaaaaacaacagggattaatggtttgtatcccatggtgttcgggaatgggtgagagccagggctttcgtcagctggagcactgagaggtggagaggcagtatggtcagtatctcctgttctgcagaggatataagtcaggactcagcacattgtgagaaggctgtctgagggacctgttgaaagggtggtaaggggaggtctggctgtgtctgcagggcaatctgactatcaagctggaggtatcccagggccttctccaggactctgagggctttaaagagaaatgtatataccagttagcttttgctaaataaaaatcaacccaaaactcaagagcttaaaactaaaacatcacttaaatttattcaactcagaatttggtgagatgacaatttaggttgggctcagcacagtggttcttctgctggtcttgactgaacttgttcatgcatgtgtggtcagctgctagtcaactggatggctgtgtttctgaaagttggttggtagttggttggcttttggcagaggtggctgggccatatgtctcttatccctagcaggcaagcctaggcttgttcacatgatatcaacaagggaccccaaagcagcaatacataagcacttttcaagcttctgtttgtgtcacatttgctaatggctcatcagccaaagcaggtcacatggccaagctgagaatccagtggtgaaaaaacagattccatctctttatggaaggagctgaaaactcaccgtgtgaagggacacagacacagacatgaatacaagatgaaaagcaatctgtggccattttttgcaatcttccacatcaggactctgaatggggtggaatgtgctttgtcggaattccttttttttaatttaaacaaattttttaaagacagcatctcattatgtgtccaggctggagtgcagtggtacgatcacaaggctcactgcagcctcgaactcctggcctcaagcaatcctcgcacctcagtatcctgagtagctggaactacaggtacacaccaccacacccagttctttgtcagaattctaaccatgtcaggggaagcctgctagaaaagtcttaagtatatgatttaggaaggtgaagtgataagaaattttagtgtgtcaatcaggcaaggtctcagctgcaaacacatggcatactcaaatagaatagtttgaggacattttgttaaaagtgtgagcagagtataggaaaccacaagggatagtgcagtatattagttcattcttgcattgttataataaaaaaatacctcagactgggtaatttataagaaaggaggtttcattgactcatggttctacaggctgtacaagaaatgtagtagcttctgcttctggagagacctcaggaaacttacaatcacggcagaaggcatgaaggggaagcaggcacgtcttacatgcccagagcaggagcaagagagagaaagggaggaggtgccacccacttttaaacaaccagatctcgtgagaactctattacaagaacagcactggctgggcacggtggcttatgcctgtaatcccagcactttgggaggctgaggtaggcagatcacctgaggttaggagtttgaaaccagtctggccaacatggtgaaaccccgtctctaccaaaaaatacaaaaattagccaggtgtggtggcacgtgcctgcagtcccaactgcttgggaggctgaggcagaagaatcgtttgtacccgggaggcagaggttgcagcgagccaagaccgcaccactgcactccagcctggacaacagagtgataccatgtctccaaaaaaaaaaaaaaaaaaaaaaaaaagaatagcaccaaatggaaagatctggccccacgatccaatcacctcccaccaggccctacctctaacattggggattgcaattcaacaagtgatttgtgtggggacacaaatccaaaacatatcatgcagtatcctttggtttgtgacagtggggtgacattatcagccctaattctggaggctggggagggagcagctaccacagcctggagctggagagagctgtcccgagagcaccacccgatgggacctcagggcttcggtagaggaacacagccagcccgtgaggactttgtgacaaggacagcagggcatactctgatctcaccctgtccccattatccaaacccagcaggaagctagagcacatggtgcccacagacataacccagacaagtccagctttggggagaaagcagagtagagaagggtggaggatggagctccactcctagccagcatcaggccatggtctcctttattctagaacaactccttcacttctgtgagtctctcatggctgttgacagttttgaaatattcatgtgagttgttttggatttttggaattaaactccccacttgatgtgtgtgcggcttttttttgtttgtttgtttcattttattttgtttagagacagagtctcactctattgcctcggctggagtgcagtggcacaatcatagctctgcagccttgaactcctggacttaagcgatcctcctgcctcagactcacaagtagctgggactacaggcacatgccaccatattcagcaaatttttttttttttctgtagagacgaggtctcaccgtgttgcccacgctggtcttgaattcctgggcccaagcgatcctctgcttcagcctcccaatgtgctgggagtataggcatgagccaccatgcctgccccagtgcaagttttcgaggaggtggtcaggtcaggccgagagcaagtggctcacatgataccttgacactgggtgtgggaatttctgcatttcctcaagaggctgtgtagcaaaatgattcagtgtgctggctctggagcctgactgcctgggttcaaggccaggctctgccatttagtagctgtgtgacattagccaagttacatggcctctccaagccccagtttccttacctgaaaagtggaaatgatagtaatacctgttaattggttgctatggaaatgggctcacctggcacagtgagcactgtgtgttgctgctcttactccttcctgtaaattttccgtctcctagaaactgccattcaccatccctgagctggttcatgcctctccctgccgcagctctgatggggtcttctacacaggtgagcatctcttcagcctgtggggtccaggttcagccagcagaggcagggatctaagtcgtgacggctaattaggcacaagagtggcggggccacacctcttcccatgccaacttgagagctaacacactttccacctccacaggccggaagcaggatgcctggtttgtggtggaccctgagtcaggggagacccagatgacactgaccacagagggtccctccaccccccgcctctacattggccgaacacgtgagttgggccccagctgttcctcaagctctgggcagcctccccttttgctctgctgagatctagctgtggctaaccaagttgaattcaggacagtcagtctgttagtcatcaacaaacattctacagagcactgaactaggagccaggaatagagctgtaaacaagacagctccagtctctgccactgtgatgttcacaggcttccaggtctctaggctgtgtgctcaggaaacccccactcctgcaagataaatggcccctggggttggagggagcatcaaatggacgttcctggtaatcttgcttctgggatccccagagtatacggtcaccatgcatgacccaagagccccagccctgcgctggaacaccacctaccgccgctactcagcgccccccatggatggctcacctgggaaatgtgagttccacctttctctggtcccatcttggagcaaggtccccaacccagggaaccctgaacagcatccatgaccaattcccagccacatttcgacccacttgacctccccagggaccccatatactaaatggcacacccctgatggctgaccccaagtgactccctcaacacccagactgaccctcctgaaccctggccaatccctcaacctcctaactcttctatactccaagtggccccaaccgggtaaccctggatgacttcccacatccagagtgaccccaaacagcccctaagcaatctctgtgtgtcctaactgacccctatatataacccctgaaagctaaccctaagtagcctcttccatagaccgactccccaggtgaccccgaccactccccaccattttttgtgagatggggtctcactctgtcacccaggctggagtgcagtactgtgatcacagcttaccgtagcctccaactcctgggctgaagtgatcccctatcctcagcctcctgaatagctgggactgcagatgtgtaccaccaagcctggctcatcttttaatttttgtgtagagatggggtcttgctatgttgcccaggctggtctcaaactcctgggcttaagtaatcctcctgtcttggcttcccaaagtgctgggattacgagcataagccaccacacctggcccacccccttgatattatgactgatacccaactgcctgagtgaccttacaggtgccccaaggccccctcaagccctgattccatcattctgcatgagaccctacacaggtcacctcagcagaggtgaggtcacctactcgccccaactgacccctctcacactgtaagtgactcccaagtgacccaaatgcctccaggccaccctgattgatccatcccaggtgaccatatgttgaccatgagcaataccccaccatcctaagtgacccaaactgactcccacacatctgagtcacctttgaatgaccctgactgatggcctcgttttcaaagtgactccatgaactccaacaaacattctcatgtccagataaccctccatgtgatctccacacaccagactgacccctcacccagagggcacacccttggaccctcttaggagagcttccaaccacatctccccagccacctttctcggcagacatgagccacctggcgtcctgcgggatgggcctgctgctcactgtggacccaggaagcgggacggtgctgtggacacaggacctgggcgtgcctgtgatgggcgtctacacctggcaccaggacggcctgcgccagctgccgcatctcacgctggctcgagacactctgcatttcctcgccctccgctggggccacatccgactgcctgcctcaggcccccgggacacagccaccctcttctctaccttggacacccagctgctgtaggtgttcgtgcctggggcccagggagggagccatctgggagtgtcgcaacctgggtctgatggccaggcgagatgttcagctgtgacacaccagtaccgctgaaccaggggtcaaaacatttcaaattggttacttacccaactggttggtaaataaccagtgtcctctgctgccctccaagtgtccccgggaccccctgggtagcccccactgttcagcaactcatacggtaagatctggcctaggagggtgtattagtctgtttcatgctgctgataaagacatacccaagactcggcaatttacaaaagaaagaggtttaattggactttcagttccacgtggctggggaagcctcacaatcatggcagaaagcaagcaggaacaagtcacatcttacgtggatggcggcaggcaaagagagaagcttgtgcagggaaactcccccttataaaaccatcagatcttgtgagacttattcactatcacaagaacagcatgggaaagacctcatgattcaattacctcccaccgggtccctaccacaacccatggaaattcaagatgagattttggtggggacacagccaaaccatatcagagggggactccaggtcttaacctgttctggttggtaggtgctgtgccttatggattgttaaatactttaaataacaaccttatttaacttaccttatttaacaacttatttaaggtattattgcatctaataccttagtgtccccatcttgataaaccagtagacagcttgggaaaatcagggatcatctattcattcaattcattctgcaaatattaattgagcacttactgtgtgccagtctcactagagtctgggagtacaatagcaaataacccagccattgttcctgcctcaggaacccgagtctaatgggagagacagatatgtgaagagactattgcaacctgatatgataaaggatgagaagaaagtagtataagatgccatgggaatgtataggaagagtacccacatcaagactggggacaggaggcagtcatggaaagcttcctagaggaaggaacatctaaactgaaacctaaaaaatgaataggaaatgagagagatgagagagcatagaattcaggtaacaggaaaaaattaaataagactgaaatacagacctgagaaaggagtagagcctgagattataagctaagaagagatcttgtaggatcatttaaagggcttggacattttctcctaaagttaaaaagtcactggagagttttaaggaaggaagtgatttaatcatattttcattttagaaagaatatcttagaatggtatatggaaagaagtggaccattcatggaatattgatttgttcaggcaagaaatgaagatactttatactagagcagaaactagagagaggaaaataggtggagtgtaagatatattagaaggaagaactagtaaaaatttggtgattagggagtttgacgattgtgagcaaggagtcaaagatcatgctcaggtttctagaagcacgtgggtactgtcattttcagaggcagggaacactagaggaggtgggggagaagaaggaggaagaagtaaaggacgatgtaatgagtttatatttagaaaattgagctcttgaaagaggtctgggttagacatagatttgaaatcatgactatggaacatgtatcagctagctttagctgcataacaaattgccccaaaacagagaacttaaaaaacaacagtttattatttttcaagattctgtgggtcagctggggtgggttgtttttctgcagtctgctcatggcttggttgagtctggagaatctaggatggcctcacttacctatctcatagttgatggactgtttgacctatgggggattaaagagatctctcacaccccagcaggctagcctgggttttctcccacggtggtctcagggtctaaagaaaaatgcataaggaagcctgaaggcacaagcacttttcaagcctctacttatgtcacatttgctgttgtctaattgattaaagcaagtctcatggctaagctgagtcaatgtgagagggaaatatacaagggcatgagtaccttgataactgaaactacccatcaccagcattcattcttctcttctttttcttctctcccactagaatgacgctgtatgtggggaaggatgaaactggcttctatgtctctaaagcactggtccacacaggagtggccctggtggtaagaagtggtctctgagtgggctggaaagaggatgaacgggagaagaacctccctcactcatggctctccatcttctgccatagcctcgtggactgaccctggcccccgcagatggccccaccacagatgaggtgacactccaagtctcaggagagcgagagggctcacccagcactgctgttagatacccctcaggcagtgtggccctcccaagccagtggctgctcattggtgagatcctctggctcaaattgggagtagatgaagataaagaacctgtgagcccagcttctgagctggaaagctaaggtccccttcagcctgatgacttttgccccccaccttaggacaccacgagctacccccagtcctgcacaccaccatgctgagggtccatcccaccctggggagtggaactgcagagacaagacctccagagaatacccaggccccagccttcttcttggaggtcagtgctgggaggggagagagtgggggtagggaggccccagcagatggggggaatagcccttggatcttttcctcgggctgctaagaataacactcgggggtgggtcaattgacctcacacaatttcccagactttttgttgggaacaacacaacttgttgttgttgttgttgttgttactgccagaaacacgttagaagtgttaaaaagtggctgggcaggtgattcatgcttatattctcagcactttgggaggtcaatgtgggaggatggatggcttgaggtcaggagtttgagaccagcctgggtaatataacaagaccccatctctacaaaaaaataaaaataaaaaattagtggggaatggttgtgtgcatctgtagtcccagctactcaggaggctgacgtgggaggattgctcgagcccaagagtttgaggctgcagtgagctatggtcacaccactgcactgtataacacagtgagaccctgtctcaaaaaaaaaaaaaaaagacattgactatttaaatcatgaaacataggtcacattttctttattcttcttcagcgtaaaaattgtaaaatattcattgaaaacaaaaactataaaagcatgtgctcctgggagaggtttggaccaaaatcactagtaagtagctcaaggttagaaggaacagccatggcctagagcaataattctcaaatccggttgctcatcagaatcacctgggagcccactccagcgctaacgcgtttaggatctctggaggtggacatctatatttttagtgacattccaagagtacctgtgttttttagtgacatcccatgaaatgctggtcattgggtaggtttagaaaaccgttcttctgggcaacatgatgtttcagcactgtggagagtgccacgtttcccaccatacacagaccactcactgccccttcagctaagcccagctctgtgctgggtgatgaagaaaagttaggggttccctggtggaagggggtgctaaaagtgaagggccctttatccccagctattgagcctgagccgagagaaactttgggactccgagctgcatccagaagaaaaaactccagactcttacttggggctgggaccccaagacctgctggcagctagcctcactgctgtcctcctgggagggtggattctctttgtgatgaggcaggtaggcccaccgccctgacctcaggtctatctggggagaacgctgcttctcctctctgagaccactcagcaactctctccctctacccagctctgattttgccccctgcctccctcccagcagctccccaggcccctgcgatcttgctctgtaagttcatgcagtctggtgaggccatctcagtcacagatactgggcccatcacggggcagggcgtggccaggacaaagctctcttaggctctcatgttacagcaacagccgcaggtggtggagaagcagcaggagacccccctggcacctgcagactttgctcacatctcccaggatgcccagtccctgcactcgggggccagccggaggagccagaagaggcttcagagtccctcaaagcaagcccagccactcgacgaccctgaaggtgagcctgtgtgaacaagacagggcagtcaggaacagagaaaagccaggggcagatttagctgcaaagctggtttattaaaagccactatagtggggtggttaggtctacatgaattaagaagagtgttttgagtagagcctgctacgtaattgagcactctaggagtgtctgctgtcattttttcatcattatttttttggagacaggatcttgctctgttgcccaggctggagtacagtggcacaatcatagctcactgcagcctcaagctcctgggctcaagaaatcctccctcctcagcctctcaagtagctgtgactacaggcataaaccaccatgcccagctagttttaaagttttgttttgttttgcagagattgggtctcgctatgttacccaggctggtcttgaactgatgtcctctagtgatcctcccaccttagcctcccaaagtgctgggattacaggcatgagtcaccatgcccagctcattattgtattattattttcaaggaacctgggtgtagataaaactgggtatagatctaaggctgctctctgtttacctcttttgagctcagttttttcatttgtcaaatgggaataataacatccagttcattacatcatctcatcatgagaagtcacaatcattattattaaataatacttaggtaatattaatattcatgttaaaatgatgttatatttggaaacaataatagtaaacgacctttgtacaatttagtaccttttattttttaaacacttatcttttctcaatttagtcttctaaagactaaagcccttttaggttgggcatggtggcttacacctgtaatcccagaactttcagaggccaaggtggggattgcttaaggccaggagttcgagaccagcctgggcaacatagggagaccttgtctctacaaataatacaaacaattcgccgggcgtggtggtgtgcacctgcagtcccagctactcagaaggctaaggcaggaggatcgcttgagtccagaaggtcgaggctgcagtgagctgtgaatctttcaaggttcctctggcatctggaatgttccaggggcttcttgcatgcctttaccaatcagcccaggctacttctgcttgattggctctgggctggctcatggttttggttgtctttgtgaacttgtgctggcaccttctagtcactgctcaagccacttcctcataccttggccccaccctgccgtcaccttctcaggcggaagtctatgccacacttggcttgatactccagtgctgttcgcaatgtccgcctctgtggtcattgtgccttagcccagaggaaaacagctccccttcctcaggggtcagctcttttagagggccctgcagcaggatttcctgagccctgagctgttgtagtttttgtcattttactggccctgggtgggtccaagtaatactcaccccactgtaccccaaaacgcccatctccctggaccttcggactcgagttgagtctggctcatctttacctggacaaccaggactccatctttccccaggatcattcttgtcaaagtcctcatggactattttatggttcacaaaattacagtggagtcacagccaactttcatttaacttgaataaatttggctgggcacggtggctcatgcctgtaatcccagcactttgggaggccaaggcagggggatcacttgaggtcaggggttcgagaccagcatggctaacatggtgaaaccacatctctactaaaaatacaaaaatgagtctggtgtggtggtgggtgcctgtagttccagctactggggggtggctgaggtacaagaattgcttaaacccaagaggcagaggttgcaatgagccaagattgcgccactgcactccagcctgggcaacagagcaagactccacctcaaaacaaaacaaaacaaaaaacccacaaaaaacaaaaacaaaaacttacacaaattcatctacatgtgcttggctgggcctccctcaggacctctggctgcatcatgtattcaataacaagtggatgcaatccagcctgaaccagggataacatttctatagcgcttactgtataccaggctataccaggcagtgttctgaatcctttgaatgcattaactcatgagataacattcctgtgaggtgaatgttattatagaattctccttttatggaagaggaaactaaggcagaaaggtctagtgacaactcccatccttacccccggctcacaaagctaataagtggcagctcaggggtccaaatgcatgtggctggctccagcaagtgccctaatttctgtgggatggtgcccctgtttgaacaatacctggcaaatacctgtgaaagaatgtgactgactgtaagtgttccccaacctgtgtagaagcagcagcaaagtccatcatgtgtatgcaggatttccagaggtaattctgactgtatgccctttctccctgacacgagatttttgattactttagaattgagcttgggaggcttaggtgggaggattgcttgagcccagcctgggcaacatagtgaagccccatctctacaaaaattaaaaatacaaaaagattagccaggcatggaggcacatgcctgtaatccagctgcttggggggctgaggcaggaggattgcttgagcccaggagttcgaggttacagtgagctatgatcacgccagtgcactctagcctgggtgacagagtgagcccctgtttctaaaacaacaacaacaacgacaaaaactcccacatttgctgcctctccattataattatgcaaaaggctaagcaaagtgataacaaatatctgtgtgtgcagactgagcctccccagctcatatatctgcattgaaggcctttgtggccttaagtctggcctgtctcttcgagggtgcttctgaacatctaatccaggaaactctaagcaagtgtttactccatgccgagagtactgagagcagacacacaagagcctctgagtccagcagagccagtgacacaaagagggcccagaagggtgactgtcacctgcagtcagatgagcagggtttgttcaagcagctctgtccctgctctctgatctgcctgtttttcctatgtgtgggtgatgtacttccagcaaggccctgcctgagcccatctactccagaaagtccagtgtataccaaaggtactgcctgcatcttactgacagatgagtatgaactctaagcaaataatccagaggaatgctaaggtgcaacttggtgttttctcactgatccctaatgctgattttattattattattattattattattattattattattaattattgagatagggtcttgctgtgtcactcaggctgaaatgtagtggcgtgatctcagctcactgcaacatctgcttcccaggctcaagccaatcctcccacctcagcctactgagtagctggatgacaggcacacaacaccatgcctggctagttttttttgtaaagatggggtttcatcatgttcccaggctggtcttgaactcaagtgatccacctttcccggcctcccaaagtgctgggattacaggtgtgagccacggtgcccagccctaatgctgattttcatttactcttcccagagctgattgtaaaaactgaagctaaaaactcttataaagtagagtgttctcaggaccaccgcactgcacaactctaggggtgccatatatgttttgccatatgaatagtgcccgttggagctgagcaggacacagcctgcccagatttgccagggtcagagtgagacgtctctcacaggctgcccaaagggaagggcagtaattgtcccaacctacagatctttgcccacctgagccgaccccacccatcctaatgggaaaccgaggcctctaggggtacccctgctgccctggaactaactctgggcaggttagcatccaatgcccactgcttctgtccggtccagtcttttttctgtggctatactcactctcatcactcttccaactgccagaactcaccttaccttgaagttgaagctgattcagtgtcaattaaaaggattcagttacaactggtggaggtgggcagaatggcagaggatgtaaagggaaaacaaagcaaaacaaaacaaacctgtgcagaagatgctgaaagagggagagaaataaaagaggataatatagcaaacatcacctccacccgttctttccatatatccatttaatcctcacaataatattgtgtgggctctttagctttagctccccactctacagatgagaataccgagggcacagaagtgaggaatttgcctaagtagacaaagaatcagtggcagcaccaggcattggatccagacagtctggcacttgggcccttgctcttacccactgcaccaggctgagcatgggagggtggaggcccagaaaatgtcaaggtgagtctggactgggccagtggccggcaaaggtgggcagaggctccctgagtcaccaccctcctctcccccagctgagcaactcaccgtagtggggaagatttccttcaatcccaaggacgtgctgggccgcggggcaggcgggactttcgttttccggtgagtggcagccaggagccaagctggggacatggcactcacagccctcgtgggcactgtcccctggagagacattctttcaaagactccccgaggtgggtacaggttgatccctcactcgccagtcctgctctttcctttatctgtttttttttttttttttttttttttgagtcttgctctgttgcccaggctggagggcagtggtgcaatctcagctcactgcaacctccgcttcccaggttcaagcaattccgggcctcagccttcccagtagctgggattacaggtgtgtatcaccatgcccggctaatttttatattttttttagtagagatgggggtttcaccatgttggccaggctggtctcgaactcctgacctcaagtgacccgcccgccttggcctcccaaagtgctaggattacaggtgtgagccaccatgtttgtccctttatctgctttccctgaatgcccccctgcccccgccatcacccactttccaggggacagtttgagggacgggcagtggctgtcaagcggctcctccgcgagtgctttggcctggttcggcgggaagttcaactgctgcaggagtctgacaggcaccccaacgtgctccgctacttctgcaccgagcggggaccccagttccactacattgccctggagctctgccgggcctccttgcaggaggtgagttgcattgcggttcagggagggtgagtgggaaggtccgggctggagagtgatgctttggcccttgctgctgctcagtacgtagaaaacccggacctggatcgcgggggtctggagcccgaggtcgtgctgcagcagctgatgtctggcctggcccacctgcactctttacacataggtacccgcacttcccctgcctcccgctccctgtccttagcccctgccttccgccctcagcaaccagctttctttctgcccctctcccacagtgcaccgggacctgaagccaggaaatattctcatcaccgggcctgacagccagggcctgggcagagtggtgctctcagacttcggcctctgcaagaagctgcctgctggccgctgtagcttcagcctccactccggcatccccggcacggaaggctggatggcgcccgagcttctgcagctcctgccaccagacagtcctgtgagtctatccaccaagtcctccaggcacacagctgccccaggctgcaggaatccgtccctgtcccagttcccctcctgaggagactccatgacacttgctgtgtgactttgagctgctcctccaagcttgtttcccttaaagaagggataatttgtccctccttctacagcagtatcaggactgttttgccacccaggggacattaggcaatgtctggagacatttttgactgccatgacttgggagggaggggctactggcatctgctggaaatgctgctaaatgtcttacaggacaggacaacacccaacacaaagaactaacaaaatgccagttgtgctgaggttgggaaaccctgagctagaaaatggtttgtaatcttcactgtgcttcacaaccactgcgcaacttaaaaaaagaatgcccattgccgggtgcggtggctcacgcctgtaatcccagcactttgagaggccgaggcaggcagattgcttgagctcaggagttcgagaccagcctgggtaacctagggagacctcgtctctaccaaaagcacacacaatttagccggtgtgggtgtgtgcatctgtggtcccagctacttgggaggctgaggtgggaggatcgcttgagcctgggaggtggaagttccagagtcaagatcacactactgcactctagcctggacaacagagtgagactctttctctcaaaaaacaaaaaacaaacaaacaaacaaaaccccaggccccacaccccgtgatttttacctaattgcctgggtcatttttatgtggagccaagttccagaaccactggtatcgaaggttttggagggcatcagatgagctaattagttgatacacagagcagcgtctgacccacacagacacttgcgtttgggacccctgaattacggattttgagtcacagtgtgtgggcggaagttgaagccagagaaatggatgccaatcacacaaaaggacagtcaccagggaaggctgcccccactcctaaagttgagagaaagctcaaagtggtgagcagggctcaaggactaaatgcatgatgtcatgagactatacagtttatatttaaattagtggcctatatatatatatatttttttttttttgagatggagtttcgctcttgttgcccaagctggagtgcagtgacatgatctcagctcactgcaacctccacctcctgggttcaagtgattctcctgcctcagcctccctagtagctgggactataggcaggtgccaccatgcccagttaatttttgtatttttagtagagatggggtttatgccatgttggccaggctggtctcgaactcccagccctcaggtgattcacctacctcggcctcccaaagtgctgagattataggcatgagccactgtgcttggccctatatatatatatttttgagacagggtcttgctctgtcatggagtgcagtcataccatcacagcttactgcagccttaaactcctgggctcaagggatcctctcacctcagcctcccaagtagctgggactacaggcacacaacatggcacccagctaatttttgtatttttttgtagaggcagggtctcaccatgttgcccacgctggtcttgaactcctggcctcccaaagtgctgggattacaaggtgtcagccacatgcctggcccaatattttaacatttgagaaattccacataaaatttggatttctggattttctttaaaaaaaaaaaaaatcagaatcgcttgaggccaaaagttcaagatcgggctgggtaacataagaagacccatctctacaaacaatttaaaaattggtcaggcatggtggcacatgcctgtagtcccacctactcaggccgaggtagattgcttgagcccaggagtttgaggttacagtgagctgtggttgcgccactgcactctagcctgggcaacatgagcaaagccccaacaaaaaaaaaaacaaaatcagctctgccaccctggagagtcccctggtgacaaccggttgaagctaaggaccagctgcccctgcagaaaaaacccatgccaggtcaccacagtcctcctgattgccttattgcctcatgtatggcacccacttatgtaaccctataccctgcaggaatgaagcttggaaacctgaactagctcagtaagggcaaaggttttggatgaaaaccatgggccccctatagtagtgtagaggggagggatctagagccaaggagatgctgcccaggaagcatcttgagttccagtctgagccaaacccctggcagctctatcagcccatgggagaatttagccaggctgacttcctggaagcagagatttccttctcatgcccatctctctggctccagaccagcgctgtggacatcttctctgcaggctgcgtgttctactacgtgctttctggtggcagccacccctttggagacagtctttatcgccaggcaaacatcctcacaggggctccctgtctggctcacctggaggaagaggtccacggtgagggagccctgggcagggcagagaagggaggacgggcaagacgctaggcaggcctgaagcagactctcctcctcctcttccatcctccagacaaggtggttgcccgggacctggttggagccatgttgagcccactgccgcagccacgcccctctgccccccaggtgctggcccaccccttcttttggagcagagccaagcaactccagttcttccaggtcagaaggaaagcttgggaatggcccccaaaagtcctaagtttgggtcctgggcaataagaaatgggatattagattagctgagggaaaacaggaagagctacctggtcctgggagcctggctctttccctaaactgggagccagcctggactcctaaactccgccatcttggcactctctggtccattcactgccagctttgccagccccagctgccctttgtatgggaatatagcccattcctttccacccgagtcatcattcatgctgtgccagtagcccactgcacttgagtgaacttgagcaagagacttcatgcctctgaactgcagtttgctcaatctgtagaatagggacagcagtaccaagctcataggttggtggtaaataacagaggcgtggcacagagaagcttcacgcccccagaggcaatgatccttgtcagtcaccctaaactactcctgtaagacaacacactcctggctatgtggcctctggccccggtcacaaggctcaggagctctctgggccccaggacgtcagtgactggctggagaaggagtccgagcaggagcccctggtgagggcactggaggcgggaggctgcgcagtggtccgggacaactggcacgagcacatctccatgccgctgcagacaggtagaggccatactcaggtgggcctgggcggtggaggggagtgggcctgggcggtggaggggagtctagcagggacggttttgccactgaattccctgtccacagatctgagaaagttccggtcctataaggggacatcagtgcgagacctgctccgtgctgtgaggaacaaggtatgtgttggggcctgggtgggcctgggtcttgggaaggcctggccgcagctgagccagggttctctgctctacctacccacagaagcaccactacagggagctcccagttgaggtgcgacaggcactcggccaagtccctgatggcttcgtccagtacttcacaaaccgcttcccacggctgctcctccacacgcaccgagccatgaggagctgcgcctctgagagcctcttcctgccctactacccgccagactcagaggccaggaggccatgccctggggccacagggaggtgaggtgggctggatgccacacagatggtctccgtgctggctcactgaagagctgagcctgtggctggcctcagaatcaggctgggtgcagtggctcacacctgtaatcccagcattttgggaggctgagtgagaggatcacttgagctcaggagttcgagaccagcctggccaacatggcaacaccccatttctacaaaaaatttgtaaaattagccaggcatggtggcgcacgcctgtagtcccagctgcttgggaggctgaggtgggagaatcacttgagcccaggagttcgaggctgcagtgagccaggatcatgccactgcactccagcctggtccacagagagacactgtcaccccctttcccccacaagactggcagaggctgggcagcctggggctgatgaagcagagatgttcgctggatcccaggccctggcacccctcaggaaatacaagaaaaagaatattcacatctgtttaatgtgcataaagccaaggaaaggacagttccgaattcaatagaaatattctgtacaattcatatggtggggttgagggggagggggacaaggctgtagaacccacacccgaacatgtacaaaaataacttatacagcaacccccacctgcaaggatgatgcagctctgcccagccaccggggctggggggcacactgcagacatggcaccgcgggagccaaccagtatgggccccagatgcaggtgggagtgaggagggcaccagtccggaggggagggcagctattaggaggccttgagacggttgctggccgagcgtgagctcagcagcttgtccaccatagtgcgggcgtagcggagccggctggccagctccttgcagcagccgtactcctccaggagactcaggcggtatgtgcggaagtcccgcttctcgtcgatgtaggtcacggctgccatcagtgggcacaagatgagcttggtgtgatcctgcaagagaagagcagcaggggttggcgatcccagaggccagtgtatgttagggagtagagggaagacacaacaggttataggtacctgagccgctcactccacattcaacccacatgggccactgccaggcatgcggagcctaccccagctctctcctgcgcctggtgacctccagctcacctggaagaagttgatctgcacgctgccgttgctgaggtgcaggatgatggcgctgcgggtgcggaaccaggtccgtaggtagggcagccgggcgagctcatcaccttcgcgcggcgtgatgttggcacctgccttcagcaagtgctcgctcatgtaattgcggaaatatttaaggagggtgatctggatgaaaagtaggtaaggggttccagaattagagtctgatcctccagcacaggtcccacttctgcaacaccaccccccatgggccggacggcactcaccttcttcatcaaggagttgggatgggaactcacggtgaggtaggactcagtgccgtcacgctctatgtactgcaggctgtcaccatcattgtagaggatgaggcgtgttgagtcattgaagagcacccccacgctgttatcacagagctgataccctagggatcggtggagagaggtctcagaaagggggaatagaaagtggggagtgggaccgggcgtggtggcacatgcctgtgattccagcactttgggaggctgagggaggaggattgtttgagcccaggagtttgagaccagcctgggcaacgtaatgagaccccatctctacaaaatattttaaaaattagctgagcataatggtgcacgcctgtagtcacagctacttaggggcctgggagtttgaggctgcagtgagccatgattgtgccactgcactccagcctgggctacagagcaggaccctgtctctggaaaaaaaaaaagctggggagtcagggagcactgggagctggaactgggaggcctgggatggagagaggagggcactgagaacagtacctgggagctcaaaaaggccagagtctgtaacaactgaaaaggtcacctggctgtgcctgagtcacccacctgttctggaagaaacctaccaaggccgtacttgtccgaatagtccacccacttgctgacccagaagatggggatgcaggcaggatcctcagcctcctctgagacagaaacagacagacagttagttggtcaggaccagcctcttcccctctgctccacacatgtggcccacaccagggaacagggaagcctgctgggcaccccacctgggctcagttgagaggcctagggccccagagaagagcaaagcagggcctctgctgccagcaggctcagacaagcagcagcacagatatctctgcagagaaagtctcagcacagcgcaccaagttccactcactccttcattccactgacccatttactgaaggcctaccgtgccaggcactgttgcaggttcagtgagcaacagacaaaaccccagcctccacggagcttacactgtggttgtaggggcaaagactaatcaatttaagtatgggcaaaatatcagtgacttctatcatggtaagagtcagaggcatctagttttccagtttggagtaattaagaaactgtgaagacagaagccagttgcaaacacatcaaaatgttacgttcagtgcatgcaacaaaccccttaatttaaatccaataaacaaagaaggacatgttggactatgttgggtgagaagtgttatggagaactatgcagtgggcaagaggatgagaagcaccagcagaggggccagggagatgctcacagagctgacactggagcagacacttgaaggaggccacagtgtgagccatgtggtgtctggaagaagtgctttcgtgccaggaccagggagaaagccctgaggctgcagtacatctgggtctgttatttcaagggtcttgaagatacaataggaacttactgagcaaaagaaacagcgtatgaaggtggcacatcgaggtgctagagtaaaaaagacggatcagaaaaggcggcaggagccacggaagcagggccttggatatcaggaaatggggaaaccaatggtcctatgcagacagggcctgaacaagtcaccagtgctttgttggccaagcctcctcctgccttttccagatgccccaagcaatcctgccccgcccagggccccgcagtacccaccttgcctgaccagcccacgctccgagggcttggaggcattgacactgtgcagctgctgcagcatgtcactgaggtggcagtcgaccacctcacctgtctctcgaaccactggttcttctttttcccggggacgctcaggcagggggttctccaagcctaggaaggtgacaaaaacaggggcgttgggaagggcacgggactcccctgccacagctgaaactcttccgaaagaaaaattctcttagctaccactgctttggggaaactgaatcagtgcctggttactagagcagcagctgccatgctcaggtgacaggcacatagtgctcactgtgaggcaacagatcttcagaagccgtggcctctgacccaacggtgtggccctgcaggatgacctgccactcaggcaaacagcttgaaggcaccagcagctcagagctgcccagctttgagcaaagaatggaaagcatcttcagcatccaggcagatggaagggctgagtagttcagttcatccacagaatggattcagtaggcatttaaataaaaacacaagaaatttttttccaccccaaaatttgctttatatgcttatttataaccaaaaaagcttgaaaagataacatgaaattttaacgctgattatatctgggcagtagaaacacagattattcttattgtctttttccttatttatttattcccccaccaccatgtgctaattctccttgtataatataaaatgtttaagttttcaattaaaaaacgatgtcatgatagggacttgggtatgaaataataagatattagggatttgctttaaacactccagcaaggccaggcccagtggctcacacttgtaatcccaacactatgagagaccgaggcaggtagattgtttgagctcaggagtttgagaccagcctgagcaacatggcaaaaccctgtctttactaaaaatacagaaactagctggacatggtggcacacctgtagtcctagctacttgggaggctgaggtgggagagtcacttgaacgcaggaggtggaggctgcagtgagccatgatcttgccacagcactccagcctgggcaacaaagcaagaatgtctcaaataaataataataaatagtaaataataattttttaaaacaccggtaacaaaaaaggcaggaggctggaataaataaaacagtctgtccaaatgttgataactagtaaaaatagatgaaacatgggactcatcatacagttctctccaccttcgggtaactgaaaatttccttaagtttttaaaatgctatataaaaaattaaaactgaaagaaaaaaagtaggagtctgaggcaggaggatcacttgagctcaggagtttgagaccagtgtgggcaagacctcatctctaccaaaaatttaaaaattggtcagacgcggtggcacatgcctaaagtctcaactacttgggaggctgaggctggaggatcacttgagcccaggagatcaaagctactgtgaggtacgactgtgccactgcactccagcccgggagacagagcaagaccctgtctcaaatttaaaaaaataaataaaagcagagaaataagtaatcctttaaaatatagcccaaagaataaaaatatccatgagtctatttcagacataaccaaataaataaatcaatcggagagaaggaacagctcttccttacagaagaattccaattattaaatgcaaaaaaagtgaggaaaagaaaaattaccattagaacatcattctaggcagggcacagtggctcacacctgtaaatcctaacactttgggaggccgaggaggatcacttgagggcaggagtttgagataagcctggtcgacatagtgagatcttgtctttacaaaaaaaaaatttttttttttttttgagacagagtctcgctctgttgcccaggctggagtgcagtggtgagacctcggctcactgcaacctccgccttccaggttcaagtgattcttgtgcctcagtgtcccgagtagctgagattacaggtgcacaccaccacgcccggctagtcttttgtatttttagtagagacagcgtttcgccatgttgcccaggctgatctcgaactcctgagctcgggcaatccacccacctcggcctcccaaagaaaaaaattttttaattagctgggtatggtggcacatgcctgtagtcctagctactctggagggtaaggcagggggactgtttgagcccaggatgttggggctgcagtaagctatgagtgagccactgcattccagcctgggtgacagcaagtcctgagacctgtctcaaaaaaaattccactgtaataattgctgcaaggtatgtaggaactctggggagttttttgttgttgttgcaacttttctgtataagcctaaaattattccaaaatgaagtttaagaaaaaccaatacctaaaaattgaaaactgaaaaatgaactgaagttgtacatcaaattggtgatatatccacagagaaaaaaagtatttcaagtgactttttaaaactatgtatccttagtgaaatcgagatcataccactcccctccagcctaggagacagagccagaccctgtctcaaaaaaaaaaaaaaaaaaaaaaaaaaaaaaaaaaaaaaaaaaggccgggcctggtggttcacgcctgtaatctcagccctttgggaggccgaggcaggcggatcacgaggtcaggagattgagaccatcctggctaacacagtgaaaccccgtctctactaaaagatacaaaaaaacagccgggcatggtggtgggcgcctgtagtcccagctactcaggaggctgaggcaggagaacggcgtgaacccgggaggcagagcttgcagtgagccgggatcacgccacaaaaaaaaggaaatttttatgtttttcaatgaatcatgaaaaagtgttagaaatttttttaaaggccagatgtagcagctcatgcctgtcatcccaacactttggtggaggtgaaaggatcgcttgagcccaggagttccaagaccagcctgggcaacatggcaaaacactgtctctacaaaaattagaaaagtcagccaggcatggtggtgcatgcctgacagtcccagctacttgggaggctgagatgggaggatcaattgagccctagagttgaaagctgcagtgagctgtgattgtgcctctgcactccaacctggaaaatagaggagagaccctgtctccaaaaaattaaattaattaaagtgatttgaaagaatttttcaggcttggcattcaatccattttcttcttcttgggcatggtacgtttatccagccatggtaaggtcagtctttcctggcagggccgagaagcagatgggcattggaaccacggattgaaggacagaggcctgtcctactccacacctgagctctcagggccagggactaagctgcacacacccctacaacctgggctttctctggggggtctgctctcttacccagacccttgttgtacctttattgaggactgtgaggggcttccggttgctggggtccaggctgctgggagcaatcgaaaaccttggtggaatggtcaggcaggtgatggggagacgggcagggatatagccagaagtaaagaactcgtcattaagcagctcgttaatggttgggcgggcagtgggatctgtctgaagcatcttctggatgagggaggcggccacggggttgatgtgctggggcagagagagggacagccataagcagaatgtgaaggggacctggagtacagtacggcctcaaaggagctgcaggtccccagcccacatgcagcccccagtctcaaatacaccacaggtcagtggttcacaacttggttcaatgccaagttctccactgtcagctttactgagcaccattgacagaagggtcaatggactgtggccgaacaccaactcactttcctagcactcactatgtgccaggaaagcattctaagcactcctgtgtttagctcacttagccctcaccaactcatctaaggggtggggatctattatcatccctttttcacagaggaggaaagtgaggcacagagagggtgaaggccttgtctagctggcttgattccatgctgtctctgacagtgaactgacactttgtgatggatttactatgtctgtccttatggtgacaggcctcctggcttcacacaaggacactacacttcaaactggctgtgtgctaggcttctgcaggaaccagctattcctttaaatgtatttctgttggtggttgtgaaaatgcacaccatggccgggcgcggtggctcacgcctgtaatctcagcacttagggagtccgaagcaggtggatcacaaggtcaggagatcgagaccatcctggctaacacggtcaaaccctgtctctaccacaaatacagaaaaaagaagccgggcatggtggctggtgcctgtagttccagctactcaggaggctgaggcgggagaatgccatgaacctgggaggcagagcttgcagtgagccgagattgtaccactgcattccagcctgggcgacagagcgagactccatctcaaaaaaaaaaaaaaaaaaaaaaagaaaatgcacacaactatgccattaggaagccctgggattcacagtgattcataattctgagagcactcaccacatgcaaggcactctgtgaggtgctccaaggcaggaactccactttatatatggaaactatggttcagaagatgcaggccaggctgggtatggtggctcacgcctgtaatcccagcactttgggaggccaaggcgggtggatcacctgaggtcaggagttcgagaccagcctggccaacatggtgaaaccccgtctctactaaaaatacaaaaaaaaaaaaaaaaagccaggcgaggtggtgggtgcctgtaatcccagctacttgggaggctgaggcaggagaatcgcttgaacctgggaggtggaggttgcagtgagtcaagatcatgccactgcactgggcaacaagagcaaaactccacctcaaataaaaaaaaaaaaaaaaaagatgcaggccatttgcccaatgtgatctcgctaagtggcagaatccatttgaattaagataaaccatttctaaagattaagcacttttgcctcctactccttcctacctcctttgttttttgctttttacacaacttttgggttacccaatctcttgagaatctgccaactctctccccctagaaaaaatgcttatgtgcacatacatgtcaagttctgtatgcaatttcagacacaggccctctcaagctctgtggctaccttagaggtgggatagacctatttctggtcctaggatattgctgggctccataaacagcttctggggaaaacaaaataaatgtaaacttaaagcatcattagtcaccttgggaatactgtattcattcttcttgatccggaggtaggtctcttttaggcaagaagtctcaaaaggtggtttgcccactaacaaggtatacctgtaagcacaaggtaggatttggcaccagtctcccagccacaacccagacatgagagaaatcatctcagggtcagaacaaaggtcaggcatcctctggacactcactctaactctggggcccctgaagacaatccctaagtccactgagcagccccagaagccatgacattggctagaataagccctcagcagaatacacatggtgagaccaggattcttaagggccagtgattttttagctatagcctgtggtcatctaggactctgtgcaagggcctcagatgctgcctgtcatgcaaaacaggtcaaagggctacctgcgcttacagaagcagctccacctttagcagttctgtacttaagtcttcaagttttcatttgaaaaaaccccactgcaaagacgtatgaaagccattgctacaactcatttctaactctccagtacctaggcccaaaacaagaaagataacacctgaaaaggcccaagcctctgcctgccaccaaccgctgctgatggtcttaatccagacagaccactggcacatcatctttccatctgtaactcctggcctaatttcccccaccatgctaatgctcatcggtgtttaagaccttattgtgcaagggaatcaccaagggaccttgttaaaaatccagattctgatccagtaagtagtctgggtcctgagattgtgtatacaagttcccagatgatggtgatgctgccctgtggacaactctagcaaaggactacagtaaggttgtggagactctccctcctcctcctccgctgtacccatgacctaggctgcagaaatccgacaggatacaccagtgacagggaaagatatgacaattaggctttgtttggggatgacttgtcccttggagtaggctttctgtaaagcaggccgaaaggtccacagaaaaggtcagccaggtaggatgtcccaaagttgcccctgctgagaccaggttggtccagagacaactcccaacttacatgatacacccaatggaccacacatccacctcgaaactgtgccctttcttgctcagcacctcgggagctatgtaattaggagtcccacacagggtcttcttcctctccccgtcatattcgactttggttgccagtccaaaatcccctgggacagagggaggaagagttggtacttagatgccagcctctgacatctgtcaatgcagaaggctagttaaggtttgaccatccagaaccagggccatctgatcccacaagcctctgctccttgtatgtagcaaggcttgcccaggaatcttcctcccatgctgacaccagggaggtgcctccagtgacacttctcacccctccttttagaaaggggctatgctttgaaacaggaactgacagggatagtaaaactccaatgccttcaaggatcaagcaagttaacctccaagacttggcaagtctgtgaagaatagggaggagtagagactgtggcaaagaagtctgaaggggacagctgttttccagcccagcaaagggctgccctaagaaaatgctgtcctcgtattactgaagctttcacctgtttaaaaggagttctgaatcaaactttttgttcaatcaaaccttccaatttaaaaaataaaaacaaattcaaattctttgtaaaaaaaaaatattgcattggggcacaaaaaaataatgcatctgtaggcaagatactgacttgtgggttgtctccttcctttctcccagcctcctccaaattccagcctcttgtagtgatgtcaagcacccctgcaggctcagcaactcacctattttcacctccagatcttcattcaggaaaaggttgcccagcttgaggtctcgatgaataactcggtttcggtgcaggtactggcagccaagcacaatttgccgtaggtagtatcgggcctcaggctcagtcagggctttcctcctcttgtgcagctccaggagagactgtgggtgggaaggagagggcaggagggatggggaggtggattgaggccggtggggaagggagagggttaccaggcaaaggaagcacaggactggactctggactcccaagggatgaaagaggggtcttggtgggtttctctccttccctatgcccccaccccattccttctccagcacagcggcatctggaccctgccttaacactgtccacaaccattcgcagcaccccttctcctactagcttccccccttacctgggggtcctctctcagccccactccggaagctccgagtccccagcaccagatccctttcctgactcgtatctcccccggaaggcccgaagtctggctccaactacccccccactgacccagctccaccccagaagctcccagggcgcggcatcactaacctgggactcctccctgggtactccagggccctagcgtccattaccagcacccctccccccagcacctcgcgtccagaagctgacttccctatcagcaacatgactcagactccacttcactggaaccccctcctctagcagctcccagagccaagaagcccttaccaaagacactttccatacgtaagcgggaggctcccagcacccttctctagcagctccaagtcccaggctctcccttgctgggtactctttccagcagctccaggtctgggcgctccaactgccccgcaggcagttccagttccccagcagcgacactcaccctccggcggcagagctccaacaccacgaacacgaagtcgttgtcctcgaaaaagccgtggaatcctacgacgtgctggtgggcgaggctgcggtgaatggatatttccatggacatcttctccctctggtgcggcttgagcagcagagacttaggcacaatcttgcccgcgaacacctccttggtgtccgcgtccgagatctcgaagcacttggcaaagccgcccttgcccaaaaagcggccccgcacatagcgccgccggctgcgtgggtccactaggacctccgggatctctttcgccggtggagccgccgccggagctccgggagctgcaactccggggaccccggctttcccagggtcggccggtgcccgtgccagcttccctgcagtcactgcagcactcatgctcccgaagctgcgctgcagacctcgatccgagcagagcctccgcaccgctccgctcctccccgaattcaaacgcggcgctgggaacgttacaaaagcctgcgcgccactgattggccgcggggatttaaaatccaaacccgcccgccgcgcggcaccatgggagcgccctgcgcagcagcagcctttaaacccggacccagccggggaaaacctgattgacacggacgcccgaacacgtgggatagcctgggaaaccaaacccggcgtggatgcggagacccagccccgagagaggaggaattccttcggggtttctccctttctcgggcgtccgggaaagctcctgcggttcacttgcgcctcctccaggaagcttttacttaaatcttcctctacctcggggccagggaacagtagcatcgccatcacctgagagcttgttagaaccgcaaaggcaaacgttcaggccctaccccagacctcccgagtcagtgtccgcctctcaacaagactgctcaggtgattcctacacatcctgaagttggagaagcacagtaccagagccccccatgatgcaacgaagctgtctggcctcctcgctactgaatttcccagggcctaaaatagtggacactcagtttcttggtcagagggagggaaggttggaagaatgcctagcaaactggcaggtcatagccaaatgtgtcttgcggggttttgtttggcctccccccacgccttttttttgtgtgtgtgacggaatcttgctctgtcgcccaggctggagtgcagtggcacgatctcagctcactgcaacctctgcttcccgggttcaagcaatcctcccgcctcggcctccctagcagctggaattacaagcatgcaccaccatgcccggctaatttttgtaattttagtagagaagaggtttcaccatgttggccaggctggtcttgaactcctgacctcaagtgatctgcccctcggcctcccaaatgctgggattacaggcgtgagccaccgcgccccgccattgtaaaacatttacagcatttaaaagaggagctcataaaagttgggatttgtggcctttcctgaaaaaaatcagctctagctacttactctgtgcctacatgctttcagtttgccacagtttacagctacacccgtttgttctgtaggtacttgagtggcaaccctggaacagtaaaatacccacgttaaaagctctttctctgtgcctccttagcaccctctgatccttcatagagcccagcaaaaatcaaccatactataagcatccttcacctgccttgcagctaagctgaaggacaatgaggacaatgatgccgtcctttctaccccatgtcccaagctcccagagcagtgcttggtaaaaaaaaaagggtacttactaaaatgttggctgaataaaaggaagactttgaaaaattaagttattttgtacccctatagtgtgaattctttttattgaaatttaatacacttacagaaaaaaatgtacatattataattgttcatagagctcagtgaattttcacaaactgaacaaatctgtaaaccacacccagattgagaaagggaacatgacaaacaccctgcaagtctcccttgtgccctgtgctggggggtgccaacaccaccacctcctagtctgatgatgtactaggagattcacagactcagcctgtagtcatactcatggctatgttttactacagcgaaaggctaggaagcaaaatcagcaaaggaaaaaagcgcatggacaaagtccagggaaaccaggtgtaagcctcccacagtcctctcccagcagagtcacataggacacaattcctccagcaatcagttgtgacaacccatgtgcaatgttgtatacaagggaagctcattacagactcagtgttcagggttctcattgggagctgctcacctcatcctctgcctaacacatatgaaaatctgactcccagaaggaaagcagatgttgggcataacccacattgtttgtacgaacagtttaggcacagtgagccactcttatcatttagggagtaatgagaaccctcctgaaatccaagctttcagatgccagccaagggccagccttgcaaacaggcctgctttctcatctcttttcacacagtccatctccttattgaggcttctttacagcaaaattattattagtaggaccacatgcaaaagggtgagaccaacctcaaatatggacctcagttcttcctggtaggggtcctggacttaaccagctaaaataaatcccattaaccataaagtctatcttaggaagccaggtggcttcctccttaattcctttttgttgttgttgttgagatggagtcttgctctgtcacccaggctggagtgcagtggcgtgatcttggctcactgcagcctccacctcctgggttcaagcgattctcctgcctcagcctcccgagtagctgggactacaggtgcacaccaccacacccagctaatttttttatttttgtagggactacaggtgcacaccaccacacccagctaatttttttatttttgtatttttacttttcaccatgtcggtcaggctggtctcaaactcctgacctcaggtgatctgcccacctcagcctcccaaagtgccgggattacaggcatgagccaccgtgcccagcccttaattgctgtctgaaccttttttttttttttcaacctgacctgaggcatcaattcaggcacagtataactctgaccagtaagcggaagctaacccaaatgctttccagggctgaggggacatcatgagagttgtggtcatgtacagaagcacagtcccaggggcacaggtggtacccctgtaaacaaagaatttgcaatattagggcacctcaagcaggacatccattaggctgtacaggtgaacagacctcctaccaggggaactcctgcccaagtgtttccagtcccatctgaaaagttcccagagtccttggcttccaagggactgcctgaaggcagtgagtcccaaacagttttgcttgttcaggatacaagttgatccatctcatgagcatggatgacatttgtgggagatcttcatggaaagcatagaagctagacccactctgttgtcagtctgaactcaaagcactcacagcacatggaaaggcagcactgggaattttccttcagcaagaggaggcttccagggatcaagcctccccaggtgccaggctttaattattttctccaatattacaaaaacagtcgtgccctgttcagcaatcataacattgcattttttcaaccatctcttactctcagctaggcctttcctctggaagggttgtatgtaagaggcacaaaagcatttttgtagataaacttttttttttttttttttgagatatggtctggctctgttgcccaggctagagtgcggtggcacgattttggctcactgcaacctccgcctcctgggctcaagccatcctcctacctcagcctcctaagtagctggaaccaaaggcacatgccatcatgtccagctaatttttgcattttttgtagacacaggatttcaccatgttgccaggctggtcttgaactcctgaactcaagcaatctgcccacctcggcctcccaaagtgctgggatcatatgcatccatcactgcgcctggccaacatttttttttttaactatcatcctagagttcaagtagataaacgtttttatgcaacttaaccagaaagacattcagaaattggtaattatgtgtggagggttgaattatgtccccacaaaaattcatgctgaagccctaaccatctacctgtacctcaaaatgtgagtatatttgaagataggccctgaagaggtaactaagttaaaatgggattgttaggatgggccctaatccaacctgagtggtatccttattaaaagagaagattaggacacagacacccagacagagggaccatacaaggacacagtaagaaggcagccatctgcaagccaagcagagaggcctcagaagaatctaaagctgtcgacaccttgtcctggactttcagcctccagaactgcaggaaaataagtttctattgtgtaagtcactcagtttgtggtactttgttatggtatccttagcaaactaataaaggatgaaaccctgaatttttaaaaatttcaaaatgtgtttacataatcttctaccccttttgtcctgattattcaatgagcagactagaaaagcctaatacctttctggggacagctacgttttaataatccacctaccttactaagctgtgtgtgctgggagaaaagtgagggaagtagagtcaggctgtcagtccactgttgcaagctgcaactaatcccaaaagctgaatgcaacaagtcaacagcagtgagagaagccccagagaaggtttgagtctggtctgtcaaaagcaggaggagaggtcatagtccttgcgatgtgcccttccccagcttggagcgtttggcaaatattagaagttaggaatgcaattagcctctgtattagagacaaagagcctatcagcagcttgatcttagatggtcccattagagaataagcccttttcagccaggttccaggacgttttcatagtttagcgctccacggagggggtccttaatctccaacggccccaacgtctgagtcctggtcattgagcctgtgcctgctttcagttcagcatagctcgtgttgaggctaaaacagctcaaggcagacagtagcaggtttcagcttagagtcagggccaggcaattaggatctgagaatttgagattctcaacaagcagctgcttttcttcagcagcagtgaaggcatgctgcatggccagacagctgtggtccaagtgacatgcaaggctgcctttttatcttgttggtcttagagtccaattgacccactcaaaaaaaatgcatattagactagacaatcatcagcctctaaggggagacatttgattttgacaagggttcattagcaatttaactgtattttcattttccaaacagattgcttctctttacatgttgtctccctctttcccgaggctccagtaagcacgaatcacagcaaaaataatcagttacagcctgttctggttccaatatccgaagaatttaaattccaacctatccactagtggcaaaaaactagaaagctgtatcccactaacacctttcatattttatttttgagtagctttatttgattagggtgatccctctagcatttatgaaattaacaagcataaaactttttttttaagagatgagtagctgggactacaggcgcacgccactgcgtccagctaaggtatgttttttaagcaatgaaatcaaccagtaaaaacaagttcaaatatttttcattcacacactcaaggcctgctgagcatccactgcatgtgttttacttgttccattagaaaggtttattaaaaaatggcggggcacagtggctcatgactgtaatcccagcacttagggaggccaagatcgcttgagcccaggagttcaagactagtctgggcaacatggtaaaaccctgtctctatttaaaaaataaacaaatacaagcaagtttttttttaaaaaatgatatattaaagaaaatcctcctaattctcttatgtcttttcatagctgtttccatgttctcatattcccatccttgtcaacatggaatttttgttgttgttgttgtggtttttttttttttttttgagacggagtctcgctctgtcgcccaggctggagtgcagtggcacaattacagctcactgcaagctccgccccctgggttcgcgccattctcctgcctcagcctcccaagtagctgggaatacaggcacccgccaccatgcctggctaatttttttgtatttttagtagagatggggtttcactgtgttagccaggatggtcttgatctcctgacctcgtgatctgcccacctcggcctcccgaagtgatgggattacaggcttgagccactgcgcctggccaaacatggaatttgttttatacagttgcaattatggtccattaatacaatctatttgtatgttatcagtaacagtaatactaacagtgaacccttattaagcatttactatgtgccaggcacaaggctaagagttttacagagatgatctcatttaccttgggttacttacccaaccaaggtttatagccagcaggtggcaaagcttgaattccaacccaactctgctgactcccaactacacccacctgcacacttgcctcttgggccttgtttgtctggcaagtcctaaatcccagactcatttgttcacttgcttgcttcctccctccctccctaccaaaacacagtatgatctgtcggttaaactcaatagactaaaaactccgggttcaaatgctagctcctccatcactagctgtatgaccttgggaaagtacttaatctctctgtgcctcaatttccatgtttataaaatgggataaagtgcccattatagtgcccatttcctaggattctatccaggagatgatgtgcctatttcctaaggttcttataatgagattctgcaaggacagcactccaaatagtacaggcacatggttttgacagttgtttctgttattattgaaataaaaagaacctatacctgttcccaggaagctcagagtctctcacaggccttttcagttcctggggctctcatatttcctcattctcccagactcctctgaccctactcttcctcaggttcttactgctcctgtgggaaatcagaaagagcagccagcagacaacaccaactgagatgaatgcagctgaaatggcacaggtcagtatggccaagaaacaccatgggctaatgttcagacccatggtatgaaagccagagtgggtgtgaatttcactcccatgtctcttatcttggatggttttcatctgcatgacccatttgcccaatgcccaatggatgtgaagatacagaaaagtccaggtactgttttcagggaagtaagatgtcctgtgccaactcttctcacttcagggtccaagtcagagtgcacaaggaaagcaggtggggctggcccaccagcaaaagcttcaggagagcaagggattggctgactgggctgcaagggtagtgttcaaagccagctgccttggaggccaagatagtggaggagctgcataaaacatggattttgcagccaagtaagagctggccttgattccagctcagccatttattagatgtgtggcattgggcaaatttacttaacctctctgaatatcagtttcctctgctgtaaaacaggctgtgaaactctcacttttttgacagttgggaggattaaatgtttgcaccccatagatacaaaacaaggaagggtgatttctccatctcttgtttgtggcggactgattataaagggcaagatgttttaaattttattttaaattttaaaaatatgtaagaatgctatgccttatactctaaggggttttgctcaaggtgtatcacttcctaataaaagtgcctaataaactgccgtttattgagtgctcaccctgagccagtacttatgctttacatgtataaatgcatttcaatcatcataataccctatccaacttccccattttatggatgagaaacctgaggttccacgaagtaagataacttgctcaaagtcacaaggctagccaatggcaggctgggatttgatcagcctgactctagcactcacactcctcaccactatgatggctctcaaaatgggcccctcagaccctctctgtattttgactctttggctttctcactcactaagctgtgagatccctatgagaaagaactggctccatcttagtctccactgtatccccaggacctaggaagtgcttggcacctagtagtggcttggaaagcacttgttaaatgaataaatgagtgatggtgtctctcttctctgtgcagcatatggtgaggggcccaccttcttacccctaaatggaagcaagcacatattctactaaaagcacaagcccattgctggggggctctagaagtgtttcagttatcatgtacttatgggaactgtagaagttggcgagacattttgctgagaccagttctgaaaaaaccaggccttcggacacgctgtcccaacactgccagtatcatttcaggggacttgcagctccatggaagctaacccccaggagaccagccagctggatttgactacctatagtcaccatccaggttgtcagatgccaattttttttcaggagaaccgctgaggctagccagaatatggctgggcagcaccctctaggctctcactggatagaacaggatacagagaaaggcctccctagccaccaagacctcttccttatagctgagaaacttccaaggatatgttaactatgaacaatgtttgtctgattaatttcaagtctgccagatgtatcagtgactaagaaaggaactgtggcctcagatcctgagtgaaatggttcatgcagaag

SEQ ID NO: 1790 - DNA, 49824 bp, Homo sapiens
  LOC342618 gene - 30899371 - 30909194 of chr17; NCBI Entrez Gene ID: 342618; Build 35; sequence includes 20,000 bases upstream of initiation codon and 20,000 bases downstream of termination codon of the gene
gagtttgtgggaaaagtgaaagccagtacacgcaggaaactatggctgagcacggggctcacttcacagctgcttctgtggccgatgaccagccatccatctttgaggtggtagcacaggacagtttaatgacagcagtgagacccgctcttcagcatgtggtcaaggtaaggtattaattcttggaaaggttttagggacaactgggtaaaaaacaaacgaataatttgtgcttatttggtagcctagcgtttgaaatagccaatttgcaaataacttgtatcccatgacttaagagttactgagtctctgttatgtgtagagacctgtactgaatacccagcatttcagggtccaacagtgacttatttaaaacaaattgtgtagactttagaggaaaagggggaatgtaaataggtgtagaacttgtgtaatggaatgaatttcacttattgctttattttgctttaggttcttgcagaatcaaatcccacccactatggcttcttgtggaggtggtttgatgaaatctttactctgctagatcttctgctccagcaacattatctgtctagaaccagtgcctcattttctgaaaacttttacggcttaaagagaattgtaatgggggacactcacaagtctcagagattggctagtgctggtctcccaaagcagcagctttggaaatctattatgttcctggttcttcttccctatctgaaagtgaagctggagaagctggtttctagcctgagagaagaggatgaatattctattcatcccccttcttcccgctggaaacgattttacagagctttcctggcagcctacccatttgtgaacatggcctgggaaggatggtttcttgtacaacaacttcgatacatcctaggaaaagctcagcatcactcaccactgctgaggctggctggagttcagctaggtcgactgacagttcaggatatacaagctctggagcacaaaccagctaaggccagcatgatgcagcaaccagccaggaggtaaggccttaacatttccaaaagatctttagttagtaaattcgaaaatcgtatcccagttttgtaaaattcacctccctgttaactttgtggcatttcatagagtcatagaaaagctattccttgtgtccataaaacaaggactgtcatcctggtaaccttcatcattctaggtatactttagtgcatacttgctatgtcccaggccctgtgctaggtgcttgctttacgtacattatctcaatcctcaacacaacccaatgaagtaaatgtattagctcacagttgaggaaactaaacccaagcagttaagtaccttgccaaagtcacgtaggtacatagaaggtggcagagctgggattcaaaccaaaccaatacaattctaaagactgtgctctgtgagccactgcacccagcctaagactgtgctcttaatcatgatgctgtgctccttctagttcatatttgtgttctcctacaagttcaaatatatacattcctcaatactgctaagttttttattaagtgaattgggtttttttttttttttctggatcactatcttccactaaaaaaagggaggtctatataatcaaattctctgatttatctttcaaaacacaaaaccaaaccctaatcatgttactaaaaacaaagcttagctcctatgctcctaaaatattgtaagttagaatcacttagaatagatccttaaggagatagtaccagtctaccaaccattcagtcccccagtgattctgatgaaaaatgtaagaattgcatttatattagtcactttgtaatgatacctaaataaagtttctctctttgcctccttgttcttttctcccaacagtgttagtgagaagataaactcagctctgaagaaagctgttgggggtgttgccttatccctgtctactggcctttctgtgggtgtattcttcttgcagttccttgactggtggtactcatctgaaaatcaagaaaccatcaagtcattgactgccctgcctactccaccaccacctgtacacctagactataactctgattctcccctcttacccaaaatgaagactgtgtgcccactgtgtcgtaaaacccgggtgaatgatactgttcttgccacctctggctatgtgttttgttaccgctgtgtgtttcattatgtgaggagtcaccaagcttgtcccatcacaggttatccaacagaagtacaacatctgattaaactctactcccctgagaactgaaagggaatcatgtcttatcctcacaacaaaagtattgcgctgtaatgtcacagagctggtttcagcatggtattgagttgacacttctcagcctcaattcataactatatgaactttaaatgattatatggatttctttaaaaggatatgcccatttgatcctaaccttttagcctgctctctagaaccctacttacagttgaccaagctgcttaaagtagaaggatcaggactggcaggggatatgagggccagtgtagagattaaacagaataatgagtacacaagtttttgcctatccctttccttaaaatataagaaataaaggagctcttacgaaaaacccaggttagaccgcataaaaaataaagtgaacagtgaggtggtagcaagacttctttttagaaaagaaagcatttacctgcctgtctgtaaggtggaaatttcatcagtttgcaaacgataagaaatgcagacttgctcttgatagaaatgcttagaaacactctgggggggaaaaaagctccttccatatactgtgagacatttgttaagtgacatctattgtttatcagcttttaaggataaaaaaggtattttaaaagttggatatttaggatatttgaggatattcctttatgagctctccatatccttcttgagaaactggttaaaaaaggaataggggttgagtgttacagagagtagtctgaagattcctgtgtaaaagcaaagctaacaagcaatgaagacatgaagcaaaatactaatctaattgtgtaaagaaaggatattttaataagttctttctgcttgctgctaagagtttgctaaagtgtcatgaattattctggttattactaaagtttctatgaaacacttaagtagattttaagaataaatgtttctggaaaagaactatgttatgattttgtagaaatgtaaagattacttgaggtgtttaaaataaatttttcattcagactacctttgactttttgaggtgtttttatatttaacattttgccaattcagtagttggaacaaaaatcctctgctccgacaacaagaattcagcctcatgcaaaataccttgcatcaacttaagaaacacttaagttgcctatgtaggagcatttatgccattggattggtagactggtgaaaacatgggttaaaaaaaaatcatcactagaagaggaaggatgaaaatgatttttaagagcctctgctgacataagtgttttccaatactttaactcattttaccagttcaaagcacattctctgatagcacaaaggtgataaagctaaaattttaaatagaatatcccatggattttaacattaagacatttatgatgttagttgagacaataaaaaaaattaaaacttttatatgccataagaaaagtataatgaattttaaaattctcattaaacctcaaaggttttaccaaagcaaatatcatggttaattaaacatttttatttatttattttttttttactgagacagagtctcactctgatgccaaggcttgagtgcagtggtgtgatctcggctcactgcaacctccacctcctgggttcaaacaattctgccacctcagcctcctaagtagctgtgattacaggtgcgtgccaccacgcctggctaatttttgtatttttagtagaggcggggttttgccatgttggccaggctggtgtcgaactcctgacctcaagtgatccgcctgccttggcctcccaaagtgctgggattacaggcgtgaaccactgtgcctggccaattaaacgtttttaatacagtaataagtgaataatagaattgagccagattcaggattgaaatgatgtagtcctccatgaagaattcaaagcaagagttttcatctcaacctaaggaggaaaacatgagaatatcagtaattcaaaagaaaataaaagaaacatcttaaacataataaaaccagtgtccaaacaggatacaacacacctgtgtggaaaaaccacaatcagaatcagctcagagagaagattaagagatcataccctggtcaaagccaacagtgaagcaatggcaataccaggtcaggctctacttcactcatcatcgcatcgctgcatttcatctccttgtattacctaagagcaacccagtgccctagtttcacatccaagaaaacataggcttacctatgaaaaaaaataaagccttctattcaggtaagtttcaaccatgggtttctaattaatatttctttctttctttttttttttaagacagggtcttactctgtcacccaggctggagtgcaatggcctgatcatggctcactgcagtctcaacctccccaggctcagacgatcatcccacctcagcctcccaagtagctgggactacagtcacaggccaccatatctggctaatttttgtactttttgtagagacagggttttaccatgttgtccaggctgttctcaaactcctggactcaagcaatccaccttctccagcctcccaaagtgcgcggattacaggcgtgagccaccatgcctggcctgttttcaattaatatatatatatatttttattttgagacaaggtttcactcttgtcaaccaggctggagtgcagtggtgtgatcatggctcactgtagcctcaaactcctgggctcaggtgatccaaccaggtagctaggactacaggtgcatgtccaccatccctggctaattctttttaaatttttgtagagacaagagtctcggtatgtttcccaggctggtctcaaactcctggcttcaagtgatcctcctgccttggcctcccaaaaccctgggatcacaggcttgagcccataagcctgcccttagcctagttcaaaagcaaaagctttagaaaatatattttctttttaaaaatttctttattttttctggagacagggtcttgccctgtcacctagcctggagtgcagtggcacgatcatggctcactgtggcctcaaactgctgggctcaagcaatcctcccaccccagccttctgagtagctgacatctcaggtgagcaccaccacgcccagagtcttgccatgttgcccagggtggtctcaaactgctgggctcaagtgatcttccctctttggccttccaaagtgctggattacaggtgtgagctactgtacctggcctagaaaatatttttttttttgaaatggagtctcactgtgtcgcccaggctggagtgcagtggcgcaatctcggctcactgcagcctcagcctcccaaatagctgggactacaggcatgtgccaccacgcccagctaatttttgtatttttagtagagatggggtttcaccatgttggccaggctggtcttgaactcctgacctcaagtgatctgccagccttggcctcccaaagtgctgggattacaggcgtgagccaccacaccgggcctagaaaagattttctactaaatttctttataaactccagttcatttaatatgcaatttgatttataattcttctgccaacaaagattaaaattatagtcataaaagtttttaaactagaatcttttatctgaagagtccaagaacccagagaggctatgatttgccgaagatccataggaaattaactgcagagctggaaagagaacttgaggtatgattaccagatttatattttttcagtagcaactaaataaaaggttcaatttcatttttctctagggtactacctttagatttactaatgaggaaggacatggaagataaagcagggcaaagcatgggtaattcacaatctgaaaaatcaatttgtgaatgagaaacctgacctccactccactccactccctcactctgtcacccaggctagagtgcggtggcacaatctcggctcactgcaacctctacctcccgggttcaagtgattctcctgcctcagcctcccgagtagctgagactacaggcgtgcaccaccacacccagctaatttttgcactttttagtagagatgggctttcaccatattggccaggctggtcttgaactcttgaccttgtgatccacccacctcaacctcccaaagtgctgggattatgggcgtgagccaccgcgcctggcctctttattttttgagacagattctcactctgtcacccaggctggaatgcagtggcactatctcagctcactttagcctctgcctcctgggttcaagcagtcctcccacctcagcctcccaggtagctgggattacaggcatgcacaaccaggcctagctaatttttgcattttcagtagaaatggggttttgccatgttggccaggctggtcttgaactcctgacttcaagtgatctgcccacctcggcctctgaaagtgctgggattacaggcatgagccaccgcacctggcctctccagactttcaaaatgatattgtcagtatctaaaattctggggccaccatatactgccttcagccatctataaacatcaatagactgatattccctagttaaaactgacagctattggtctgtgttcactattcagcaactaagctccataaagaggaaaactaggtcaggcgcagtggttcgcacctctaatcccagcactttgggaggccgaggcaggcaggtcccctgaggccaggagttccagaccagcctggccaacgtggcgaaaccccgtctctattaaaagtacaaaaattagccgggcatgatggcaggcgcctgtaatgccagctactcaagaggctgaggcaggacaacagcttgaacctgggaggcggaggttgcagtgagctgagattgcaccactgcactccagcctgggcgacaagagtgagatcctgtctcaaaaaaaaaaaaaaaaaagaaagaaagaaagaaaaagaaagaaagaaagaaggaaagaaggaaggaaggaaagaaggaaggaaggaaagaaggaaagaaggaaagaaggaaaaaaagaaagagaaagaaagaaagaaagaaagaaagaaagaaagaaagagaaagaaagaaagaaaaagaaaacagaggcctcagcctctgtttaagcattcaagcataaccattgtgtaacaggcacttcatcagttactttccctcttttgagacagagatcagagcttaataacttaaataaatctgccaaaaataatgaaacttgtgagcaaagccaagctctgaaccaatgagtgcttggctctaaaacccacgttccttctggcagacaatactgctatctcaatgggcctcctgcctccagtttctctcccatccaatgtactttgaatcttacacacatactaacccttatatatggaggtgtgattactcacaagcattcagttgctccccatagtctaggaaataaagtcctaacgactttgtttagcaatcaagatgtttcaaaacagaccaatatttatccttaaatacaccataaataacccaaacatgtcttttgtttgtttgtttgtttgagatagagtctcgctctgtcgcccaggctgcagtgcagtggtgcaatctcagctcactgcaaactcagcctcctgggttcaagcgattctcctgcctcagcttcccaagtaggtgggattacaggcatgagccaccatgcccaactaatttttgtatttttagtagagacagggtttcgccatgttggccagactggtcttaaactcctgacctcaagtgatccacctgccttggcctcccaggtgctgggattataggtgtgagccaccgtgccgggcccccaaacatatcttacagtctaatcaacccagattattccttagtcctcatattggctctatttgaccttatgccctccatctagaaagtctttccccctgtgtagaaatccttcctgtacttcaaaatcctatccctgcagtttgcaacccttcaaaatgccatcttttgcatgaagccttttttcatcaatccaacaggaagtatctgtcctccttctgaattatgaaagcaccttaatacctgttttgtggtacctatttcactttgtattttaagatccagacagccagactaccatgtaattcaagatctttacaagttgaactccctatctgcttcatcatcagctgggcaaacctcccatgtgctccagccacatgcggcaggtacattttcctagttcctggagtgctttctccacccctttcgatggggagaaaacctgagtatacttttttttttttttttaaagatttttaacattatttggattcttagtttgtgggaaaagagtaagatagacacatctagattgttatatagctcaggctttttaagggggatatttaaacatacagtatataactttaaaatgcccaggtgtggggagatttgccttatcactcaaaaaaagggtcaagagtaatcattccaagtttaggttgaagtgggtaagattacagccagagattaaaagctcacacatccataagcaaggtcccagtcaggcatctggaagggcaaagggatggctctgtgctggctgagtaaaaggcgctttcatggagggataaatacccaccctaagtatactttttaaactttactcaaggccgggagcggtggctttggcctgtaatcccagcactttgggaggccgaggcgggtggatcacgaggtcaggagttcaagaccagcctggccaacatggtgaaaccccatctctactaaaaacgcaaaaattagccgggcgtggtggtgtgcgcctgtaatcccagctacttgggaggctgaggctgagaactgcttgaacccgggaggcggcggttgcagtgagccgagatagcgccactggactccaacctgggaggcagagcgagactcccgtctcaaaaaaaaaaaaaaaacaaaacaaaaataaactttactcaaatatcactttctgttaaatgtccttaattccttcaatcatccccctcttctaactctcacagcactttcttccactacggcacgcatcacacgccaactactcaccagttcacgttttccgccctctctcccacttgcccaatcacagagttcctaaagaaccaggactatgttctactagtctttgtagccactgcactcggaatggtgcctagtacataggaatgagcgtttaattcattgaatgagcgactcttcctactaaaccctaagctcctagattataaaagcatcaacacaagttataaatccgacttacctccaacatttcacgtaggtaaagaccatacctcaagcacctccaagccctcatttccccagcctctacctcatggccctctgcacagccatctgcgcacaaccagtgcttacacacaggaggccctcaaaataatactaataatctaaggtccaaatcccacgaactcccgggaagactgagagtgaggctggagccaaggcttgaaccaaacacccaggaaggaatctgcagcccgcttttctaagtcgtaaaactcctacgacctggactctctcaggaagcctgctccggcctgaggaggatggaggtagccaagctctccagatttctgtcccgggccaaaggtgcttccagcttccctctcctttgcttctccgcccggctcaggtcttacagcctagcgcggctctcgccgaacaaccaatcccacggcggccatcgggtcacgtgggcgcccctgaggcggggctggtgggaggagcagccaatcgaaggccgaggccaacgtcaggggtggagcaaaagggatggcggacgcatcttttccgtcacttctttgcgtcgcggtctctatcctgagagaccagtcgctttccaagttctgagcaattctcccccgccccctccacaattcctcgccgtcggccgtcggggtgactgttaggcagagtggttttgcctgtaccctgtttcataactgggaatgagcatttgaggcaggattatagtgtgtgtgccctgggattgcgggaagaaatggttttgggttttttttttttttttttttgtgacagggtctcactcaagtcgcccaggctggagtgcagtggcgcgatctcggctcactgccacttccgcctcccaggctcaggctattctcctgcttcggccttctgagcagcttggattacaggcaggcgtcaccacgcccggctgattttatttatttatttatttatttatttatttatttatttattttcctgagatggagtttcgctctgtcgcccaggctgcagtgtagtggcgcgatctcggctcactgcaacctccgcctcccaggttcaagcggttctcgtgcctcagcctcccgagtagctgtattacagacacccatcatcatgccgggctaatttttgtacttttgtagagacggggtttcaacgtgttggccaggctggtcttgaactcctgacctcaggtgatcctaccgcctcggcctcccacagtgctgggattacaggcgtgagccaccgtgcccggcctcaactgtgtttagattggtggggggcagagagcgaaaggagggaaagctattgcaatggtccaggtgagagctaataggagcttaaattagattggcagtggaaatagaggagtggcatatgaaaggcgaatgaggattgtgatgaatgttagacaggaatgggtaaaaggacatgaagaagtaaaatggagagtcttctgtaccagacccactcaaggcctctttcgttcgttaaggattggagagattagacagtgaagacaatgtgcctttgcgcgtgctatttcctctacctggtttatctttctcccatccatctccctttctctcaacctgttgcttgcttgctttcttttttttttttgaaatgaaaggtctcacatatttattactgaactcagccaaccaaagcgttcataacagattcagagagaaaaaatatgtccccaataaaacatgtccaactctccagatagtggtgacattttcaggttgatatgataatgtgattgtgaccttcagacatcataaatacgtgtgccatctcatgtgcaattccttatagacccagcttggttcttctccaatgtctccttttggagttgtacctgattttattaccaatttttatctgaatccactggggaatgggacgattttgcttttgtttcttggccaggaattgcttaatcctaaacgtcttgtgagaagacatggcaagaagcagagtcaagcacataccacgatggcggagaaaggaagagagggggaaacctgttgctttcttacttacaggttccagctcacaaatcatctcatctaggaaatcttttctgatgctcactcatagttattgtcactcctcagaacacctagagaacactgctcatacattgcaaactctttagagtggtactagagcgtagtggtcatgtatgtggactattttggcaagtaacttgaattctttgttcttcagtatcactatttgtaaaaaggaggctaataatagcatctacctaatagaactgttacaagatcaatgacaacaatgcctaatacatagagtgctcagttgatgttattgtgtatgttgtattgttatgagttgtttagtacatgttttccctctttagattgtgaatgatctcagctcactgcaacccctgcctcctgggctcaagcaattctcctggctcagcctcccaaataggtgggattacaggcatgcactaccacacccggctgattcttttatttttagtagagatggggtttcgccatgttggccaggctggtctcgaactcttgacctcaagtgatccacccacccaccttggcctccgaaagtgctgggattacagtcgtgagccaccgagcccagcagggacgtgtgtcttattcttccagctaatagtaaggctttctggcaggatgagagtaactgggctttggattcagataggtcagtgttcagctctcagctctgccacttgctagatgtgtaactttgtgctttacctcaatgaactcagtttttttcatttatgtaatgtgaaaataacacttcttgcaagttattctgaggattatatttgagaaggaaagttgcatatttggctcaaggaaggcagttactaaataagagcttttattttgatgggtagccccagattgtagcaccatgtttaaaacattgtaagcgctcaacaattgattatcattattattatttgagacagagtctcgctctgtcacccaggctagaatgcagtggtgcgatctcggctcactgcaacctctgcctcctgggttcaagtgattctcatgcctcagcctcccaagtagctgggattacaggcgcatgccaccatgcccagctaatgtttgtatttttaatagagatgaggtttcgccatgttggttaggctggtcttgaactcctgacctcaagtgatccgcctgccttggcctcccaaagtggtgggattacaggcgtgagccactgcgcttagccgacaattgattattgaatgaaaatggcattacatgccgggcaccatatgcggcaaagagcacatgttaacacacatttactctttatgtgtatcatttcacttcattctggcaaatactctgtggaggaggctctgttattatctccagtttacacagaagaaattggaggcttaggttagtttaacaaagttttcatagctagaatgtggcagagctgagatctgaacaccttaggatccccaaaatagctgatcgaatgaaagaatgaatgaaagtgaggaaacttacacggagtcaggtagtggcataatggagcccttggtcactattctatttacactctttggatcatctctatgaaagaattgggggtgagatggaggcatctgggggtaaagagaccaacttttcccctttagttgctatttgacagtttatgtctggtgaacatgcaggcttgcgtctggtgaacataagtacaactgtggataaacagaaatgcttagtgaataaacacatctaaaataaattcggggttcttgttcttagcaatcatcaatagcatggccagatgaattttcctgagacaggaaaaagcataatctaagttactgatttcaagttgttttgtatcaggaacatttgcttgggagctatcaaagccaagatgtgaagtcctccctggcctgacaacctaactattcatatccaagggacttgactaaaacgctttgaagaaggaaaagaagttctcattgctcattttccacgttattccccgcttctcttgatttgattcccagtactaccctgtagaagaagaagaagaaaacagcaatctagtttctagttctcctgaccaaatgatgttattcctcttgattgggaagaaaatggggaggtacttagacttctgattttgagggctttcaagcaatccagaatcccaaacttgaaagagtgaaagagtacaagtctttgaattagacagacctagtttgggatcgtcactcttccactctctggccgtatagtctcagtttttgtgtgatgtgtagtgctcccagcatggtcccttgcatctggtaagcacatttttagtaaatggtggtcatttttagcctttgaaacataagtaatatcagagggatttcaatatgaaagtgaggccgagaattaaggtagacaggagaactaaaagtgagactggattcagaagtgacacgaatgaaaaatgagttaaagctgagagcaggcctttggagcttattatgttgctgtgtgaattatatatcatagtacccattctgcctcctttcctggaaactccttttaagccaaacatgtacaaagagtgatgccagcagagcagaacttcgttgggcagtggcgtcagctaacaacaacgacaaaaatagggatgtccagagacttatttaagaatgtcgtttcatcataaacgaattgaagtagagatacagagtactttgctggtttgatttagagggagagaggtgtattagtattctgtggctgctgcaacaaatcaccacaaatttggtggcttaaaacaacagaaacttttttttttttttttttgagatggagtctcactctgtcacccaggctggagtgcagtagtgcaatctcggctcggctcactgcaagctctgcctcccgggtttacgccattctcctgcctcagactcccgagtagctgggactacaggcgcccgccactacgcctggctaattttttgtatttttagtagagacagggtttcactgcgttagccagcatggtctcgatctcctgacctcgtgatccgcccccctcggcctcccaaactgctgggattacaggcgtgagtcactgcacccggcccagaaacatattcttttatgaaaacttattttaggttcagaagtacatgtgcaggtttattatatgggtaaactcatgtcacgggggtttgttgtatagatcatttcattacccaggtattaagcctgctacacaatagttatttcttctgctcctctccctcctcccacctcaggtgggtcccagtgtctgttgttcccctctttgtgtccatgtgttctcatcattgagcttccacttataagtgagaacatgcagtatttagttttctgttcctgtattagtttgctaaggataatggcctccagctccattcatttggttatttttgtttttgcgttttttttttaaattttttattttttttacagctagaagttcaacatcagtttcactgagttgaagtcaaagtgttggcatgggctgggcacggtggctcacgcctgtaatcccagcactttgggagactgaggcaggcagatcacatgaggtcaggggttcgagaccatcctggccaacatggcgaaaccccacctctattaaaaatatgtaaattagccaggcatggtggtgcgcacctgtaatcctagctatgctggaggctgaggtgggagaattgcttgaacctgggaggcagaggttgcagtaagccgagatcgcaccactgcactccagcctaagcaacagagcaagactctgtcaaaaaaaaaaaaaaaaaaagtgttgccatggacctgctgtctccagaagctccaggggagactcttccagcttctggtagctgctggcattcctttgcttatagctgcatcactccatctctgcttctgtgatcacattgcctcctccccttttgtgtgtatcaaagcttgacccagtttagccaccatcctcaaataagataactcactgcctcccatctgttggttgttttttctttttttgagatggagtctcgctttgtctcccaggctggaggctggagtgcagtggcgcaatctcggctcactgcaacctccacctcccagattcaagtgattctcctacctcagccacctgagtagctggtattacaggtgtctgccatcatgcctggctaatttttgtatttttagtagagacggggtttcaccatgttggccaggctagtcttgaactcctgaccccgtgatccaccggcctcggcctcccaaaatgctgggattacaggcatgagccactgcgcccggtatctgtttttttttttttttttgagatggagtctcactttgtcacccaggctggaatgcagtggcatgatctcggctcactgcaacctttgcctcccaggttcaagcaattctcctgtcccagcctccccaggagctgggatgacaggtgtccaccaccatgcccagctaatttttgtatttctagtagagacggggttttcaccatgttggccaggctggtcttgaactcctgacctcaggtgatctgcctgcctcagcctcccaaaatgctgggattacaggcatgagccactgcccccagcatctgttgggttttctttttctttctttctttctttctttctttttttttttttttttttttttttttttttgagatggagtctccctctgttgcccaggctagaatggaatggcatgatctcggcttactgcaacctctgcctcccaggttcaagcaattctcctgtctcagcctccccagtagttgggattacaggcacacaccaccacaccaggctaatttttgtatttttagtagagacagggtttcaccatattggtcaggctggtctcgaactcctgacctcagatgatccacccacctaggcctcccaaagtgctgggattataggcatgagccaccacacccagcccatctgttggtttttaccatttgttttttaattatgaaaaacaatttatactcattgtaaaccattaaaaatacagatcagttaaagataataaagggaagaaaaataaattaattaaaaaattacctttaatcctcctacccagggattgccagctcctaatctatgaggatttttctaggctgggtcttgtgtttaacaaagatgaaaagtaggaaaaagaataaaaataaatagaaaagaacaagccatttaggaggtaatgaaataggttaatattgcccacaatgaatatgtacaggaagcctaatttaaaataaaaacagagctttgcacacacaattttccagcgctgaaggtacatgtatgatatgtggaaatgaagctcagtctcttagaagtgctaagtttaactttttccattcacccctgcattttctcattacgacctcattcactccctgaggtcagaccctggcctgctaatctgccctgtcacaggctcttcatgagtccttatcggccttcctcagtatgtcagtgttatgaagaagtgggaagtctgctcctcccaggctaatatcaaagggcaaaaggggctgtgacagaagcaaacattcagactacagccagatgtgaaactgaagcagcaagaggaaacacaggagcataggtaaaaaaaaaaaaaaaaattcttaaaaatatctcatttatctaattttaggtgcagtctacatctgagggcatgagggattagtaaaatagtatttagggaaaatttgtaaaggaaaatgaataaaaaattctgggaaggcctggcgtggtggcccgtccctataatcccagcactttgggaggctcaggtaggtggatcacctgaggtcaacagttcgagaccagcctggccaacatggtgaaaccccatctctactaaaaatacaaaaatgtatcgagagtggtggctcttgcctgcagtcccagctactctggaggctgaggcaggagagtcacttgaacctgggggacggaggttgccatgagccaagagatcgtgccactgcactccagcctgggcacagagcaaaactctgtctcaaaaaaagaaaaaaaagtcctgggaaatgtggaaaggatattcatctcgagctagaatctcagtaaatgttgtatttatcataattgttatcagcattcaaataacattgatgagacttacgagtcacgagaccatagggtttgctattcaaaatcaattagatttgttttgtgggtcccatcagtggaagttatggggagacaaattgcagcttaaagtaaggagaccatttctaacacagacgtcagaaattagaagggactagagggactatttgataggtagtgagttgctcattgctggaggtttgcaacttgttgggagttggcaatattatagaggagattttagaatcctatagattgttggactggaggatctttaaagtcctttccaacacttctgtgattctatgatataaatagaatgttatgggaaatttccctaaggagccataaaatactacatttacatgtacctatagaagaggctcacattctaaaaagaattccccaggttgattctggttttcctgaaggaagtgagaaggcaaccaagaacaaattgatatcaggggagtgcacatgtcttgccggatgcctgctttcttcctcttggtgagtatatacaatgcccacagggcccctgctttgcaaagatcacacagaaagatgggttctcttctcctagaggaagaattttggttgagttagcaaatattttgttttgcaattgactaaaggtaagcagatcttttctgaaatatttgtttcagagctcaaatttcagtttaggtggctgttttctggtctaggaagcaaaagaagggtgacaatggtttagttaccatgccccaaaagctcatgttcttttccaagtcttaggggtttccacagcacagggcagaactattagaagggaaggaaaatgctgctgtcacatcacactgtatatgaggcaatgtacttttgagatttagaacatgtgaagagttgaaaaggtttctgcatttggtatcaactgacattctttcaggagtaaaataaagcttttcaaagtgtatgaaataatacataaaaatatagaattttatttatttacttttatttttatttttttagacaggttcccactctgctgcccaggctggagtgcagtggtgcgatcatggttcactgcagcctcaaactcctgggctcaagagatcctcccacctcagcctcctaggtagctgggactgcaggtgcgcaccaccatacctgcctaatgtttaacattttttttttttttatcttttgtcgagatggggtcttgctatgttgtccacgctggtctcaactcctgatcgaaagcaatcctctcacatccacctcccaaagtgctgagattacacatgtgagctaccacacccagcctatgtttgtgtttatagcaagatcttctacagtacatatactgtaaaattatacttccttagttctctagtgccttcctttcttccccttttgaattataaataagagcatcttctcacttcaacttctatttctgcatattctccaataccttcctgggctcctgtgccaacccatgccctttatatctgggctcagtgttggcgtttcctgatttgaaatgcaaaatggctgaaaatgttagcaatttaatttttccattatgacaaatattaggcattcacctttatccatgcctacttattctggcaaggctaaggatatttggcaaagtgattagaaaacagcagtatcaaagataatttccagttgggtgcggtggctcacatctgtaatcccagcactttgggagggaggcccaggcaggaggattgcaacgtagcaagactccatctcttaaaaaaaaaaaatagcaagaacaaaaaagaaaaaaaaaattagccaggcttggtggcacgtgtctgtagtctcatctactagggagactgaagttggagaatcacttgaactgggaggttgaggttgcagagaactattattgtgccactgcactccaacctgcataacagagcaagattctatctcaaaaacaaacaaacaaaactaaaaaacccaaaacaaacaacaacaacaaatatacatatagagagagatgacttccaacattaaaatatatctccagtaattgatagttttgaagaaaatattgtaatctttggaattcttattaatatagaaacaatatttctgtcctgattataggaactcctttcttttattgtttggagcacagaggggctgctgaaatggagagtctcaagactgatactgaaatgccgtatcctgaggtaatagtagatgtgggcagagtgatttttggagaagaaaacaggaagaagatgaccaacagctgtttgaaaagatctgagaattctagaattatccgggctatatgtgcactgttaaattctggaggtggtgtgatcaaagcagagattgatgataaaacctatagttaccaatgccatgggctgggacaggatttggaaacttcttttcaaaagctccttccttcaggttcacagaaataccttgactacatgcagcaggggcacaatctcctgatttttgtgaagtcatggagcccagatgttttcagccttccactaaggatttgcagcttgcgctccaatttgtatcggagagatgtgacttctgctatcaacttgagtgctagcagtgccctggagcttctcagagagaaggggtttagagcccaaagaggaagaccaagggtgaagaagttgcatcctcagcaggttctcaatagatgcattcaggaagaggaagatatgaggatattggcctcagaattttttaaaaaggacaaactcatgtataaggagaaactcaactttactgagtcaacacatgttgaatttaaaaggttcaccaccaaaaaagtcatacctcggattaaggaaatgctgcctcattatgtttctgcatttgccaacactcaagggggatatgtcctcattggggtggatgataagagcaaagaagtggttggatgtaagtgggaaaaagtgaatcctgacttactaaaaaaagaaatcgaaaactgcatagaaaaattgcctacattccacttctgctgtgagaagccaaaggtaaatttcactacaaaaatcctgaatgtgtaccaaaaagatgtcctggatggttatgtctgtgtgattcaagtggagcccttctgttgcgtggtgtttgcagaggccccagattcctggatcatgaaagacaattctgtcacacggctgacagctgagcagtgggtggtcatgatgctggatactcagtcaggtaaagggaagtgaagtcattgtccccatcagcagggaggaacccctttctctgccttttgtgggtatttgatcacatatgttagttaaaaaatagaaatttatttttcttataagtgttctcccattacagtgttccttatctaacatttttagttccaaagactcagaatataaactgaggtcaagaaatgtttggattctatggcctaaacaacttttttttctttagactctgtcacccaggctggagtgcagtggtgtgacctcggctcactgcaaactccacctcccaggtgcaagtgattctcgtgcttcagcctcccaagtagctgggattacaggcacacaccaccatgtcggctaatttttgtatttttaatagagatggggttttgccatgttgcccaggctggtcttgaacttctaacctcaagtgatcaactcacctccacctcccaaactgctgggattacaggtgtgagccaccactcctggccagcctaagcaacttttaaaggaaagttacagtatgccatcagcaatgagttaggaaaggtctccttttattgtctataaacctgttgaaaaaattgtgcaggctgatcatcccagtcaaaattggaatagcctcattttagagatgatattctagagaaacactgtttaagaataactctgaggctgggcgcagtcctagcactttgggaggccaaggtgggcagattgcctaagcccaggagtttgagaccagcctggccaaaatagcgaagccctatctctcccccaaatataaaaattagccaggcgtggtggtgtatgcctgtagtcccagctacatgggaggctgaggtgggaggattgcttgagcctgggaggtggaggttgtagtcagccaagatcactccactgcactccagcctaagcaacagagcgagaccccgtctcaaaaaaataaataaataaaaataaaaaaataaaaataaatgactccactactccactaattctttcaagcaaaacattgttgacaaatttgaattgtttcagtaacattaggagctaataaccttaagccactgggcttagggcaccaccaagtgggggaaaatgatgcaaaaggagatgctagggcaagggggtgctggggggagcaggacccctggtgttctcacttacctttcagttttgattggaatcagccttggtgattcctaatcaatccataaaggactataggccgaactacgcctatctgcttgccttcacggccagtatgttccagatttcatcaaaacttgagtgattggagaattttattgggtcattctttctcttaatttgtttgagttcacttctcttctcctctcccctaaagatcctgccacttttgattccatctaaccttagatggggacataaacaactgtaacaacatttttttttttttttgagacagggtcttgctttgtcgcctaggctggagtgcagcggcacgatctcagctcactgcagcctccgcctcccaggttcaagcaattctcccacctcagcctcccgagcagctgggattacaggcacaccaccacgcccagctaatttttgtatttttttgtatttttttttttttttgagacggagtctcgctctgtcacccaggctggagtgcagtggcgctatctcggctcactgcaagctccgtctcctgggttcaccccattctcctgcctcagcctcccgaataggtgggactacaggcgccggccaccatgcctggctaattttttttgtttttagtagagacggggtttcaccgtgttagccaggatggtcttgatctcctgacctcgtgatccgcctgcctcggcctcccaaagtgctgggattacaggtgtgagccatcacatctggccaacaccatttttaaaatactgtgctttaatccttgctgatccccactagatgccttttcttcttagagataacctggagtcagaatattataattgaaaggaagcttagggattattacttcactccagcgtgagagagaggtgaaatgacttgctcaagccgagtcacacagtgacttagaatatgtgtgatatgtcccctgtaggaatccccagacttcctttcctgacatacgtgagctgtctgacgcatagtaagtacgactgctcaggcacccatgcacatcacaggtctccagtaagaagagccaaaaaaagaggcttttttttttttttttttaactttttattttttgtctgaaacaactttccatgtaattgtctagctcctcccagtttggtcacagactacaactcttgcctgatttcatcagcttcatctgcacgaaaaagtcccggatatcccataaaagtccacaaatttaaggaggctctgcaacgacatttgtttccaggtattccctcttgatttcaacttaggggactatttgttttctaaaattgagttgggaggtgttagtagtaatgagttcaggtgtttctccttagggaaggtcaaatgaaggacttagcgacataatgatcctgaaatttgaaatatatatattatatatataatatatatatgactgaaaacaagggtcatatatatacttatttaaaataattattaatatttattattaatttattatataattattatatataattatatataatatttatatatctatatatctgacccttgtttccagtcatctgattcccactattactatttctgtgtgccttccaacttctcataacatatggcttttgttttccaaatttgagagtgcagggaatttctcaggtctcaaccatcaaaaaactgcccctagctttccaatgcagaaggagccattgggttatctgaacttcttctaaagcagggtttctcaaccttagcactattgtcatttgagtcagataactctttgctgggggagggagagccctgtgaattgtagaatacttagcagcattcctatctggtacctactacataccagtagctcccctccaattgtgacaataaaaaattctcaggccgggcatggtggctcatgcctgtaatcccagcactttgggaggccaaggcgggtgacctcaactgaggtcaggagtttgagaccagcctagccaacatggtgaaacgctgtctctactaaaaatacaaaaattagccaggtgtggtggcatgtgactgtaatctcagctactccagaggctgaggcagaagaatcactggaaccagggaggcagaggctgcagtgagccaagatcacaccactgcactccagtctgggtgacagcgagactccgtctcacaaaaaaagaaaaaattttccagacattgccaaatgtccgtggggatgggggagagttggggagtaaaactgctcctgattaagaatcacaattctaaaggaaagctcttattttcccaaatgcaccaggtatcatttttttctgcaacgttgcaggaatacttaccacatgcttttgtaagttttggtaacatctattccttgaattttcagtgacacaggaagaggtacaatttaaaccagaatccctctgtaagaagctgttctcagatcataaagaactggagggtttaatgaagaccctgatacatccttgttctcaggggattgtgatattttctagaagctgggctggtgatgttggcttcaggaaagaacagaatgtcctgtgtgatgctctcctgatagcagttaacagccccgtggtactctatacaatcttaatagaccccaattggcctggaggacttgaatatgcccgaaacacagctcatcagttaaagcagaaactgcaaactgttggtggttacacagggaaagtgtgcatcattccaaggctgatacacctgagcagcacacagagtagacctggtgagatccccctgcgttaccccaggtcctacaggcttgctgatgaggaggaaatggaagacttgctgcaggctctggtggtggtctccctgtcctccagatctcttctgagtgaccagatgggctgtgaatttttcaacttgctcataatggagcagagccagttgctttctgagagtcttcagaagacacgtgaattattcatctactgctttccaggagtcaggaagacagccctagccataaagatcatggagaaaattaaggacttgtttcactgcaaaccaaaagagatcctctatgtttgtgaaagcgactccctaaaggattttgtgacgtaagagttttaccaactacacacacacaaaaatatgtatgtgtatatatatatgtgtatatatatgtgtatatatatgtgtatatatatatgtatatatatgtgtatatatatacacatatatatatattctttttgcagttgcaagatttaatagagtgaaaacagagctcccatacaaagggaggggacccaaagagggtagccgttgccagcttgaatgcctgggtttatatcccgatcattgtccctcctgctgtgctctcaggcaatagatgattggctatttctttacctcttgtttttgcctaattagcattttagtgagctctctttcttatctgattggtcgggtgtgagctaagttgcaagccccatgtttaaaggtggaagtggtcaccttcccagctaggcttagggatttttagtcagcctaggaaatccagctagtcctgtctctcagtgcccccctcaacaggaaaacccaagtgctattggggaagttggccgaccaccgctctaactgcttcctgctgaattggggcgtagtaggggttctgcagttgagatttcctcgggaggggtgcctttgatgtcattaacattggagcatgggctagcaggccggtccaggggtccgtggtagattttactcatggattgcatctggggctccatttgaagaaccatttgtagctttgcagcttcgattctggaagagacaaacttaacaaggaggttaaagatacagggtccaattaacaaggaggttaaagatacagggtccaaagaggagtaacaatattatagctgctagaggtcctaagaaggggagaatccggggcatccattggctgaggaggccccaggggccagtgttttgaagctcctctgctctacgttgtattcgatctcgaatttctttaactttttggtgacgattccggattgattaacataataacagcattcttcccctaaaaataaacaggttccccctctttcggcggctagcaagtctaaagctcttctattttgaacgactactgctgctagggagttaagttgatcttgcaaggtgaccagggagtcagagacccgttccatgtcaccatttagttcttgagatagtttgtagtagaactgaatagaggttgtgataccgccagtgccagtacctactccacctagcactcctgctccgataacaaaaggaagaatgggtacccttttgttgcggggcttaggtacgacatgattgtataaatcttgttcagtgtagatggtcatagggggcgctaagaatgagaggaagcatatagattctgaagagccattcaaacaacgataggctgaggtaccacagacaaaaaatattcctgagggtaggcagactattcgtgtgggaagagttacccacctgatgtgctgggagttggttgcacacacacacaaaaatatatttagtcagtcttttcaagagtgtcacaaaagtgatttgtgtttttagtttaagtttttgcagtgccttagttgcataagtgcaagagcccaaactatatacacatttccaaataatcatggaattgagctgtaaacaggtaatttataatgttcaaccttaaacatctcattataaataacccacatgtgcataacttacatttacagaaccagaaacttttttttttctcacaatccatggccttacatttaagagaagtagaaatgaacccattctgctttaagtatactttctgtttgatatgtaatgttttaaagtcatagggtatttctgctaattagacattgtacctagtgaaacttgaatttaaatacagtttgattttgttcataaaatattttcatttttgacttgttctgcatcagtaattttagaaaatatgcaaattcacttctgatttaaatctctaacttttaatttagtaaaatgaattggtcattatagaattcagcaaaagagggcaaaatcattatgatttttggcttggttttgttattcaataaatctttttgagcactgttgatgtggtatctactgtgctacatttagtgttagaggagaaaacatattgaagaccttgccataaaaaaaacaatgtgagtattgtataataataaagacatgctcattttaattaactaattaattaatttatttttgagacggagtcttgctgtgtcaaccaggctggagtgcagtggcacgatctcagctcactgcaaactctgtctcctgggttcaagtgattctcttgcctcagcctcccgagtagctgggattacaagtgtgcatcaccacgcctagctaatttttgtatttttagtagagacggggtttcaccatgttggccaggctggtcttgaactcctgacctcaggtgatccgcccacctccttctcgcaaagtgctgggattacaggcgtgagccactgcacctggcctcatgcccattttaacaggctagaggttggttggtaaatattccccagtgaaggagaccattgggcacactgttaagaagtcagcaggagaagtgaatcaaataggggagggctttccaggcaaagggcacagcaagttcaaagacatggagacaccagagaaccagaatggtaggtctgactagagctgtgcagactgtgggtatacagcaggtggtgatgttgaaaaggaggtagacgccagattatcagggatcctgtagactgtgctgaggactacgttctttattaagtttcatagctaagtttgaaaatactccagtcaaaaggctaactcaacaaatatctatgaaacccttaatgtgagagggatacaaagatggctaagaatcagtacttttatttgagtccacacagtccaaaccagaagagaagaacatagttatgattcaaggcatagggagtaaaggccctaggaactgcatatgtaaaatcatggaatctgtagggatgagtgatgttacttggatccaaattaaaggaggcaaaaaacaaccaaattcgttcagaaaaaatacatatatgctaaagcgtactataaaggaaaattgagctaagtaaatgaggtagctccaaagaggcatagccccatagatttggtaccctacttgatgtgtcgtggaactcagcatcctcttgatgtttctcttaccaaaatctaaagaagctttagaggaatttgaactagtccgtgctttttttgcacataaaaattatgatatgcatcgaggaaactgttttccagctctaaagaggatagaaagtaaagaaatggtagtaagaagtgtaagttaactttgagatttcctttagatgtaatgaacttgtcttcaggattgccaaacagtaggaatggattactaatagacataatacaatctgttacctgggttcatttcagaagtttcacatgcaggtttaactggataaccccaaagagcaaggtgtaaaattatgcattctgtctgtcaggtaacttgtaattagaacagttttgtggtattcacactactgaatcaatgactcagcctgcagatgagaatcagcctctgattccattccagagagtaatgactgctggtgttctctttgttgatatgcctcaagccctgttttttccgtccttacagccaacaaaccacctgccaagctgtgaccaggaaaactttcatgcaaggggagtttctaaagattaaacacatagtgatggatgagactgagaatttctgcagcaaatatggcaattggtacatgaaggctaagaacatcacccatccaaaggcgaaggggactggaagtgaaaaccttcaccatgggattctctggctttttcttgacccttttcaaatccatcacgcagatgtcaatggccttccccctccatctgctcagtttcctcgaaaaacaatcaccagtgggatccactgtgctctggaaatagcgaaggttatgaaagaagaaatgaagaggatcaaagaaaatcctccctccaacatgtctccagacacattagcattgttcagcgagactgcctatgaggaagcaacgtgtgcccaggctctgcctggggtgtgtgagacaaagactaatctgacaacagaacaaatagctaactatgtggcaagaaaatgtcacagcctgttccagtgtggctatctgcccaaagatatagcaattctgtgcaggagaggggaggacagaggacgctataggcttgcactactcaaagcaatggaattaattgagacccacagaccatcagaggttgtgtttagcccggccaccggtgtttggggaagtcacattgttttagacagtattcagcaattttcaggcctggagaggactgtcgtgtttgggcttagtccagaatgtgaccagtcagaggaatttcataagctctgctttgcttcaagagccattaaacacctctacctgctttatgaaaagagggcagcctactgaaaattattacaaataatagaggaagacaggaagagcagagtcctttctcctagacaggtagcagtgactccattttaatattacaagtgaggaaatcaaggcacatcagtatggcctggagccacagaaatgtctcttggagctgagccttccactctatttcaatgccactggccttttcacaatttccttcacctcctacctatacaattacaatagacttcattagtcccctgtctccagctttcccactcaatccagctgtcatccatcagagaatttttcctcaaatagagaactgattttatgtaataccttgctaacatatcttcaatgagtccccacagccttcaaacctaaccaattttcaaggctttcattaatatgccctgacttgctctcccaaccacatcctttattgtatctccatctccccatgtttctcatgcaccccagcccacctggcataatttttgggtggtggtatggtgccctccaggctggttactttgactgcataggtctcaaaagtagccaattgactggcacctcatactggctatgggtctcaagctttccaggtccagaacttgattgcctttttgtaccaagtctagatcagtctcttggggatgctttatgctaatcaagctcacaaaggaccaatgcatacatcaaaatgttactctgttaatttatagtgaggaccatagtcataagtgggtcaaatgcttttgctaatcagtgccctcaacagtaatataggaagccaaattatatgaacatagccttacagtaagggaagctggtaatttgattcaaatcttaaaaatcttcagattatattagactattgcaatatctattaggttggtgcaaaagtgcaaaagccacaattacttttgcaccaacttaatataaaataagattgcaataatttctaaaataaagatatttctatcacaaggactagacaaattagtttacagtttacaagctaaagcaaatttagaatgctaaggatgactagtttttcattattctttgccctcagatgaatttttttttctctgtcttggtttctaaaatttccaggttcaccaccaaccctctccttactgcccccaacatatacaaattttgcctacatttatcctctatgtatgtgaatacattcatgtaggctagaaatgccttatactctgccgctggcctggaaagtagtcttcctacaaggggcctttgcacatctctgatttcttccattatgacttggtgctaatttttaaatccaactctcagagtttatggggatccttggtggcaactttaccaccaacaccacccacacacatccccgactcctggtctgtgcctgtgccattttctcagtctttaaacccttttctgtcccctccacctttgaaatccttacttggcaatcacatcctttttcaaatgcctactacctcaattaaacttttattatctccctaagtgaaactttccaatgtatatgatacatattagaaatgaaatcaaagttccccttttctagtcagttccccaaatggctgagccaattctgtactcttcaaattactcttgcttttgcaaggatttttaaattgctttggaagtattcatatttccaaactgtttttaacttctagaaaagtttaggataacttgattgactctggggaggcttgaatccaggagacatgtggaaattttggttatgattttagataaagcccctcagccttccaagaggtggaagagcaggcagggtttcgagaagctctcttagctgcctttctgaattgcttaggcccattagaagggctagtctgtacctaggcacgggttgaaaagaaaaacctctcccttgcttcctactgctctaattacctggtgtttcttcctttttacctttccttgggggctttagggtagttttggataggaggaaatgaagttcagcaatcggttttgcaaaagatgccagtgcattgacattctgatgtagggagatgtatgaattctataaaaataatttaaacagtcaaagtcaacagagtatgaaggagtatgagtgggacaaggaattgctatattttagtcataagccttagtaccatttgactttttaaaatatatgcatgcatcatataatttttaataaaagaattgatttgtaaagaattgttttaaatattgaatttgagagtctttgtcagttcttagtctagtgaaacaattcaatcaggatgaaagtagaataactaactcagtgattctcaaccctggatgctcattataatttcctgggcgacttaaaaaaaatcagtgatcaggccagacaccagactaattaacctcagtgtgtctgaacacaggctcgggcatcggtatttattaaatgttgtccaggcagggtgcagtggctggtgcctgtaataccagaactttgagaggctgaggtctgggggaatcacttgaagccaggagttggagaccagcctgggcaacataacaagaccccatctctacaaaaaaaatttttttaaaaacttagttgggcatggtggtgcatgcttttaatcctagctactccagaggccaaggtgggaggatcacttgagcccaggagtttgaggctacagtgacctatgattactccactgcactccagcctgggttacagagcaagactctatctcttaaaaaaaatccaaatgattctaatatgtcacaagggttgagaaccattgaacccttctcctagtctgttctttctgtcctcaaaaaatgtgtgcacatttctcttcctattaagactgtgagctccttgagagtaagaggatgagtcacttacacatccttatttcccctagagcaactagtacagtgcctcacacagggcaggtgctcagtaaatatttgctgaattgtacttgtagcttttagaaaactagaatctacaatgattcaattcgatagtatgaatttctaatgttagagatttcaaagaagtcagtgtggagaataatctttaacactgtaataatgaagaataagggaacaataaaggcaactcaattgtttttaggcaacaggtcaaattaaggatctatgatgatagttcattagattcaaatgtaagattaggaactggtggggactaagaataatggactaacttggttgttttagaattctcaatgttttctacaaagtcttaatatgatggataaagcaattaactaaatgaaataactaagataaaagagaagctttagaaactgtgagaagcttctaaaacttacttttaaaaagaagggtaatataatattatcatggaagcttcggaaatggagaaaggcaaaattaaaagttcttaaatcaggctgggcgcaggggctcatgctggtaatcctagcactttgggaggctgaggtgggtgaatcacctgaggtcaggagttcaagaccagcctgaccaacatggagaaaccctgtctccactaaaaatacaaaattagctgggcatggtggcgcatgcctgtaatcccagctacttgggaggctgaggcaggagaattgcttgaacctgggaggtggaggttgcagtgagctgagattgcgccactgcacttcagcctgggcaacaagagtgaaactctgtctcaaaaaaaaaaaaaaaaagttcttaaatcatcttgttatctgggtgtaacattttttcatttttgcttatttatttctattctttgttgatatggaaaaatattttcacacagttatgatcaagttgtgccatcaactttataacgtatatgtgtgctttttccatttaattgttttgtgagatattgctatagactacattattgttcccaatatttcctacctctctatatctataccctttgtagttactaacattagaggtagagatattttccacccctgtaatgtggccttggtcatgtgacttggaatgttagtagttctgatgtgcacagaggctgtacatggactttcagcattgggtttactctctcgggtttctgctgtttccatacaaagaatgtaccctgggtggcccaccagccactgagatatgtgaatccaacttgaactcaactcatggcctggagccaagttccaccagtcctaactagcttagccaaaatccagctgatctgaaagtgcatgaatgagaaataaaagcttattatttaatgactgagatttcaaggttgtttgttttgtagctttagctgactaatgcaggcatttcctcatgtggtagcacagtcttcaatataatcatttttaatgggtgcactgcatcctagccagatcatatgaaatttcagcgatcattcccctgtcattcgtgtcactagcaattttacaccaatttaattaagccaggcacatactcaggcatacaaccttttctttttctggtatatttataaatgcctggagatgggcttactggatgaaaaggtgacttggatgaaagaatcactttattcagattagttctgatgggaagtgaatagaaaaccccagtcactgcatctgataacgtataaattttgttgcattaactaagagaacaaaatgctgatatcaggttctgatgacaaaaaagaggcaatgatatcttggaaacaggtgactctaaaagggctgcaagggagcacagagagtgaaactaaggctcaccaccctaacctggagctgcagagaagatcttaacttggagaactatgggtagaaacatgaattatataacctcgacactgtattaaaaaaaatctgtggtcacttaaaactgacataaggtacaaagagaaaagaaaagatgcctctgaccatgaacaggaccttttaattttttaatgtatttcctcttgttattgtttactacttcagagttctcttgggccaattgcagataaagtcccttatccctgctttaatcagggaaggctgtctttgcccagttgtacagcttgaaagaggcatgtggtagagggggaaacaatgaaggaagcaggtgcttccttcctagccagccaaatatgacagaccccaccagtcaacagctaatacatcaaaatacctttacagtcccattgatgtctcctctgatatatacagttacaacaaacatatattaagtgcttagtatgtagtagacatggtgcaaattgtttttaaaatatatcttttaacccccaaccagtctttgaattatgtatagcagtaaggtacgataaggcagtgttaagagcttgagtccaggggtcggattgactctggccttgaattccaactctattccttaattggctggatgaccttgagcaagttactttacctcttcaagattcagttttctcatctataaaatagaggtaaaattcatacctacgtcttcaggtaaagatgaagattgaaagttaatactacatttaggccgaccactgtggctcacagctgtaaacccagcattttgagaagttgaggtagttggatcacttgagcccaagagtttgagaccagcctgggtaacatggtgaaaccccatctccacaaaacaaaccccaaaaattagtcaggcatggtggtgcgtgccactagtcccagctactttgggggctgaggtgggaggatcaattgaacccagggggtcgaggctacagaaagccatgatggggccactacactgcagcttggggaacagggcatgatactgtctaaaaaactaaaaataataaataaatatgacattgcccaggcacggtggttcacgcctgaaattccagcactttgggaggccaaggcgggcagatcacttgaggttgggagttcaagaccagcctggccaacatggtgaaactctgtgtctactaaaaatacaaaacaattagctgggtgtggtggcacacacctgtaatcccagctacttgggaggctgaggcagaggaatcacttgagcccgggaggcagaggttgcagtgagccaagatcgcgccactgcactccagcctggatgatagagtgagaatctgtctcaaaaaataaataaacaaacaaataaataaataagacatttaaataaagcataatatgtggaaagctctcaataaattttagatcttactagttccaatttacagctgaggaggctatgacttaaaagataaatacttagggccagtttcgatggctcatgcctgcgatcccagcaccttaggaggccaaagctgaaggactgcttgaagccaggagtttgagatcagcctgggcaatatagagagactctgtctctataatttttttttctaaattagcagagcgtggtggcacacacttgtagtccagctacttgggagactaaggtggaaagattgcctaggcccaggagttcaaggttacagtgagccatgatcataccactacactccagcctggataacaccacaagactctatctctaaaaataaataaataagtaaataaataagcaaatgaataataataccttacccaagatcacagaactagtaagttctgaatctgagatctgaactcatgtctgtctgactccaaagtccatgttagcttctatgttcttctgtttgtacatcaaagttaaagacgtaagtctccttctgtgttgacagtaattcatttgattttatgctgaggcttggatcaaatacacttagaatactgatggtatttttagcctctaaaatttttctacaaaatcaatatgattacttaaatgacttacataataagaaacgttcagaggagagcattttgtataccaagaaacataaaagatatacctgtcattacaagttctatataattacattatagaaagattagaaaatagagaaccacaaaagaaaattcaatccctattattaccgctgaatcatgcagttgctttcacttttgcttgttcgtttcctgggctagtccactggcagatatattttagcagagttgtaatcatagcgtacattccattgtatatcctgtttgggtttattgttctggtgacccctttcttctctgcagtctcccatatagtatgtgagacatttcccacattgcaggttagggagaggtggttctccgtgcctttgagcaaggagccaagattatcagtgcagtagtgccccttactttccaattggtttcatgaacagcaggaactcatgcctacagggaagaagaggatgatgggcaagtaaaggaggaaaaagctcttcacctaattccataaaatatggggtagggtggggtggggtgggggcagacattttagggaactgtacaacagagcaacacaattaggacagaagcagccttctttcgtcacttccccacgggtcactgtgggaagatggcatgtgagcgtgccctgcttgtgcagttgccagtcacagaacccaggaggtctggaaagcaaacctctgtttggccaaaggtactgaagggtggcagaatgtgttgcccccaaatatgccattttggcataaggattatttggagctaaaggcacttgaaaatagcagatgcatatgaggacccaaaggcataaaaataatagactctgaggacttgggggaagggtgggaggaggatgagggataaaaggctacacgctgggtgcagtgtacactgctcgggtgatgggtgcaccaaaatctcagaaattactgctgaagaatttatccatgtaaccaaacaccacctgttccccccaaaactgttgaaataataataaaaagaaaaagaaaatagcagatgcaaaaagtgaatcttaatctttttttcttccttaaaacaggagataaaagtcccacgtgaaagatgccctccctgtaccaggagaataaaaaacattctttgacgggggtcatacccaggataattctgtacaaacagaccttgctaaaataacccttatcttactttgccttcacacatactttaatgtaattacttttctgcagttgtactctttgctcaccctactatacaagcatttaggtttcggcacttctttaggtcttgaattttctataggggctcctatatgtaaaaatctgtatgtttttctcttgttaatctgtcataggtcaagttaattctcaggcctagccaaaatccctaagagaacagaggtaaaattttgcctcccttgtggtttctggcaatgaaaatgggaccctagaaggttgggatgcgccactcacttcagagcctgtgggtaggatcccggaagagctgacagaacctgcagaaggtaagaattcttaccaaagtcagtcccccgacatatctatctgcagtgccctgtagagaggagaacgtaaattttccttgtctcttcctttccaaattcagattggcaggagaaaaacatttgtaagaatgagttctttgaattgtaacttttataaatttggtctgggtatgatccacagcctccaaggaataataaaaagtccttgtctctgtcgtttgtgttgtttgtcataaggaagaaaatcatgagattcgattcttccttcgttttatgtcccgagagcttggctttaaaatagtctctctggtcctcgccgccagagggcgcaagtgttgctggtttgcatcaggccaccagcctggaacccaaaatctaagataagcagcattttcgtccgcctgtgccagctctcagagaagtttgtcttaataaaaggtcccagtccataagaggcgtttgtcacctgaaccttcatttttcttttctttctttctttctttctttctttctttctttctttctttctttctttctttctttctttctttttttttgagtacagggtttcattctgtcgcccacgttggagtgcagtggcgtgatcttggtcactgtaacctccgcctcccgggctcaagtgattctcccgcctcagtctcgcgagtacctgaaatttctgacatgcaccaccaggcctggctaatttttgtattttttgtagagacagggtttcaccatattagccaggctggtcttgaactcctaacctcaagtaatctgcccgccgcagcctcccaaaatactgagattataggtgtgagccaccgcgcccggcaaaagggctgcatggtttgcatcctccttggggatgtctcttacatccatggttaagtgataaaaggcttataggttttaagccataaaaacttactggttttgagtcacaattaagacaggtatacctttgaagatttgaacttttatatctaaaaggatttttttttaaaagaaagctgtcatcctaaacaaatgtctatggaaagatgagatcgaaagaaaatattaataggcaaagatgagaatcaatttttatcaaaattattaaattttgtgtttatgtatacctaatcatggctaagattttaaatgaaaattataagatctatttgtgtctgtctttatgtttatgcctatatgtgtgtgttgtgtatatgtgatatgtctctacctcctgatattgcaccactacttgacagtataattcagaatgtctggggaaggaccttagcatctgaatttttaaaaagcatgccaaaagatttgaacaagcagccaagattgggaactaattatctgattaacgaatgacatctctaattcaattccctctagtgcacagcaccttttcttatagctaaaaatgattgctaaatccacactgtaataattttttcaatgtataaggatagaaacccaaaaaaaatggaacaagaaaccaacaagagctcaagggaattgtgactcctacagctgttgagggagacagcaggtcaaaaagtagcagaaacttgatcagaacaatagcaacagtattagcagctaaattaatagcagtgaatccatctcggctctaattacaacaactattaggattatggaggctactataaaaattgaatgagaaagtcagtgagatgcactgtttaatttcctttctggctctttcactgtttctttttgttttgttttttcccttttccttgccaataaaaaatatttgttgagtaactcaggcctactgtacaaagtaacaattctctcctccctttccatcttcttcctctccagttctacttctgagaaagtaatccttaataacagtttggtgtgtatccaaaaaagcttttttgtagcattattctccaaagtgtttgaagcatttcttctgataaagtttctttagtctttagccagaactagtctttggcccacttagtctattgataaacaggaaatagcacatattccccccttgaggctagaatggcaggcctaaaatgagtaggagaattctgagaaatggaaactttaaaaaggcggcaaccttctagtttcattctcagaaataccaaagcagcatttttcctggacttgttctgcagagcgctcagatttgaaagccatttctagcctttgaggattaccactgtcctcagccaaactgcagggactcctaagtagatcagagctcctggaactttctcatcttttcagcatctcaaccctgtggaatcttttaactcccaaggtaagtacagattgtccagagagatctaagccatgcttattcaatggaatggagagtctctcaaagagacctcataactctaagatgaaaatctcctctgtggctacagacttttccagatatacccactttaggcaagagaggatgaagtagacactttaggtctacacttttaataaataagtgaaatagacaatgagaggagctggtccttagactgtactcaccttgtagctgaggccagggatgtaggactcaagcccagaggaacctggctgggctgagagaaagagatgtagagggttctcatagttctggggaacaaaccttcagataagacaagtgaggagacttgggaggaagggatgcctgtgaagattctcttttttttttgagacaggttctcactctttcgcccaggctgtcgtgcagtggtgcgatcacaactcactgcagcttcgaccttccagggctcaaaggatcctcctgcttcagcctttgaaagtgcggggactacaggcactgagcgtgagggtgcctggctaatttttttcgtttctgtagagaggaagtcttgctagattgaccaggctggtttcaaactcctgacctcaagtaatcgtcccaccttggcctcccaatgtgctgggattatagacattagccaccgtacccagcctcgcctgtgaagattctttagcagttagctgattgcttcatcactatgaaaaggggtttcttatttttcttatttttttttttttgagacaggctctcactctgtcacccaggctggagtgcagtgatgcaatcgtggctcactgcagtctcaacctccctaggctcaagtgatcctcccgtctcagactctcgaggagctgggactatagaccatgcaccaccacacccagctaatttttttatattttgtagagactggatttccttgctcagactggtctcaaactcctgggctcaagcaatctgcccaccttagcctcccaaagtgctgggattacatgcatgagccactgagcccaactgtgtttttttgtttttcgtaatatataaactattttgttttcagagaaacttaagctatattgactgggaaactgtgatctagttggatttagatataatgtttgcaaatgtgtcactgcattgggtctttttgtttaccaacattaattaaagcagatacttgtgaaggccctagatgttctgtctagctgtgtttttacatgtgacttttgcttgcctgtgtttaacagaaatagacctatgtttttcttgttatcaaatgtgttttataaaataaatgctatcacaaataccagggagattattccagaatggttattcttaccagagtaatgaaaactctcttgtcttccaagaggcctaataatttgggagaccagtttgcacaatgattaagagtctagatttttggccggatgtggttgctcatgcctgtaatcccagcactttgggagaccaaggtgggaagatcgcttgagcccagaagtttgagaacagcctggataacatagcaagaccccatctctacaaaacaaacaaacaaacaaacaaacaaacaaacaaactagccagggccgggtgtggtggctcacgcctgtaatcccagcactttgggaggccgaggaaggtggatcatttgaggtcaggagttcaagaccagcctggccaacatggtaaaaccctgtctctactaaaaatacaaaaattacctgggagtggtggtgcgtgcctgtcattccagctactcaggaggctgaggtggaaagatcacttgaacccaggaggtggagggtgcggttagctgagatcctgccactgccttcgagccttggcggcagagcaagaatccatctcaaaaacaaaaacaaaaaaagctagccaggcatggtggcgtacacctgtagtcccagctacttgggaggctgaggtgggaggactgcttgagttcgggtggtgaaggctgcagtgagctatgactgcaccactgcactccagcctggatgacagagcaagaccctgttgctttaaaaaaaaaaaaaggctgggtgcggtgctgtaatcccagcactttgggagcctgaggtgggcggatcacctgaggtcgggagttcaagaccagcctgaacaacgtggagaaaccccgtcactactaaaaataaaaaaaaaaaaattagctaggcaaggtggcacatgtctgtaatcccagctactagggaggctgaggcaggagaattgcttgaacctgggaggtggaggttgtggtgagccgagatcacgccattgcactccagcctgggcaacaagagtgaaactccatctaaaaaaaaaaaaaaaaaaggagaaagagagagtctaggttttgattagaaacactagcatttggaatcaaatactcctggatttgagcctcacccatatgactctgaatatgtcccccaacctcagtttcctcattggtaaaataaagataatagtatttgttgtgagaaagcaatgagataatgtatgtaaagtttttggtacagttcctggctcaataaatgttagctctttcagctcatgaggagcaccacaagcattaaccttcctactatgccctttgtttttatttgctcttgattgattagctcttcctgtatcagaactcttgatcccaggccttgatagagatttctgcttttggctgcttaagctttggcatatatccaggttctctctccacatttggatcctttctccctttcaatgtttggctaagctatggtttttaatctggggtgagaagcagtatctcataaacagctcccgccagtgactgggcccattctggttcttatccattggattgagatggaagaggagcaattgaaataatagacatgaattcccatcaattgccaggtccctcggcttacttctaaatctctctcaactctgccggcttaattctaaatctctctcaactctgcctacttctccactgtccccaccttagtccacatcaccatctgttctcatttgggctgctgaaaccatatcctgaaaggtcttttccatgactgctctaacctgcttcagctagaaaggactttgaaaaatgttcatctgatgctgtgtcttcctgcttaacaacctccaatggcttcccattactttttgttttttttgagacggagtcttgctctgttgccaggctggagtgcagtgggacgatctcagctcactgcaacctccgcttcccgggttcaagagattctcctgcctcagcctcccgagtagctgggactgcaggcatgtgccaccatgcccggctaattttttgtatttttagtagagatggggtttcaccgtgttagccaggatggtctccatctcttgacctcatgatctgcccaccagggcctcccaaagtgctgggatcacaggcatgagacaccgtgcccaggcctttcttttgagacagagtctccttctgttgcccagcctggagtgcagtggcatgattttgactcactgcaaactttgcctcccaggttaaagcaattctcgtgcctcagcctcccaagtagctgggactacaggtgcagcctggttaatttttgtatttttagtagagatgaggtttcactatgttggccaggctggtctcgaactcctgacctcaggtgatctgcccgcctcggcctcccaaagtgctgggattacaggcgtgagctatggtgtctggccagcttcccattactcttagggtaaagccaggaacccttaaagtggcttaccagacaatgcacagctggacacctgagcatggttccaacctcatctcctgcctctatccttccagctctgtgctgtcagtcttttgaacttgacatactccttcttacttctgtctagaaaattcttcccccccttcttcaccaaattaactcttcacctcatttgcattcttcagatcttaactcaaatgttactttttctggaaatccttctctgaacccattccctctccaactgccaggtgagggcagtgtttccattctaagctcccctgacattctaaacttttgtccataggagtcacttgtttactgtcaacctcctcaagaacagggaccaggtttgttttgttcaccactgtcttttctggatttagcacagtgctaggcaaataatagatttccaataaatatttgttgagtaaatgatttatgactattatttatggttaagtatgaattgagagcaatttcaacaattgagaagtacctagttcattaatatgcatcttttaaaaatagtttctacatacaacattgtgttaagcatcttcttgatgaaatgtaacatataactaaaagcataacaacttgaaagggttgtagaggtgttatgtgataaaagcagaatataaaattctgtttatttgatgtttacaaattgtaaaacaatgtaatattattaagatgataagagataaggctgaaaatattattgatcaccataatattgtttataaagtatataaaactgaatgttgtagcctgccattttttgtgtgtcaaacaatatatatttaataatgtgataattatatgattttgaagtttttttgtttttgtcttttggtttgtttttgtttttgagacagggtctcaccaggctggagtgcagtggaatgatttttgttcactgcaacctctgcctcctgggttctagtgattctcctgcctcagcctcctgagtagctgggattacaggcacctgccatcatgcctggctaatttttgtattttcagtaggggtgaggatttcactgtgttagccaggctggtcttgaactcctggcctcaagtgatatgcctgccttggcctcccaaagtgtaaggattataggtgagagccacggtgcctggcctgattttgaagttttaaaaaaagttttccagtaatcccaacggagccaggtactttataaaatttttcttgataacgtccctcaggctttttattctgttattgatttatctgcactatcaattttttattaaacaagctttgcttttgtgcctttttttttttttttgagatggagtctcactcccttttgcacaggctggagtgcagtggtgcaatctcggctcactgcaacctccaactcccaggtccaagcaattctccttcctcagcctcccaagtagctggcataagaggcatgtgccaccacgcccagctaatttttgtatttttagtagagtcggggtttcgctatgttggccaggctggtctcaaactcctgacctcaggtgatccactcgcctcggcctcccaaaggattacaggcgtgagccactgtgcgcggcctgtgcctatttttaaaaaccattcatttatgttttcaaatttcttaatacatattttgatggaaccaaatctttctcaggtatgattttagaggaagaaatctactagagttttctgtgtattgatttttttctttgggtcttaaagggagaagaaaagattagcagttcttgaggtttctatttcatacaaaataatttgcacttttagatgtagaagagagttgtcaggccgggctgggtggctcacacctataatcccagcactttgggaggccgaggtgggtggatcacctgaggtcaggatttcacgaccatcctggccaacacgatgaaaccccatctctattaaaaaaataaaaataaaaaaaatttaaaaagttagccaggcgtggtggcaggaacctgtaattccagctacttgggaggctgaggcaggagactcacttgaacctgcgagatggaggttgcagtgaaccgagatcgcgccactgcactccagcctgggcaacaagagtgaaactccatctcaaaaataaataaataaataagtaaatataataaaagaagagagttgccaatatgaaaattttatccatggaaaccaatggcatgctatacttgaaagaacatgtccataggaataaacattaaaactttaaagcttgtatgtcacaaatggcactttgtataaataatctgacaaggttgttttaatggtcataaaatacagaagaagacagttgtaagctttattacaaggcacgtatcagacatatgagtaagatcatgaaagatctggccttctacataatttcctgctcagaagtctatttccttttcacacctgcatcaaccaccattttatttgttcatttctttaaaataataaagatgctagtgaaaaaaataaaagtgctagtgggttgtctaaaaagatggaaaaccagacaaaaaagcaaaacaaggaaaaacaaaacttttaatcttgttaattaatcaaataaattgttttttaatttttcaatttcctcctgcccttacatttattattccctttattttgtgttcctttgtgatctagttctttttctaagttctgtaaattcactctacttttatctttctctttaaccaatataggcatttggggctatggatttttcttcacatatgtttaagccacgttatggcaatttgttgtgacctaaaccatatgtccccagcagacagattcttagtatctctgacaggactgtgtttagtgtgagctttcattgaatgtttcctgcgctactgaatcaaataacgaaatgttttcacggcatgcacgaatgcatagtcaagcaaaagaaaaaagtgattgtgcaggttgtggcacaattctgagagtcttaggagcccccttctcaccatagcacagttaagttttattgatttgcacaaccactcccaaatacaagttctttgaaataaaaaagactaagaatcattgatgttccttttactccatttgtcagatttaccacgtcccttggccatcttcatttcccccactatctacataagaatgtatagtccaaaagtttaacttctctccctttctctttctttctttctttcttttcttttcttttcttttcttttcttttctttctttctttctttctttctttctttctttctttctttctttctttctttctttctttctttctttcttcccttcccttcccttccttccttccttccttccttccttccttccttccttccttccttccttccttccttccttcctttctttctctttttttttctgacagagtctcactctgtcaccagactggagtgcagtggcacaatcttggctcactgcaacctccgcctcccgggttcaagtgattctcctgcctcagcctcccgagtagctaggactacaggtgcctgccaccacgcctgactaattttttgtatttttcgtagagacggggtttcaccatgttggccaggatggtctcgatctcaaaaaaaaaaaaaaaaaaaagacaaagcagtcacccaggaggctagccagggtaccaaaagacgtgacagatgacgtttatgaggttataatgttagtcggaagagtatgggtttctctttcagtatgggtttgagtgactttgagaaagttaattaatgtttctgagcttccatctcttcaacttttttcttttctaatctattttattttttatttactattattatttttattatttcaatagttttaggggaacaggtggtattttgttatatggacaagttcttttcttattatactttaagttctggggtacatgtgcagaatgtgcaggtttgttacataggtattcacatgccatggtggtttgctgcacccaccaacccgtcacccacattaggtatttctcctaatgttgtccctcccctagccccccacccccagatatgccccagtgtgtgatgttcccctttatgtgtccgtgtgttctcattgttcaactcccacttatgagagagaacatgtggtatttggttttctgttcttgtgttagtttgctgagaatgatggtttccagcttcatccatgtccctgcaaagcaatgcactcatcctttttaatggctgcatagtattccatggtgtatatgtgccacattttctttatccagtctatcattgatggacatttgggttggttccaagtctttgctattgtgaatagtgccacaataaacatatgtgtgtatgtgtctttatagcagaataatttataatcctttgggtatatacccagtaatgggattgctgggtcaaatggtatttctggttccagatccttgaggaattgccacactgtcttccacaatggtggaactaatttacactcccatcaacagtgtaaaagcattcctatttctccacatcctctccagcatctgttgtttcctgactttttaatgatcgccattctaactggcatgagatggtatctcattgtggttttgatttgcttttctctaatgaccagtgatgatgagctttttttcatatgtttgttgggtgcataaatgtcttctttttgagaactgtctgttcatatcctttgcccactttttgatggggttgtttgtttttttcttgtgaatttgtttaagttccttgtagattctggatattagccctttgtcacatggatagattgcaaaaattttttcccatgctgtagattgcctgttcactctgatgttagtttcttttgctgtgcagaagctctttagtttaattagatcccatttgtcagttttggcttttgttgccattgcttttggtgttttagtcatgaagtctttgccaatgcctatgtcctggatgttattgcctaggtttccttctaggatttttatggttttaggtcttacatttaagtctttaatccatcttgagttaatttttgtataaggcataaggaaggggtccactttcagttttctgcatgtggctagccagttttcccaacaccatttattgaatagggaatcctttccccattgcttgtttttgttaggtttgtcagatcaaatggttgtggatgtgtggtgttatttctgaggcctctgttctgttccattggtctatatgtctgttttggtaccagcaccatgctgttttggttattgtagccttgtaatatagtttgaagtagggtagcttgatgcctccagctttgttctttttgcttaggattgtcttggctatgcaggcttggttctatatgaagtttaaagtagttttttccagttctgtgaataaagtcactggtagcttgatggggatagcattgaatctgtaaattactttgggcagtatggccattttcacaatattgattcttccta

SEQ ID NO: 1791 - DNA, 661 bp, Homo sapiens
  SYNE2
  misc_feature [331]..[331]: Chromosome 14, SNP identification no. = rs1152591
  misc_feature [331]..[331]: allele = a, in linkage disequilibrium with rs1256033, respectively
  misc_feature [331]..[331]: n is a, t, c or g
cgacatcatacccgggaggagcaggagaagcactctcctcctcggggggtgcagcggacacaccagggtgaggtccccctacctcaggtgcgactgtccccagagcgtcggtctggcgagcacgggaccccggtgatctactgtgtccctgactcctctactgccaaggagcgagagaggggcaaatgcggttcttagtcagacctaaagagaccccagaaggtacagacaaagtaagagtctccggaggaaaagtagaaggttcgggatttggtgtcataggtcaacaatcttaattagttgagtatccgaagacgttaatcttctcgtnctcttcagacggatagatcgtcaaaggtttttattgacggttatcataaagattccgtcgaaatttttctagtccaagggtccaggacaaagaccaataaggtcaaatctgttagacctcaccccggattttagacaataaaagggtttggaggtcgataaaaaagaatccttttttttcgacttcaaactattagattcaatttgttgaaatagatcctctattcctttaccaccggtttcaaagtaactaccaattaccgtccaaggaggttcttagtctgataaaaacttttcctgtaaacttacaagacccattctgagtttgaag

SEQ ID NO: 1792 - DNA, 661 bp, Homo sapiens
  SYNE2
  misc_feature [331]..[331]: Chromosome 14, SNP identification no. = rs1152589
  misc_feature [331]..[331]: allele = a, in linkage disequilibrium with rs1256033, respectively
  misc_feature [331]..[331]: n is a, t, c or g
tctccttcacaaagacttaacctgtgtttgtcgggtaatagtcgactgaacctaaactcgtacgtttccgtcttagaggaggttactacattgttataagagaggaattaaagagagcgacgacgggatccgacgggagggtcctcgacggatcggtctcgtacggttcttgagttccgtcgactccctttacattgattcttctttgtcggtaacgatatttgttgtttggttatgtccttattattagtgctggttatgtccttattattagtgctggtaatgaagactcctggaagaaaatggaaatatgtgttattagaattgttgntgatccactttatcgaaatcggagtccactctttccgaatgtcttcgttccgcttcacggagtccatggtaccgttacctaaccgtcccgatccttagtttaggcacaggtgacgtcgtgtggtagttactaaaaaaccttatcctacatacctgttttccaattgtattgtttccgaacttccaacctacgtcacctggtacggacattagggtcgcgaaaccctccgactccgtccacctagtgaactccagtcctcaagttctggtcggaccggttgtaccactttgggggtagagatgatttttatgtttttaatcggtccgtacc

SEQ ID NO: 1793 - DNA, 661 bp, Homo sapiens
  SYNE2
  misc_feature [331]..[331]: Chromosome 14, SNP identification no. = rs915057
  misc_feature [331]..[331]: allele = a, in linkage disequilibrium with rs1256033, respectively
  misc_feature [331]..[331]: n is a, t, c or g
ccaggaaagggttcgggaaagttccttctaaggtggtgatcagaaagcacattgacacgtcgtatgtcaaaccttctcaccaaaatgtgacggactgtcacaggtgatcgtggaggtcttttcagatctttacggagcctacagtctaaaaaggtagagacctctagactcggtgtggaggggtcatgagaccctagtcctagtaaacgtctatgagaaggtacacttttgtttttagacgtagatacaggaacggttgataccttgactttaccttctctcactggagatgtatgtggtagacgttcgacgcggatacggtgcttatgtnccctagacgagcaggtcgtatcgttacgcaagtgtacgtgtaagacttagggagaaggggtggtgtggagattgagtggacgtcagagaagtgagagtcaagataaaggacctatagtctccctccgaaacggtagaaattgtaaaggtcgagacgaagtcaaaaaaagtcggttcatcactaccgcgactatagtctcaagtcgacaacgtttaaaacaaaataaaactcgaataacacttcgaggacacgaacttagtagagggtagacagcttccgtggaccttaattttttagcggttaatttttttcgttattacgttgtctaaa

SEQ ID NO: 1794 - DNA, 661 bp, Homo sapiens
  SYNE2
  misc_feature [331]..[331]: Chromosome 14, SNP identification no. = rs1152588
  misc_feature [331]..[331]: allele = g, in linkage disequilibrium with rs1256033, respectively
  misc_feature [331]..[331]: n is a, t, c or g
ctagcccagtacctgacacagtaaatgcacagcgggtgtgagctctgcaccactgcctagctctggctgtgtctcagggaacgtgagcccaccccagcctgtcctgttgggttgtttccctctgccactggaacccagcagagaacccagcagattggctgaggaatgcgtgtggccttcatatataaaatcagctgggcatcccaaagccctaccttcatagtggcacttttattcgcggcctcctggcactgtgctgagtgtcttccttctttcctcttcctcattttggggccctggcatttagtttaaagctggtcctcgtattcantgggtaaggccagaaaagcaaatgactgtgatggattggaagcagtaagccatgttcctggcacaccctcttccagggctctaagacacggccgcgctctgatgtgttgttttttaaggacttccaccagttgagtcaaaatctgctgctgtggttagcgagtgccaagaaccggaggcagaaggctcatgtcaccgatccaaaggcagacccccgggctctcctagagtgtcggagggaactaatggtaagtttcctcccaagggctctgtactgccaccagcctctgtcagccccagagaggcagcacactcaggtagcctcgcctag

SEQ ID NO: 1795 - DNA, 661 bp, Homo sapiens
  SYNE2
  misc_feature [331]..[331]: Chromosome 14, SNP identification no. = rs1152582
  misc_feature [331]..[331]: allele = g, in linkage disequilibrium with rs1256033, respectively
  misc_feature [331]..[331]: n is a, t, c or g
cacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagnacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaac

SEQ ID NO: 1796 - DNA, 661 bp, Homo sapiens
  misc_feature [331]..[331]: Chromosome 14, SNP identification no. = rs928554
  misc_feature [331]..[331]: allele = c, in linkage disequilibrium with rs1256033, respectively
  misc_feature [331]..[331]: n is a, t, c or g
ttctcaaaacccttatgtgactcgaaactcactttcttcgacgtcaccggagggacctctacccctcgtttggtcgaatttccgggaataggactccttctctgtttttaactgtacgtgttataattcgaaactttacgtctggtgtgaaggaaagtgacgttgaaactgaacagggcgtagagatgaattcccgtcttttccggagagtttgtgagtggagtaaaccttacttctacctctgagaaaacggacttcgttgctacctcgtcactgggagattagttgagccaccggatttctttttagaacccattgtaaaagtgaagtnaaagggagaccctagtaacattaggtactttttttattaaaatttctttctcaattttatgaaacttcaatcaatacaccaatttttggtggaaggaaagataatagttaggttgttaaactattgacatttgcgatttcacttctgcctaagagaagtctaccagaggaattgacgggtcccgaacgtctacagagtgggtactccccgtggttacatctttcgactccgaagtagatgactactcgaagtgaccaaaggggactccaaacacgaaaccgtctcttcccctcctcccctgaccctaacacaccagtcgacacggacggt

SEQ ID NO: 1797 - DNA, 661 bp, Homo sapiens
  misc_feature [331]..[331]: Chromosome 14, SNP identification no. = rs1152579
  misc_feature [331]..[331]: allele = a, in linkage disequilibrium with rs1256033, respectively
  misc_feature [331]..[331]: n is a, t, c or g
acaggacctgtggtcataaatcaatcacaagtgtgagattagctgactaaagatgaaattgttctttttaagaagatacattaaagcagagcttcttaactcttctgaaattgtactcaagcatttgtgttcaggtgccctttcccaggaagactagccctggttttcatcaaattctcaaaggactctctaaccccacaataagaattcagaatagaatgtagacactacttagcctaattactgtaagttcttacactcaacccccaacaaatacatttttaaagccaaaataatgaaacactttatttatatcatgttaaactctctncgacagtgccatagacattaaagggacacagtaaggaaaacactccctggaggaagggaaagcaggtctcaaaatctgctttcacagagcagcaaacattcatttctacaaggcccaaatgtaaagcctgcaaatgaagtcaacaaattagtgtaatgatacaaagcattcgtctgagaaaatggcaaattatagccaaccaacaggctctgaagtacacattgaatgacaaaaggtataggaccaacagttaaggcatttagacacccaacagaggaaacaaatgcaaaaacatccattgtacagttaacaggaactgttcgcggctgg

SEQ ID NO: 1798 - DNA, 661 bp, Homo sapiens
  misc_feature [331]..[331]: Chromosome 14, SNP identification no. = rs1152578
  misc_feature [331]..[331]: allele = t, in linkage disequilibrium with rs1256033, respectively
  misc_feature [331]..[331]: n is a, t, c or g
ttttctgaactgggattttatcagaacttccctaaaaagagttttttaattccgcccttgtgttctgtttcgacagtcggatcagtgtttagacttctgagttgacgtaatttttatcacgttttagccgtcctcgacatgtcacgctcagaaccagaccttatgagggggacgattgagtcgaccttcccgttgatagaatctaaagtcattccttctttttagtcaatggttatgaaccgtctcggtataatatataggtatatataaatacatatattcaccttaacttcgttaagatcttaaaagatcgtacactttcgtcccaaancaagaataaatgcagacgattccctgaaaagtttaagtttcacttggaagacaaatatccggataaaactttgtttcataggagtgaattattctaaactgtggaaaaaaaaaaaaaaaaactctgtcccagactgaggacaacgagtccgatctcacgtcaccgcggtagtaccgagtgacgtcggagctggaggacccgagttcgctaggagggtggtgtcacggggtagggtggggtaagggcgggagcggctcatcgaccccacgtgtggtggtgaggaccgattaagaaaattataaacatctctaccccaaaatgatacgaggg

SEQ ID NO: 1799 - DNA, 661 bp, Homo sapiens
  misc_feature [331]..[331]: Chromosome 14, SNP identification no. = rs1256065
  misc_feature [331]..[331]: allele = g, in linkage disequilibrium with rs1256033, respectively
  misc_feature [331]..[331]: n is a, t, c or g
acaagagagggactggaacgacggtcgacgtgtgtctaaacagggagagctaaacataagtgtctcggacggttattaaaccccatacacacatactcgcacactagtaaaagtacgtcctgacaccctctatgtttagagcgacgaagacctcgacgagaaggaatttggacaacagggtaccccggtcgcacccacgacctctttccggcacaaacgtccttaccccaagagaggacacccacacccactgtcggtgtcacaaagggaccccgttacacctacgtcaaaggtagaacatgttggagtattcatcgtcggtgttaacggngtagtcagtggtgttcatcagtccctatgaaacccgacacctacacacgtcacacgacaaaatacctacctactcatcgatacgtggggtcacacagtcgagaccccggtgtgacatatcggaactactcatgcggggaacttgttctgggtcaaacacttgagaggaatttctctttataaatccctattaataaatatcgttctttcttaagaaaatgtgaactctcgagaaaatttttataaaagaataaccttttaaatataccacccgtcccactttttctttgtcatttttataatcaagaataaggttcaccttgtatttatc

SEQ ID NO: 1800 - DNA, 661 bp, Homo sapiens
  ESR2
  misc_feature [331]..[331]: Chromosome 14, SNP identification no. = rs1256061
  misc_feature [331]..[331]: allele = g, in linkage disequilibrium with rs1256033, respectively
  misc_feature [331]..[331]: n is a, t, c or g
ccgcctaacgctccagtcctcaaactctggtcggaccggtcgtaccactttgtgacagagatgacttttatgttttttaaacgacccgtaccaccgcgtacggacattagggtcgatgattcctccgactccgtcctcttaacgaactttggccctccgcctccaacgtcactcgactctaacatggtgacgtgaggtccgacccactgtctcactctgagacagagttcttttctttttttttttttccagacacgggagtttcgtgagtacaggtcagaacgactcccgtcttcccaccgacaccccacacacacccctgttccgtctntaggtcgtacaccccgttgtaccacagagacgactcctacttgtcccgtgacagtctcatagtcccctgtggagtctggtctgaatcccaccctaccatccctccaacccccttcgaaggtcttccttaaagactggtccaaccttagatgtcctccttacccatatttactcgttttcttagtcccatctctttctccttcctctctcaaaggttcgtcgttcaactcgtacaagcctcgtggtgtgtaagtccctcaactctccccctgagttccgctccacaccacccttgacgtctactctcttcgcccctcccgggaccatggag

SEQ ID NO: 1801 - DNA, 661 bp, Homo sapiens
  ESR2
  misc_feature [331]..[331]: Chromosome 14, SNP identification no. = rs1256059
  misc_feature [331]..[331]: allele = a, in linkage disequilibrium with rs1256033, respectively
  misc_feature [331]..[331]: n is a, t, c or g
gggaaataggtcagttcaactgtggattctgattggtagtgtttcccattgggtttatctgtggtcaccagagggaaccatcgttccgtcgatcctgaacctcccctctcatgactcaccctttctcgacgtgtttcttaaaacctctagatacctctcaggagaagttcagaagtcgactcacgattagacgggtacgaatactcctatggttcctgtccctttcttggtagtctttcctcgcccgctttgttagggatctcaagtgtgtcccggtccttgtcaagtgtaagagtggtcggtcaccctttttggaacgtcaagtgacccntaacccgtgaagagtcggaaggatatcataagtcttcccataacggagtcatcacccggatctgattttcggtaatactaggatggtttgttttttcgttcggacctcctagtttgttaacgattcactaaattgacgtagggtcgtgtttcgagttctcatctctgtgtagggtaaagtaatgtacaacgaaataacacgtagtgtctatgacgtacaaaaatgtttagcttccaaacaccgttacgacgtaacttgttcagacaatcatggtaaaaaaggttgtcgtacacgagtgaaatacagacacagtttaaaactattgtgaaa

SEQ ID NO: 1802 - DNA, 661 bp, Homo sapiens
  ESR2
  misc_feature [331]..[331]: Chromosome 14, SNP identification no. = rs1256056
  misc_feature [331]..[331]: allele = t, in linkage disequilibrium with rs1256033, respectively
  misc_feature [331]..[331]: n is a, t, c or g
cccctaatacctctaatgttaagttctactctaaacccacccctgtgtttcggattggtacagtctgtcccaaagtggtacaacaggtccgaccagaacttgaggaccgaagctcactagacgggtggaaccggagggtttcacggcactaatgtccacactcggtggtgtaggccgggtggtcggtcctataaactttaactagtaccttattctagttgggaaagactggaaaaggtttggtggatggttgtaatggagtgtatccacgacggtaaagacagtttccctcctagacgaacttctcatggaagggtagaaccgttacctnctagtagtttacggtctactaccccgaagagagtgaaagtctttattaaatctagagaaaagacacgtcctttcacgaagagcctttcgtgacaaacgaacaacaatgttgtgaaatgtcatatttcggaagacaaaccgttccgaggaatatccgtaaaatcggagggtctgtagtataacacaacaacagtttcgatctgcgtcgtagacacgtttaccctttctacttccgatgtcgtaaggggacgtcgtactgtcttgacggtgtaactctattaatgtcttccgctccctctgtacactacattaatggtgaacaccgtcattt

SEQ ID NO: 1803 - DNA, 661 bp, Homo sapiens
  ESR2
  misc_feature [331]..[331]: Chromosome 14, SNP identification no. = rs4365213
  misc_feature [331]..[331]: allele = t, in linkage disequilibrium with rs1256033, respectively
  misc_feature [331]..[331]: n is a, t, c or g
agtcttgctctgtcgccccagctggagtgcaatgacgtgatcttggctcactgcaacctccacttcctgggttcaagcaattctcctgcctcagcttcccaagtagctgggattacaggcgcctgccaccacacccagctaatttttgtatttttagtaaagaaggggtttcatcatgttgctcaggcttgtctcgaactcctgacctcaggtgatccacccatctcagtctccccaagtgctgggattacaggcgtgagccaccgtgcctggcctaaagaagaatattgtttaatacaacaacaaaatgttgaatgagtgggcctccctnaggggtacactatttgtgtgtgtgtgtgtgtgtgtgtgtgtgtgtgtgtgtgtgtgtgtatgtatgtgtgtgtatatatatatatatatctctgctcgcagcacacacctgggtacagaccatggtttacctctgtgtgtatggcaatggcagggagtgtttaaggcttagaattgggaattgaaaattcggtggttatcttgaaggaatttagcatacaaataactaatgtgaatgtaaactcaagacatttatacatatacaattccacggacctatctgcaaatgtccacaatgggatccaagccagatacaaacttcctctgacta

SEQ ID NO: 1804 - DNA, 661 bp, Homo sapiens
  ESR2
  misc_feature [331]..[331]: Chromosome 14, SNP identification no. = rs6573549
  misc_feature [331]..[331]: allele = t, in linkage disequilibrium with rs1256033, respectively
  misc_feature [331]..[331]: n is a, t, c or g
tacaaaaattggccagccgtagtggcacatgcctgtaatcccacctactcaggaggctgaggcacaagaatcacttgagcttgggaggcggagattgcagtgagctgagatcatgccatcgtattccagcctgggtgacagagcgagactccatctcaaaaacaaaaaacaaacaaacaaaaactactagaaattgcaacaacaaataaacaccagtagtcattccaaaaaaaaaaaaaaatgcctgctcaacatgaatgcatttacaattcccaagaattcctcttctatactcaatcaaatatactagatttatgttttacaacataanactttcacttaagttataaaggcagtgtaagtctattagaaataatttgtaagaaaaataacttttcttctattaactaaaaggtaggcctaatatttttccaggatttgtgtccacttatagtaatgtatacacacaattacaggaattaaagaacgcatacagagaaatgggagagtggagagttaattgtactaaaaaccaggaatgaaatagtcaccaaaaataaacactaaatttggcatcaatttagaaatcaagacaaaagataaaataatcctaaagtctgcaaattatttgtcaagggatggaatgtgttcctaggactaa

SEQ ID NO: 1805 - DNA, 661 bp, Homo sapiens
  ESR2
  misc_feature [331]..[331]: Chromosome 14, SNP identification no. = rs12435857
  misc_feature [331]..[331]: allele = g, in linkage disequilibrium with rs1256033, respectively
  misc_feature [331]..[331]: n is a, t, c or g
ccagcgctttgggaagctgaggtgggcagatcgcctgaggtcaggagttcaagaccagcctggccaacatggtgaaaccacttctctactaaaaatagaaaaattagcctggcatggtggtggacacctgtgatcccaactacttgagaggctgaggcagcaggatcacttgaatccggtaggcggaggttgcagtgagccaagattgcacctctgcactccagcctgagcaacagagagagactccatctcagaaaaaaaacaaaaaacaaaacaaaacaaaacaaaaaaaaacaaaagagtgagttaaagcatgtgaaaataaacttgncacatttctaagaattttatcacctgtccagaaagctccagatataattggtcactataggtacaaaaaacagcaggacaacttaagattataacctgaaaatggaatttttaatggagaaaaatctgtgtcgacttatacacatagtggccacatacctacgggatacagtcccctattaaagcgctggcctgtaaatgctgctgcaccacagattaaaaatgagtcacaggaccctgaatccttggacccaactctctccttctctggttcttgacccagtgaaggagctgatgatgctatcatcctctgccctgcaagtgtgagatt

SEQ ID NO: 1806 - DNA, 661 bp, Homo sapiens
  ESR2
  misc_feature [331]..[331]: Chromosome 14, SNP identification no. = rs1256048
  misc_feature [331]..[331]: allele = a, in linkage disequilibrium with rs1256033, respectively
  misc_feature [331]..[331]: n is a, t, c or g
catcagggtcgatgagtcctccgactccgtcctcctaacgaactcaggtcctctacttccgacgtcactcgatactaacgtagtaatgtgaggtcgaacccgttgtctcgtcctgagacagagtttttatgttaattttatcacatctatgatgttagattaaaacacatatttccgacccacgtcaccgagtgcggacattagggtcgtgaaaccctccggttctacccgtctagtgaactcttagtccttaaactctcgtcggaccggttgtaccactttagtgtagagatgatttttatatttttaatcggtccgtaccaccgcccgnggacattagggtcgatgaaccctccgattccgtcctcttagcgaacttgggccctccgacttcaacgtcactcggttcttacacggtgacttgacgtcggacccactgtctcactctgaggcagagtttttatttatttattaaaacacatattttgcacctttttataccaccgtccgtgggtatcaggatcgatgagccctccgactccgtcctcttaccgcacttgggccatccgcctcgaacgtcactcggctctagtgtggtgacgtgaggtcagatccggtgtctcgttccgaggcagagttttttttttttttttcttttttc

SEQ ID NO: 1807 - DNA, 661 bp, Homo sapiens
  ESR2
  misc_feature [331]..[331]: Chromosome 14, SNP identification no. = rs1256045
  misc_feature [331]..[331]: allele = a, in linkage disequilibrium with rs1256033, respectively
  misc_feature [331]..[331]: n is a, t, c or g
acaacaaaacttcatatactcaaatcttaataaatagaaaaattttataagatcgctactcagaggaatagatattattattaaaaacggaatttcaaataaacagaccatagttatctcattacagttaaataaaccaattaaaacggacaatttataaaaagatagacagatgaaacaaaaagatatacaatccatatagagaatgtggattagatacagatctaaatttttatacatattaaagtctcagtgagaatttaccagttaaaccataaaaaacaaataacactattgactataaacccaagtaaagatagtagaataaaanactaaattttttaaaataatacataaaagatgaagaagggaaaatcctcaactagtgtaaaaatacaaaagaaaaagaagaaaacgatcaaattttcagtatgtaagacaaagttaagggaaaatagaaaactctgtctcagagcgacacagtgggtccgacctcacgtcaccacactagaaccgagtgacgtcggagacggagggtccaagttcactaagaggacggagtggaaggatttgtcgatcctaatgtccgtaaacggtggtacgggtcgattaaaaacataataatcatctctaccccaaagtggtacgacgggtccaacca

SEQ ID NO: 1808 - DNA, 661 bp, Homo sapiens
  ESR2
  misc_feature [331]..[331]: Chromosome 14, SNP identification no. = rs1256044
  misc_feature [331]..[331]: allele = g, in linkage disequilibrium with rs1256033, respectively
  misc_feature [331]..[331]: n is a, t, c or g
gagggtctcacgaccctaatgtccacactcggtgacatgggtcgggagggactgttaaagaatcatcgaaacggaacactcgtaagagacgggaaaagaaaagagacacatacattgtctaatcttgggagtcgataatatcaagtcaatgtcgtcttcaagagaagtagactagtacgaagagaccgaaggatctcagtgactactagaagtaaaggagacatcttgtaggacggtcacgggtatcggagtgtcgcacataataaccaataagagagtttgtggatttgtaaaggtaagggtggcgaagtgtaataggaacagtctttgnccacccgaagaaaagtttggacaaagatgagtgacattaacaatgtaatattttaaattaattttaaatgagtttgtataatacttatccttttctgttcaaaccaaaaaaagacactttcaaatcaattccggcccacgccaccgagtgcggacattagggtcgtgaaaccctccggttccgtacgtttagtactccagttctctagttctggtaggaccagttgtcccactttggaacagaggtgatttttatgtttttaatcggcccgcaccaccgtacacggacatcagggtcgatgaaccctccgactccttcctcttatcaaac

SEQ ID NO: 1809 - DNA, 661 bp, Homo sapiens
  ESR2
  misc_feature [331]..[331]: Chromosome 14, SNP identification no. = rs1256043
  misc_feature [331]..[331]: allele = a, in linkage disequilibrium with rs1256033, respectively
  misc_feature [331]..[331]: n is a, t, c or g
aaaaaaaaaaactctacctcagagcgagacagtgggtctgacctcacgtcaccgggtaagagtcgggtgatgttcgagacggagggcccaagtgtagtaagaggacggagtcggagggttcatcgaccctgatgtccgtgggtggtggtgcggaccgattaaaaaaaaaaaaaacataaaaatcatctctaccccaaagtagtacaatcggtcctaccagagctagaggactggagcactagacggacggaaccggagggtctcacgaccctaatgtccacactcggtgacatgggtcgggagggactgttaaagaatcatcgaaacggancactcgtaagagacgggaaaagaaaagagacacatacattgtctaatcttgggagtcgataatatcaagtcaatgtcgtcttcaagagaagtagactagtacgaagagaccgaaggatctcagtgactactagaagtaaaggagacatcttgtaggacggtcacgggtatcggagtgtcgcacataataaccaataagagagtttgtggatttgtaaaggtaagggtggcgaagtgtaataggaacagtctttggccacccgaagaaaagtttggacaaagatgagtgacattaacaatgtaatattttaaattaattttaaatgagttt

SEQ ID NO: 1810 - DNA, 661 bp, Homo sapiens
  ESR2
  misc_feature [331]..[331]: Chromosome 14, SNP identification no. = rs10148269
  misc_feature [331]..[331]: allele = a, in linkage disequilibrium with rs1256033, respectively
  misc_feature [331]..[331]: n is a, t, c or g
cgaagaaccaatcagaggcagcaaaactgatgaggccaggagaccagatgacagcctgctgtagttgtgcaaatgagagatgtctggatggggtgttggtagggaggatgaggacagctacatgggtttgagaaagggttaagaaatagaaattataataaaatagatgagaagcaaaagtgaaagtgaatagggcattttagtgcctttctaataaacaatatggcctcaacatcttacattaagcctataatgaaccagaatttcagtgcggagaataaatgaatctcaatgataaatgaaatgagcaagtcataaaagaaaaaagtcncaaaatatatgtagaagacatgaacacataaagttcaaaaacagagaaaatcaacctgcatcgtttagggatgcacgtgtaggtggtaaaaccatacacagcaaggaaggcagaaaggaggactgtcccacctctgcagggagggaagtaggtgtggcaggagggaccacccaaagggattctgggctgccattatattctatttcattgtttgagcgctggttacacagggatttgctctataatcattctttaaactggacatgttacatgcagaattctacacattagcaaacaatgaaaaggtaatttttttttttttgagacaga

SEQ ID NO: 1811 - DNA, 661 bp, Homo sapiens
  ESR2
  misc_feature [331]..[331]: Chromosome 14, SNP identification no. = rs1271573
  misc_feature [331]..[331]: allele = a, in linkage disequilibrium with rs1256033, respectively
  misc_feature [331]..[331]: n is a, t, c or g
taacccggtatgatctctacaataacaaactttagtttatatacttcatatcaattattatattcacattatcttcttttcctcggaatctttcgaactttttgtagcaacatgaagtatatgtagaagaaacgaatgtaatattacctgttacgacgttgtttgtaccttcacgtctatagagaaacgttgtactctctaagtacatctagattctctgacacttctgacaaagttataacctcaatgttaatcgaaaaattaatggagaagaccggtcgacaccaccgagtgcggacattagggtcgtgaaaccctctggttccgcccncctagtggactccagtccttaagctctggtctgaccggttgtgccggtttggggcagagatgatttttatgtttttaatcgacccgcaccaccacccacggacttagggtcgataaaccctccgactccgtcctcatagtgaacttgggccccccgtctccaacgtcactcagctctagcacggtgacgcgagattggatccgttgtctccttccaagacagagtttttttttttttaatggaaaagtaacaaacgattacacatcttaagacgtacattgtacaggtcaaatttcttactaatatctcgtttagggacacattggtcgc

SEQ ID NO: 1812 - DNA, 661 bp, Homo sapiens
  ESR2
  misc_feature [331]..[331]: Chromosome 14, SNP identification no. = rs1256040
  misc_feature [331]..[331]: allele = g, in linkage disequilibrium with rs1256033, respectively
  misc_feature [331]..[331]: n is a, t, c or g
taatcatgttgatgatacctcttgtcaaacttcaaaggagttttttgatgtttatctcgatggtatactaggtcgttagggtgacgacccatacgtgggttttctttcctttagtcatatagcttctctacagacgtcagggtacaaacaacgtcgcgacaagtgttatcggttctaaaccttcgttggattcacaggtaggtgtccacttatatctatttcttttacaccttgtatatgtggtgataagccggtattttacttactctaggacagtgaacgttgttgtgtctacgttgacctccagtacaattcactttattggtctgtntgtttctgtttggagggtacaagagtgaataaacaccctcgatttttatttttgttaacgtcacggagtacggacattaggatcgtgaaaccctccagctccgtccgtctaacggactcgagtcctcaagctctggtcgaacccgttgtgccactttgggacagagatgattttatgttttttaatcgacccacaccgccgtacgcggacatcagggtcgatgagccctccgactccgtcctcttaacgaacttgggccctccacctccaacgtcactcagctctagtacggtgacttgaggtcggacccactgtctctctctgaggcag

SEQ ID NO: 1813 - DNA, 661 bp, Homo sapiens
  ESR2
  misc_feature [331]..[331]: Chromosome 14, SNP identification no. = rs11158536
  misc_feature [331]..[331]: allele = g, in linkage disequilibrium with rs1256033, respectively
  misc_feature [331]..[331]: n is a, t, c or g
tagatttttttttcagattgtttgctgttggcatatagaaatgctactgatcctgcaactttactgaatttattagatctaatagttttttggtggaatttttcaatttttccaaatataagatcatcagcaaactaggataattagacttcttcctttccaatttagatgccctttatttctcttttctgattgctctagctaggacttccagtactatgttgaataacagtggtgaaagtgggcatcctcgtcatgttccatatagaggaaaggctttcagtttttctccattaagtgtgatactagctgtgggtctgttatatgtctnttattgggctgaggtatattctgtctatacccagttttttaagggtttttatcatgaagggatgttgaattttatcaaatgccttttcagcatcaattgaaattatatggttttccaccttcattctgtcgatatggtgcatcaaattaatttgcatatgttgaaccatccttgcatccctgggataaattccacctggttatgatgaataatctttttaacgtgttgttgcatttggtttgtattttattgaggatttttacatcaatattcattggggatattggtctgtcatattcttttgatgtttctttggttctggtatcacgg

SEQ ID NO: 1814 - DNA, 661 bp, Homo sapiens
  ESR2
  misc_feature [331]..[331]: Chromosome 14, SNP identification no. = rs1256038
  misc_feature [331]..[331]: allele = t, in linkage disequilibrium with rs1256033, respectively
  misc_feature [331]..[331]: n is a, t, c or g
tctggtgtatgtatgacaattctaacttgatacttctttaggctttggacttgtatggtcattgttcattgttctaacttcgacaatatttttcggagggtcgttcgacccgtgttaccgagtatggatattagggtcgtgaaacccttcggttccgtcctcctagtggaattgggtcctcaagttctaatcggacctgttgtgtgtctctagggatagagatgttttttttttttttaatgtttaatcggtccacaccaccatacgtagacatcagggtcgagaagtcctccgactccaccctcctatcgaaccctggcccttcagttcngacaccattctgttctaacgtggtgacgtaagatcggacccactacctcacactagtccagagtttttttttttttttttcagagagtcgtttcttttcggtcctgactaccgaagtaggtcttaaaatggtttgtaaatttcttcttgattacggttaggataagtttgttaagactttttatctcttcctcctcccttattaaagttttagtaaggcactctggtcataatggcactatggtcttggtttctttgtagttttcttatactgtctggttataggggttacttataactacatttttaggagttattttatgtttggttt

SEQ ID NO: 1815 - DNA, 661 bp, Homo sapiens
  ESR2
  misc_feature [331]..[331]: Chromosome 14, SNP identification no. = rs1256037
  misc_feature [331]..[331]: allele = g, in linkage disequilibrium with rs1256033, respectively
  misc_feature [331]..[331]: n is a, t, c or g
taaaacaagtgatcaccgtgaatggttaaggaacttatactaaaaagttttaattaacccgaatatgtgtctcaagacatagtaaaaagtgaattataacagcatattcgtaaagacaacaatttaaaggtctctgggaaaagtgttgacgtgttgacacattataagatagaatactagtctaaattaaataaattgagaaataataacttccgggatagttaataaaagtaacaaaattacgataccaatgaaataaacaagtacttcaaaactttttttattcaaagagacctatacaaaaatcttgtttagacaccccagtctcacntaattacaaatttcaagaactgtctacaaaagttcacaagttcagaattcttccaacatgtctgaacgagaaaatggtcgtcacactcacagcgaaaaaggttggagaaccatcgtaactgagaatagtttttctttttttggaacgatgtaactatgcactacatatcatagaaaaccaaagttaaacgaagagaaataatcactccatttacaaaagagtatttagatagacggtaaacataaaagagaaaatagaagaaataagtctctaaaacgggcaaaaatataacccaagaccgtaaacgaactatttaaataacacacgaaa

SEQ ID NO: 1816 - DNA, 661 bp, Homo sapiens
  ESR2
  misc_feature [331]..[331]: Chromosome 14, SNP identification no. = rs1256036
  misc_feature [331]..[331]: allele = c, in linkage disequilibrium with rs1256033, respectively
  misc_feature [331]..[331]: n is a, t, c or g
tatctaaggtactcccgttcctaaaaacaggtaaaacaagtgatcaccgtgaatggttaaggaacttatactaaaaagttttaattaacccgaatatgtgtctcaagacatagtaaaaagtgaattataacagcatattcgtaaagacaacaatttaaaggtctctgggaaaagtgttgacgtgttgacacattataagatagaatactagtctaaattaaataaattgagaaataataacttccgggatagttaataaaagtaacaaaattacgataccaatgaaataaacaagtacttcaaaactttttttattcaaagagacctatanaaaaatcttgtttagacaccccagtctcacgtaattacaaatttcaagaactgtctacaaaagttcacaagttcagaattcttccaacatgtctgaacgagaaaatggtcgtcacactcacagcgaaaaaggttggagaaccatcgtaactgagaatagtttttctttttttggaacgatgtaactatgcactacatatcatagaaaaccaaagttaaacgaagagaaataatcactccatttacaaaagagtatttagatagacggtaaacataaaagagaaaatagaagaaataagtctctaaaacgggcaaaaatataacccaagac

SEQ ID NO: 1817 - DNA, 661 bp, Homo sapiens
  ESR2
  misc_feature [331]..[331]: Chromosome 14, SNP identification no. = rs1269056
  misc_feature [331]..[331]: allele = t, in linkage disequilibrium with rs1256033, respectively
  misc_feature [331]..[331]: n is a, t, c or g
gtcctcgaccggtggtgtgggacgattaaaaaacataaaaatcatctctgtcccaaagccgtacaatcggtcctaccagagctagaggactggaacactaggcgggcggagccggagggtttcacgaccctaatgtccacactcggtggcgtggaccgggtaagaatacaaaaaatattaaaatttgaacagaacgattgaactaaatattcgattaactggtatagaatcagtacatggacaggggaagtgacatgtttacgtgaccttcgacacaacacgaacgaaaaggtaactatgaaacaaccgaagaagtgtgttactcaacggnagtctcactattcacgacaacaaagagatgacccaatacctcgtgtctccttcctcctgtatccctcttcctggagtagtgaagtagaccaggtctactgtcgtaccgaataaaaaactcgaataggaaatgaaaaacaagagaaaggataaccacaagtaaattgtttataaataactcgtaacatggtccgagatgcctacgtcaccacttgttctgttatctaatatctaaggtactcccgttcctaaaaacaggtaaaacaagtgatcaccgtgaatggttaaggaacttatactaaaaagttttaattaacccgaatatgtgtct

SEQ ID NO: 1818 - DNA, 661 bp, Homo sapiens
  ESR2
  misc_feature [331]..[331]: Chromosome 14, SNP identification no. = rs960069
  misc_feature [331]..[331]: allele = c, in linkage disequilibrium with rs1256033, respectively
  misc_feature [331]..[331]: n is a, t, c or g
gttgtgggatacaaaggtagactttcgagggaaggaaaaagatagtttcggggttacgaaacaagaaacggtcaattcttttcgttgcaactctcttaagtatcacacatttaccgtttatcgttaaatgatttaattgagtgggtaactattgagattctcctacaaaatggaattcgtctctttatgactatcttaggtcctataccactcctcactttacaaccatcagtggaaggatggacaggggactttaagtgggacatacttaccgtcggagaaacaggacctaaaatattaatgatcgagacgctgaagtggaggatcgganaaaggaggagacactttacctctatgagtatccctaaaagatttctactttattccaactaatatacttttgtataagtcacgagtttataaaataaacactgttagaattgtcatctaatattccggttcaggtaaaggaccgatatactattcttgttataactaaaagactttaagacttgacttaagaactatgctactgataaaacatagaacgactcaaagatcctaaaatggggaattcttgcaaacctggataatgatgattggtatagaaaatttttctctaggaagaaaaaaaaaaaacgaaaacccctttgtaaccaga

SEQ ID NO: 1819 - DNA, 661 bp, Homo sapiens
  ESR2
  misc_feature [331]..[331]: Chromosome 14, SNP identification no. = rs960070
  misc_feature [331]..[331]: allele = g, in linkage disequilibrium with rs1256033, respectively
  misc_feature [331]..[331]: n is a, t, c or g
tatcatatagccaggaaatggacttggccttataatctactgttaagattgtcacaaataaaatatttgagcactgaatatgttttcatataatcaaccttatttcatctttagaaaatccctatgagtatctccatttcacagaggaggaaacaggctaggaggtgaagtcgcagagctagtaattataaaatccaggacaaagaggctgccattcatacagggtgaatttcaggggacaggtaggaaggtgactaccaacatttcactcctcaccatatcctggattctatcagtatttctctgcttaaggtaaaacatcctcttaganttatcaatgggtgagttaatttagtaaattgctatttgccatttacacactatgaattctctcaacgttgcttttcttaactggcaaagaacaaagcattggggctttgatagaaaaaggaagggagctttcagatggaaacatagggtgttgcctgggagggagcagttgagggacaggttatggggcaaatagagaaaacaagagtaagcaagaaagtgacttcagcaaatcagggctggtacgagagaaggagtgtagcaaagacacatgcagggagatgagctgaccagccttgaaatcaggggtgcacaacttgaagtttataaa

SEQ ID NO: 1820 - DNA, 661 bp, Homo sapiens
  ESR2
  misc_feature [331]..[331]: Chromosome 14, SNP identification no. = rs1256033
  misc_feature [331]..[331]: allele = t, c
  misc_feature [331]..[331]: n is a, t, c or g
cgtccgaagtctctcttatctaacatttataaagaatccccagaatttcccagacaagatagtcactaaggttttcccctccctcccatattacttggtacagacagagggaacaaggtagtaccggatttgaataaaaagtccaattgaaacattacgggaaccggttctcctccctgggtaagtctaccaactccccggaatcttaaaataaaaaaccaaatatttgaagttcaacacgtggggactaaagttccgaccagtcgagtagagggacgtacacagaaacgatgtgaggaagagagcatggtcgggactaaacgacttcagngaaagaacgaatgagaacaaaagagataaacggggtattggacagggagttgacgagggagggtccgttgtgggatacaaaggtagactttcgagggaaggaaaaagatagtttcggggttacgaaacaagaaacggtcaattcttttcgttgcaactctcttaagtatcacacatttaccgtttatcgttaaatgatttaattgagtgggtaactattgagattctcctacaaaatggaattcgtctctttatgactatcttaggtcctataccactcctcactttacaaccatcagtggaaggatggacaggggactttaagtgggac

SEQ ID NO: 1821 - DNA, 661 bp, Homo sapiens
  ESR2
  misc_feature [331]..[331]: Chromosome 14, SNP identification no. = rs1256031
  misc_feature [331]..[331]: allele = g, in linkage disequilibrium with rs1256033, respectively
  misc_feature [331]..[331]: n is a, t, c or g
cttggggttctaatatgtcggttgagcttacccagaatggggagcaagtgggtgtacccacaacctatcttctgtagctcaatgttggaacacttctacagagaaccttttttacacgagtgttcctcaacgtttctaacaaagaaagaaaatgaatttaaattatatatcgtacgaattgtcagtactaccacccgaccgaggactccttctttcttatttgtgtaaaaaacctttaccagtctttagtccttaagtcgatgtcacctgaaactcttaactagatctgtgtaaagaaggggatccgatcctcccagagtcaagtgttagnggaacaaaagacccgacacaaatctaataaagggattgaaagagatttgcggaagacctaaaaaaaaaaatttagttgaacaactacttttcttagtttgagacattttataaacttctctaaataagactcggtttatactcactgtttaccggacactgtatcgggagtcctctagactcttgtacacgggttccaccagtccggtgttgaaccagaatatgtaaaatccctctgtattccgtaattagttacgtacattctacatgtaactaagtcggacttttccgtcctgtggactttcgtccccgaaggttcagtgtccgtcaa

SEQ ID NO: 1822 - DNA, 661 bp, Homo sapiens
  ESR2
  misc_feature [331]..[331]: Chromosome 14, SNP identification no. = rs1256030
  misc_feature [331]..[331]: allele = a, in linkage disequilibrium with rs1256033, respectively
  misc_feature [331]..[331]: n is a, t, c or g
ggtggaaccgaggggttacacgatcctaatgtccgtacttggtaacgcgggttggactttcaataaaatttagatctggaaatagactttaacgtctcacactctacaaacaagaggtaaatttacccttgaagtttacagacttcccgacgaatcgttacgacaacccttactgactacaaaccttcaccaacttacggaagtgtgggtaggtacgtcgtaagcacttgagatcattgatgtcttctggttacgtataggacggacaccaagtctggacacccattctaaactagaccggtgaggaaagtaatgtgaatctctacatcgngggtggggtaccgatactgaccagaagccgtcactgtttacgagtagtcgtagtgcacctacccgtatttgagtggatgggtgaaagtttgtaatcagtaaggggtgtcgcaccgagaaacatctatactatagtcatagttttcgaaacgacatagtctaaaggcccttatataaatggtccttgggacctcctttttctctaatttaatccgttacaagtacgataaaaaaaaaggatctttcgggaaggaaagggaaaatacgagacaagttacctataaaagaaacgagggatctctctgtgacttttccttccaatcacccttgg

SEQ ID NO: 1823 - DNA, 661 bp, Homo sapiens
  ESR2
  misc_feature [331]..[331]: Chromosome 14, SNP identification no. = rs3783736
  misc_feature [331]..[331]: allele = g, in linkage disequilibrium with rs1256033, respectively
  misc_feature [331]..[331]: n is a, t, c or g
ggtcgatgagccctacgactccgtcttcttagcgaacttggaccttccacctccaacgtcactcggctctaacgcggtgacgtgaggtcggacccactgtcacgctctgaggcagagtttttttttttttttttcattacgctattactctcgaatgaagttctaccgtcgttttctgtcaccttttttccgtaaccctttttttcggttacacggaactactcatttcaattgactcagttcccctcttcagtttccattgatactacccgaaaaagataattgtgtttatcctttactcaccaaaaccctttctttcactacttaatgnggagtctataacataattaacagataatgacaccggcccgtaccatcgagtacggacattagggtcgtgaaaccctccggctttgtccgtctagtgaactccagtcctcaagctctggtcggaccggttgtgccactttgggacagagatgatttttatgtttttaatcacaccaccacatacggacattagggtcgatgagtcctccgactctgtactattaacgaacttggaccctccgtctctaacgtcactcgactataccgcggtaacgtgaggtcggatccgttgttctcactttgaggtagagtttttttttctaaacggaca

SEQ ID NO: 1824 - DNA, 661 bp, Homo sapiens
  ESR2
  misc_feature [331]..[331]: Chromosome 14, SNP identification no. = rs6573553
  misc_feature [331]..[331]: allele = g, in linkage disequilibrium with rs1256033, respectively
  misc_feature [331]..[331]: n is a, t, c or g
aatgacaaatgccaggatacacctagccaatcaatcaggtgcatggcaactttgcttagaaaatacagatctcacatctcaacatatcaccaatcaacttctgtagaatttccacatatccccagaaggatgataattaaagttagagaactgacttctggagagtcattaaaaggctaggtgctttttgtttggatatatttcagatatatcagattcacatgattcacagattaactctttgtcagtggcatcttgaatagttaggtacttggtagccaatgcaaagagtttttcttcctaagcagagccataataaggggaagaaatnatgaacttacaccattgtaatagttctctgagacaggagaacaggtagcaaaaaaagacctcctttctaccagaggtctgtaaaaataagtcaacaaacccattctggttgagaagccctcctctaaaacagagatataaactggtcaaaggaaagactccccaaaagatttaatttctttaacattgtagggcagagttttcccaacacatcgattgaatgttcaaacatggcctcagtacaatgttctggtacaacaggaaaaaattgtctctaaagagtttaattgttgggcctggcatggaatttcacctggccaaccaaagaacc

SEQ ID NO: 1825 - DNA, 661 bp, Homo sapiens
  ESR2
  misc_feature [331]..[331]: Chromosome 14, SNP identification no. = rs1271572
  misc_feature [331]..[331]: allele = a, in linkage disequilibrium with rs1256033, respectively
  misc_feature [331]..[331]: n is a, t, c or g
gagtcgaaattacttttaacctgaatcccaccccgtcacctctgaaaagtgtcgataacaaatcgactacttcgtctacgaagaggtagaaacctcggacagaagtaatggacacctggagtagaaatagttgggtctcgtgtgaacgcagagagataaaaccgatttgtggtttgtcgactccgaccatgacattttgaaagggaggtttacgggggggagcagaaggagataatctctagacctagtgttgggagtttttggtacagggaatacggtggactcatctaccaaactactaattaatccgtgtctacactgtgaccccccnagagtgttaccggacacccagtgtacgatgaaaggaaaagtaaaagtagtcgttgtcgacggaatttcggtcaattctgacaccaggatcagagcgtgggaccccgaggacgaccccacccactccccttgtggggtaattcgacccccttgaccccgacggtggtcccccgcgctccccggaagcgggctcttctccccacccgtccacggaggtcgcctcttcccgcggcaccggcctccgtgtccagaggggccacggtgaagttcactcaagctccttcatggaccctagaaactagattgcgctttccggaagggtcactggaga

SEQ ID NO: 1826 - DNA, 661 bp, Homo sapiens
  misc_feature [331]..[331]: Chromosome 14, SNP identification no. = rs3020445
  misc_feature [331]..[331]: allele = a, in linkage disequilibrium with rs1256033, respectively
  misc_feature [331]..[331]: n is a, t, c or g
gttttgggacagagatggtttttatgtttttaatcgacccgtaccaccacccatggacattagggtcgatgagccctcgtactccgtcctcttaccgaacttgggtcctccgcctccaacgtcactcgactctagtacgataacgtgaggtcggacccactgttctcgttttgagacagagtttattattattattattaaaaataaaaataatatctaattccccatgtacacgtccaaacaatgtacccgtattacgcactacgactccaaacccaatgcagtggtccattactcgaatcatgggttatccactaaaacgtagggtacnggggagagagggtacagaccatcaggggtcacagataacaagggtggaaatacaaatacacataagttacaaatcgagggtgaatattcactcttgtacaccataaaccgaaagacaagaacacaattagacgaatcctattaccgacggtcaaggtagatacaacgacgtttcctacactagagtaagaaaaattaccgaccattcgtagaagtatatacggacaactggtgacccgaaaagaaaagatgtttaacggaggaagaagggtattaaacctagaatccacgtcttctaacacgattagtttaaagaatttatcacagaaca

SEQ ID NO: 1827 - DNA, 661 bp, Homo sapiens
  misc_feature [331]..[331]: Chromosome 14, SNP identification no. = rs2357479
  misc_feature [331]..[331]: allele = g, in linkage disequilibrium with rs1256033, respectively
  misc_feature [331]..[331]: n is a, t, c or g
tcagactactcaaagtgaagacgatgagaatgaagacctttatgatgatccacttccacttaatgattagtaaatatattttttcttctttatgattttcttaataacattttcttttctctagctttactgtaagaatacagtgtataatacatacaacatacaaaatatgtgttagtcaactgtttatattactggtaagtcttccagtcaacaacaggttattagtagttaagtttgggaggagtcaacaattatacacagattttttttttttttgcatgatggccatatcccctaaccccagattattaaaggattaactgtactntcaactagttttgacaactgaaatattcttttataaatggagccaacacataaattggatcatgtagacccttgctttacatacagattacattaaaaagtggttatagtcgaaggaatttgaagaacacttcctcagtactattttacttcctcagcaatattttacccccaacagacttctataaaatcttctctttttattcttttctactgactactcctcaaccctccttcactcaatgaagatttggggcctcacattcttcttctataccaactcataccataattcaagatttcaggggtcacagtagatgatcgatccaat

SEQ ID NO: 1828 - DNA, 661 bp, Homo sapiens
  LOC441687
  misc_feature [331]..[331]: Chromosome 14, SNP identification no. = rs1256112
  misc_feature [331]..[331]: allele = c, in linkage disequilibrium with rs1256033, respectively
  misc_feature [331]..[331]: n is a, t, c or g
aaaagaactaataaaattattacgaataaataccactttttataaaatgaataccttcataacaattcggacgtcacacaatcagacctcacctacaccataatacgatcacatattattgtagaatttcgtgttaaaaaatgaagttatgacaactaaagacgtttccttttgagtccctgattcgtaagggtctatctgttcgtatcgttcttcaagtttttcgatctctttctgttgtacgttgttttgtttacaataacttataaaccgtcttaaacgtctaacgatgatgcgtttctaacctcctcttttaagtctttgaagtctntgtcgagtcactaaactttaacagtttatttttatacttttgagtcgactgttctcatttacaggaatttcattcatttccttcactccgaaagtctttaagtgatttcgaaaccagaaaatggtaaaatcgtcgtacgaaaagtaacttcgatttttttaattataattttaataaaatgtatgtatgttttcttatatataaattcgtatatcttattttaaccttaagtggtgagtaaaattctttgtttataatggttatgttaactttgggggtatataggtatataggaggaggaacataagattcacaataataatgtttagg

SEQ ID NO: 1829 - DNA, 661 bp, Homo sapiens
  LOC441687
  misc_feature [331]..[331]: Chromosome 14, SNP identification no. = rs1256111
  misc_feature [331]..[331]: allele = c, in linkage disequilibrium with rs1256033, respectively
  misc_feature [331]..[331]: n is a, t, c or g
tcggtactacggtactgaaaggaagagattagaggaccaatccaaagtaacaaacggcttagtgtaaagaaggagaaaaaaccaaaggaaagaataaaatgaccttgtgtaggaggttaccgaaggattctttaccacggaacctctcgctgtaaaaaactccaggaacacacttactgttacagaaaaaaacaaacttagtagtatgagttaactatcgacccaaatctgaaataaaagtgtgtgcctgaagtaacagaagattagagatcccaacaataactccttttatacggtaagactaagaacaaggaattatacaataaagaanattacctaattttgtaaatggtattgaaaaaacattattgtaaaatattgattaaaaaaagagtattattttaattaagtcgacccgtatcaccgagtacaggcattaaggtcgtgaatccctccgactccacccacctatcgaccttgggtccttaaactctagtcggacctgttgtaccgttgtggggtagagatgttttttaaattcttgatcggtccgtaccacgtgtgaacatcagggtcaatgacccctccgaatccaccctcctacccaactcgtgccctccagctccgacgtcacacgacactaacgtggtgacgtgaggtc

SEQ ID NO: 1830 - DNA, 661 bp, Homo sapiens
  LOC441687
  misc_feature [331]..[331]: Chromosome 14, SNP identification no. = rs1256110
  misc_feature [331]..[331]: allele = g, in linkage disequilibrium with rs1256033, respectively
  misc_feature [331]..[331]: n is a, t, c or g
tatcattgaaggtaaaaggatttgttaaaatttgacggaatagagctcaatagatataatctgtacaacaactaaaggacaatatactatctactttaaagtagagagtatggtgaaaggatggacgaggaaagtagaagggttagaccaatataactataaaattcgatttacgtattagtcgtaaatgaaatggcactatgatttacaaatgttttcgtacttcatgatataagaaccatgtaaaagaaagaacataacgtaaaataaaaaggatgtcaattatggaaggaatataaaagtatgcaaattaaaagtcacaagtaaatanttccaaaaaaaggacggatttagacatagtctactaggaaatcagaaatttttagagggtaaaaaagagagggtttcaggaagtaagggaacgaagtcagacctaaaatgagacacccggactcgtgtcggtactacggtactgaaaggaagagattagaggaccaatccaaagtaacaaacggcttagtgtaaagaaggagaaaaaaccaaaggaaagaataaaatgaccttgtgtaggaggttaccgaaggattctttaccacggaacctctcgctgtaaaaaactccaggaacacacttactgttacagaaaaaaacaaacttagta

SEQ ID NO: 1831 - DNA, 661 bp, Homo sapiens
  LOC441687
  misc_feature [331]..[331]: Chromosome 14, SNP identification no. = rs10146204
  misc_feature [331]..[331]: allele = g, in linkage disequilibrium with rs1256033, respectively
  misc_feature [331]..[331]: n is a, t, c or g
ctgaggcaggaggatcactggagccctgaaggttgaggcttcagtgagccataatcatgccactgcactccagcctggacaatagacagagccagaccctgtctcaaaaagaaccactggttctttggaaagataaaatagatgcctcaggcaagcctggttaaaaaggaaagagagaaagtgaaaatacacaatattagaaaggaggaatatacagaatatatagatatgcatacagaatggatacagaatgcaaagataaaaataattctaagagaacattttgcaacttaggggcagtaaattgaaaatctaaaagaaataaaggctntaattccagtactttgggaggcagagatgggcggatcatttgagccacaaggagttcaagaccagcctgagcaacatggaaagaccccatttctacaaaaattagctgggcatagtggtgtgcacctgtggtcccagctactcgggagtctgaggcaagaggagcacttgagccttaggaggttgaggctacagtgaatcgtgatggtaacaccacattccagcctgggaggcagagcaagactgtctcaaaaaaaaaaaaaaaaagacagttctcccatgagctggtccaaactgttccacctttagaatcaaattatttataaaataa

SEQ ID NO: 1832 - DNA, 661 bp, Homo sapiens
  LOC441687
  misc_feature [331]..[331]: Chromosome 14, SNP identification no. = rs1256108
  misc_feature [331]..[331]: allele = a, in linkage disequilibrium with rs1256033, respectively
  misc_feature [331]..[331]: n is a, t, c or g
gagggctctctgtctccaacgtcactcggctctagcgcggtaacgtgaggtcgggccccctggtctcgctcagaaggagagttttttttttttttttttttaactctactaaatttcacatgtcctcctacacttatccaatctatgttcgtgttatggtaaaacatagtttctgaactcataagtatttaaaaccgtagagatcctccaagactgtggtcagagggtccctgcgatccctgcggacatataccgaatctaagtcacacaatcactttggacgatgtgtcatcggacaaatctcaaggggtaaaaatttttatgagacganaaaattttaagtaatatgtcggaataaagagtcatgactgattttacagaataaaaatatatagcttcgaaagataaataaaaaatttggttacatatgtacagtttaggattttagcggacataattagatgaatcattgaattacggtgaggttacacctatatttatcttgaacgtgtatcaaaactttgatgcatctttcgtacctccgacccacgcatccgagtgcggacattagggtcgtgaaaccctccgattccacccgtctagtggacttaagtcctcaagctctggtcggactggttataccgttttggggcagagatgg

SEQ ID NO: 1833 - DNA, 661 bp, Homo sapiens
  LOC441687
  misc_feature [331]..[331]: Chromosome 14, SNP identification no. = rs1256107
  misc_feature [331]..[331]: allele = t, in linkage disequilibrium with rs1256033, respectively
  misc_feature [331]..[331]: n is a, t, c or g
tctcacgtctcggggtcgtacttcggatcgagacggtaaacggtcgacacacacgagaacccgtctgatgaataggagagacacggagtaaaagtaaacacttcatcccctgccacacatcaagggtggagtgtctcaccaacgttcctggtttacccaattatgtactatttacgaatcaaatcacattcaagttatttatagttttatcaccatacaatttctatcacaaatgtactattggattttaattaacggtcaaacaaaattaaatgaccagttcagatagtttactaacttagtcgtacaaattcacctatatagagtaaanacaggtctagtaaaatcatataagtactgaggagtgaaattttaagtttactattatccatgtcaatcaggaggtatagacacctaagttggttcatttttattttttaacgtagtgttgttccgtaccaccgagtgtagacatcagggtcgtgaaaccctccgactccgcccacctggcgaactccggtcctcaaactctggtcggaccggttgtactgtttttgggtagagatgatttttatgtttttagtcgacccaccaccaccgaacgtgaacatcagggtcgatgagccctccgactccctactcttaacgaacttgggtcctc

SEQ ID NO: 1834 - DNA, 661 bp, Homo sapiens
  LOC441687
  misc_feature [331]..[331]: Chromosome 14, SNP identification no. = rs1256101
  misc_feature [331]..[331]: allele = t, in linkage disequilibrium with rs1256033, respectively
  misc_feature [331]..[331]: n is a, t, c or g
tagaaccaaaaccatccaaacccgatagaaatagcgtaagacaaagtagtcgtcccagaaacaccagacatagaacacgactggaggatagagtaggacactgattcttacggattcgaggacccttacgtcggtcatcaagactcggaatgaaatgggtcggggataagttctacctcaacgagaccaagattacggagactgtcttggaggactaacagtgttataatggtcatcgtcgtccgtcgataagtgtgggtttaaagtggaatttttcttaccgaagttttaactggagggggtaccctttataacgtcctgaattgtgtcntaacaaaaagagaagtaaagagatgctaaagaaagaaagaaaaaaaaaggaaaaaaggctccacctcaaagagagaaaaacgggtccgacctcacgtgaccacgttagaaccgagtggtgttggagacagaggacccaagttcgttaagaggacggagtcggagggctcatcgaccctaatgtccgtacgcggtggtgcggtccgattaaaacataaaaatcatctctgccacaaagaggtacaacgttggagtccactgggcgggtggagccggagggtttcacgaccctaatgtccgcactcggtgacgtgggtcggatggtaaagaa

SEQ ID NO: 1835 - DNA, 661 bp, Homo sapiens
  LOC441687
  misc_feature [331]..[331]: Chromosome 14, SNP identification no. = rs1256093
  misc_feature [331]..[331]: allele = t, in linkage disequilibrium with rs1256033, respectively
  misc_feature [331]..[331]: n is a, t, c or g
ttcttaaggttttataaaaaattttcgtcgagacatgtacagctatttaataaacgagtaacattaaaaaacttagacaaacagtttcgtttacatctgcccgagcttgaggactggagtttactaggtgggcggagtcagagggtttacgaccataatgtccgtactcggtgacgagtaccggacaatagtaaaaattaacttttaaaatgactctattaacatctaagtgaacggtaatattctttattaagtctctatagtgaacatatgaatcgggtcacagggggtttccattttaaaacgttttaatatcagattacattgtcgnacttataactgtaattatgttaggtgactcaaataagtctaaaggggtcaaaatgaacataagttaacacacaaacacataattcaagctatattgatcagttatatgacttgtcaagattgtagtgttcataggaagtccatcgggaaaacataggtgtaggtgaaggaagagtaggggttgataactgttggtgattagggaaaaggtaaagattttacactaaagtttttacaatgtatgaaccgacccccgccaccgagtacggacattagggtcgtgaaacctatatgccagagatgatttttatgtttttaatcgaccctcacc

SEQ ID NO: 1836 - DNA, 101224 bp, Homo sapiens
  ESR2 gene - 63769608 - 63830831 of chr14; NCBI Entrez Gene ID: 2100; Build 35; sequence includes 20,000 bases upstream of initiation codon and 20,000 bases downstream of termination codon of the gene
tggtgctttagctgtgtccctcaagtgttgatatgttttattttcattttcattcagttccatgtatttttaaaatttcccttgacctatgttttatttaggagtacttgtttcatttccatgtgattggagattttcctgttatctgttattggtttctagtttgattccactgtggtcagaaatcacattctatacgatttcaattcttgtaaatattttgatgtttgttttaatgctcaggatatggtctatcttactatttcttgcatagaccctcaaaaggttgtgtagcctgctcttgtagggtggagtattctacaaatgtcaattggattttgttgatgctggtgtggttgagtttttctatgttcgtgctgattatctatctcattctatcaactgagagaggagctgaatcctccaacaatagtggatttttctctttcttctttctttctttctttcttttttttttttttgagacagagtctccctgtgttgccctggctggagtgaagtggcgagatctccactcactgcaagctccacctcctgggttcatgccattctcctacctcagcctcccgagtagctgggactacaggcacccgccaccacgcctggctaattttttttgtatttttggtagaggtggggtgccaggatggtctcgatctcctgaccttgtgatccacccgcctcagccttccaaagtgttgggattacaggcgtgagccaccgcgcctggcctcttctttcttttttcttttctttctttctttctctttctctctctctttccttttcttttctttttttttttttttgacagagcctcactgttgccccaggctggagtgcagtggcctgatctcggctcactggaacctccgcctcccaggttcaagtgattctcttgcctcagcctccagagtagctgagactacaggtgtgcaccaccacatctggctgatttttgtattttttattagagatggggttttgccatgttggccaggctgctttcaatctcctgacctcaggtgatacacccgccttggcctcccaaaatgctgggattataggcatgagctatcatgcctgaccttttttctttcatttctatcagtttttgcttcacatatcttataactttgttgtttgggggcatttaagattactgtgtcttcttggttgattgatccttttgttattatataatgtccctccctgtgtctggtaattttatttgctctgaagtctactttgtttgacactttcctttaatatttgcataacatattttttccatcctcttactgtcaaattccttatatttttatttgaagagtttcttatagataccatatagttaaacatcttttaaatcccctctgctaactctgtcttttaactggggtatttatttttatttatttttttctttttgtgatggagtctcactctgttccccaggctgtagtgtagtgatgctcacttggctcactgcaacctctgcctcccgggttcaagtgattctcctgccttggcctcccaagtagctggaattgcagatgtgcaccaccatgcctggataatttttttgtatttttagtagagactggccaggctggtcttgaacttttgactgtatgggaacagacacacaactctcccaaataagcacaacaaagagacacagaagcagtccaagcctctgataaactctcccatcctgaatccttaaaaatgcttagtctgtaagaggatgtgcctctgacctaactcagccagacgcccctctcaggtttgttttttctaaaataaacctgtcttgactggcaagccacctttcttttctctcctctttctttaattcctacactgacttcaagtgatctgcttgcttcggcctcccaaagtgctgggattacaggtgtgagacactgcgcccggcctaactggtgtatctagaccatttacatttaatgtaattattgctatattagggcttaagtcttccttttcattttgttttctctgttttttaaatttctgttttctttttcctaatttcatgcttgttcctgaaacattttttagaattccattttgaattatttatagtttttgatgataaacatatatatttggtatagcttttttagtggttgctccaggtattacattttgtatatatgacttaatacagtgtattgatgtcattttaccagtttgagtaaagtatagaactcttagcttccattatgtctctacttttccctgtttatataattatcttagctatttcctcttcatacatttagaaccacatcatacagtgttatagtttttgctttaaccatcaaacatattttagaaaactcaagagaaggaaagcctattgtatttacccacagttttgctcattatattttctgtctcctgatgttccaagattccttcatttttaaaaatcattttctttctgtttggagaacttcattatttagtaagtctttttgtttttgtttttgtttttttttagagatggggtattgctgtcacctaggctggagtgcagtagtgtgatcatagctcactgcagccttgaactcttgagctcaagcaatccccctgctcagcctaccaaatagctggtactacaggcatgcaccaccatgcctggctaattttttttttttttttttttctgagatggagtctccctctgtcacccaggctggagtgcaatggcgtgatctcagctcactgcaacctctgcctcccaggttcaagcaattattctctcatctctgcctcctgagtagctgggactacaggcacacaccaccacacctggctcatttttgtatttttagtagagacagggtatcaccatgttggccaggctggtctcaaactcctgacctctagtgatccgcctgcctcagcctcccaaagtgctgggattacaggcgtgaaccaccatccccagtgtgttgtaggcttttaaaatgtaaagcaaaattgttctaccagcagtgaatcaaacagtaggttttgaaacgtcaagaagcccaaacacaaatttaagttagagttttgtaaagtaatataagttctcctttaaatgcattttaaaatattaataattttctttagtattgcttaaccccctgtaagtcactagggctccataattattttggaaccaactcctaagttaatattctttcactgtaatttcagcatccttaaatcttctaagcacagctataagttgaaatgattttagagaactgtgagtaaaaatctaatatgataaaatggctccattttgcggggaaggatgtactggtaattgacagaaaatgaccaggaacatggaaataggagtaggtcagacagattgaattgttaagtattttgaatatactataaatgagatataaatgatattttgaaatcaatatgcaatttttgttgtatctaataaggacttttaaggatacagtcaagaaggagagatgcaatattactgtgtttagccttactaaagcaaaggaaagtactgtacgtaaaagttctctggcgcggtggctcatgcctgtaatcccagcactttgggaggccgaggcgggcagatcacgaggtcaggagttccagaccagcctggccaacataatgaaacctcgtctctactaaaaatacaaaaattagttgggcgtggtggtgtgcacctgtaattccagctgcttgggaggcagaggcaggagaattgcttgaaaccggaaggcagaggttgcagtgagccaagatcgtactactgcactccagcctgggcaacaagagagaaactccgtctaaaaaaaaaaaaaaaagttctccggcattttttgaaaaaggcaaactgcactcataaaattttacctttggaacagaatctttatagttacataatcaatggaaagaacagatttgatgacaatattgagcttatgaattaatcaaatttgaagctgctctacacccagaattattattattattattattattattattattttttgagacgacgtcttactttgtctcactttgtcgcccaggctggaatgcagtggcgcgatcttggctcactgcaacctccgcctcccagattcaagcgattctcctgcctcagccttccgagtagctgggattacaggcacctgccagcgtgctcggctaagttttgtatttttagtagagacgagctttcttttttttaagacggagtctcgctctgtcgcccaggctgcagtacagtggcgtgatctcggctcactgcaaactctgcttcccgggttcacgccattctcctgtctcagcctcccgagtagctgggactacaggcgcccgccaccatgcccggctaattttttgtatttttattagagacggcgttttgccgtgttagccaggatggtctcgatctcctgaccttgtgatccgcccgcctcagcctcccaaagtgctgggattacaggcgtgagccaccgcgcctggccagagacgagctttcaccatgttagtcaagctgtcctcgaactcctggcctcaagccatccacccacctcggcctctcaaagtgctgggattacaggtgtgagctaccatgcccagtttatacccagtcttgttaagtgagatgttacatctccctctgtttagttcacttgacgcaagattctctatttttttttttgagatggagtttcactcttgttgcccagggttgtagtggcacaatcttggctcattgcaacctctgcctcccaggttcgagcaattctcctgcctcagcctccagagtagctgggattacaggcgcctgccaccaatacaatacttttttgtatttttagtagagatagggtttcactatgttggccaggctggtctcaaactcctgatctcaggtgatccacccacctcggcctcccaaagtgttgagattataggcataagccactgcacccggcctaagattctctattacttgagaataaaacaacctgttaaaatattataccacagtgtgcttggcctatgtaacatctgcttagataacatactctcttaagcagtaaatgagtatgagttacaggggctctccttttgttctttagggactctagaaatgccagataattccacttttgtggtgacagaagaatctggcaataatagctaccgtttactgaacaacaactgcacattaagcactgtgtcatatgctttaggtatgttatttgatcctcaccaaatgcctaggtattattcctcttttcttttcttttcattttcttttctttcttttctcttttcttttttattttctttctttttaacaaagaaagaaactgagggggctgggtgtggtggctcaggtgtgtagtcccagcattttgggaagctgaggttggaggatcacttaaggtcaagaatttgaggttacaatgagctatgctagcaccactgcactccagcctgggtgacaggtgagactctgtctctaaaaaataaataaatttacatctgttcaaaagataaatgaccttttaaacaaacaacatgtagtataaagtttatgacatacaatcataaaaaataattaataaaaaaaacagccaatgtgacctgatatttatagaacactcttaacaatagcagaatacacatttttaaaagtacctgtagaacatttatcaaaataggccatactatttttctcaataaatttaaaattatttctgtcataaaatatactttctggccacaatataattaaattagaaatcaataaaaaggatatctagaaaatctccaaatgtttggaaaataaaacttctatatcacacattagtttcaaaaaaagaaattggaaagtgttttgaactgtctgaaaattaaaacacaagataataaaacttgtgagatacaataaaatagtgctagagggagtcttgtagcactaaatgcctatattagaaaataggggcccggcgcggtgtctcatgcctataatcctagcactttgggaggccgaggcaggtgatggcttgagctcaggagttcaagaccaacctgggcaacatggtgagaccgcctctctacaaaaaatacaaaaattagctgggcagggtgtcatgcacttgtggtctccgctcctcaggaggctgaggtgggagggtggcttgagcctgggaggttgaggctgcactgaggcatgttcatgccactgcactccagtctgtgtgacaaagcaagaccccgtctcaacaacaacaacaaaaacaacaaacaaacaaacaaaaaacgaaattagaaaaagagtaagttaaacacagaataaaatgaagacaggaaataattaagattggagcagaaacttatgaaatagaaaacaaaaatagcaggaaatcaataaagcctaaagctggttctttgagaagatcaataaaattaataaatccctaggccgggcatggtggctcacgcctgtaatcccagcatttttggaggccgaggcgggtggatcacgaggtcagaaggtgagaccaacctggctaacacagtgtaacccagtctctaccaaaaatacaaaaaaattagccgggcgtggtggtgggcgcctgtagtcccacctactcaggaggctgaggcaggagaatggcgtgaacccaggaggcggagattgcagtgagctgagatcgtgccactgcactccagcctgggcgacagaatgagactctgtctcaaaaataaacaaaacaaaacaaaacaaaaaacaggttaaaagaccggtgtggtggctcatgcctgtaattccagcactttggaaggctgaggtgggcggatcacgaggtcaggagttcgagaccaccctgaccaacatagtgaaaccccatctctactaaaaatacaaaaaaaattagctgggcatggtggcacatgcctgtaatcccaggtactcaggaggctgaggcaggaggatcacttgaacccaggaggcagaggttgcagtgagccgagatcgtgccactgcactccagcctgggtgacagagcaagactctgtcttaaaataaataaataaataaataaataaattaaattaaattaataaacctctagccagactgaacagaaaaaaagtgaaaggaaacacaaattgcaaatatcaggaatgaaggagataacctacagattctacagctattaaaataataattagagaatattatgaaaaactttttaacaaaaaattcaacatatataaaatggacaaaccccttgaaaaaaaccaaattaccaaaaattgtacaagaagagctgacctgagtagtcctatatctattttttaaaattgaatttgtagtttaaaaccttcctacaaggaaaactccaagcccagatggcttcagtggtgaattataccaaatgattaaggagaaataacagcagttctctaccacctctttcagaaaatggaagccaatggaatacttcccaattcatcctaggataacagcattaccctgataccaaaacctgacaaagacattcttagaaaactacagatcagtagtcttcaggaacacaggtgcaaaaattctcaaggaaattttagcaaatctaacctaacaatatgtaaaaaggacaatgcattaagaccaaccggagtttatttcaggcatataagtcttcatttcaaagcccaatcaatataattcactacattaacataaaattaaaccatatgattaccccaacagatccaccaaaagtgtttgacaaaatctaacatccgttcctaataaaaactcagcaaactaggtataggggccctttgtttgtctttttctggtttccaagtccttgaaacaaaatccaactatgtccaaatgccatgaaggtttgtgttgctgctgatgtcagagataaacattacttttaaggacaggacggagtggagtagcagaagcatttagatgagaaaaaagacaaattaacttgtttaattcttcttaagagccaaaatgcaggtgtttcttgcacaatgtagtattctttttctttttactttctttttttttttctttttttttgagatggagtttcgctcttgtcacccaggctggagtgcaatggcggatctcagctcacttctgcctcccgggttcaagtgattctcctacctcagcctcccgagtagctggtattacaggcatgcgccaccatgcccagctaatttttgtatttttactagggacggggtttcaccatgttggtcaggatgatctcaatctcttgaccttgtgatccgcctgcctcggcctcccaaagtgctgggattacaggcgtgagccaccgtgcccggcctatttttctgtagtcccattttcttgcttcagagttattcaggagttagcacggtactacaattgctatgcacagaagctgaggaacatttggtagtgttaaatacctaacattgacttaaatctgtacataggtagttctagatatactatgcttctttactgcatcaaccagatggacattaaatggtagaattatgactaatttgtataaagcattttatatagtatatatattttatttatttatttatttattgagacagagtctcgctgtgttgcccaggctggagtgcagtggtgcgatcttggctcactgcaagctccgctgccctggttcacaccattctcctgcctcagcctcccaagtagctgagactacaggtgtccgctaccacgcccgcctaatttttttgtatttttagtagagatggggtttcactgtgttagccaggatggtctcgatctcctgacctcgtgatccgcccgccttggcctcccaaagtgctgggattacaggcgtgagccactgcgcccggcctagtataataatttttaaaattagctttaaatatttttgagttaaaatcttgatattttaaaatgttgcctattaattaattttttttttttttttttgagacggagtctcgctctgtcgcccaggctggagtgcagtggcacgatctcggctcagtgcaagctctgcctcctgggttcacgccattctcctgcctcagcctccagagtagctgggactacaggcgcccgccaccacgcccggctaatttttttgtatttttagtagagacggggtttcaccgtgttagccaggttggtctcgatctcctgaccttgtgatccacccacctcagcctcccaaagagctgggattacaggcgtgagccaccacgcctggccgcctattaatttttataagcagtttgcttttaatattttagaagaaaatagctctttgaatacatttaaaaccagttttaactttttaaattttaatactttatttatttatttattgtttgtttgtttgtttgacagaatgtctcgctctgttgcccaggctagagtgcagtggaacaatcacagctcactgcagcctcaaactcctgggctcaagccatcctcccacctcagcctcccaagtagctaggactagaggcatgagtcaccacacccagctaatttttaaaagattttttttttgcagagacatggtctcactatgttgcccaggctgatctcaaactcctgacttcaagtgatcctcctgcttcagcctcccaaagcgttggaggttacaggcatcagctactatgcgcaggttttaatttacttttgaataagtatgtgaaattaaataattcaaacttaaagctgttggaactttattctgagccttgagaggtgtgtggctgtgcagcctgagtcacatggcatgcagctgcaacttttgccttgtttttcctttagataattaagaacaaacagcaccaaagacccccacagatcattacccctccttatagagtaataaagtattctttcttggaatttagcaatctgtaaccaatcaaattgctgtggcatatgcactagtcttgtatgaaaagagtcttgctctgtcgcccaggctgcagggcagtggcagtcatagctcactgcagcctcgaacctgccgggctcaggtgatcctcccacctcagccctctgagtagctaggactacaggcatgcaccactgtgcccagctaaatgtattttttgtagagatggagttttgccatgttgctcagcctgtttttgaactgggctcaagcaatcctcccatctcagccttccaaagtgctgggattacaggcgtgagccaccatgcccggccaaaaccaactaatattaacagtattttgtgtgtctctctaaatatatcctatgtgaatgtatgtatgtattctttcttttgcctttataaacaaatgatagtatatttttcataacgttctgcactctgattttcttctcaatgtatcttggcagtctttctcagtatatagtgacttttctcatttttttatctttatacctcaatatctggcacatagtaagcaaatcataaatgctgagtgaatgaaatattaaatgaataaaaaggaaatttttgtgctgctattggaaattagctctctatatatttcaacatgttacacatatacaatgatctaaaaacttgtcttactctttcctatccactagagggagacatcaacctgttgtggaaaagaatgatcacttaaagtctttagaaattctgaaccaactctctagcaggtgatccttgttagaatttgagcccttaacgctatccaggactggaggttgaagggacgatagagggagcaggaggagaatgcacatggattaaggagcgagaacacaggtgaacttcagcttttttgctaacagtcagacaaactactgaccctgactcagtgatgtgctagtaaaccagctctttaaaaaaaaaaaaaaagccctagattgctgatttgtatgtaatgtttatgaatttcagtagagaaaaagacaatattcaaactgagccatgcacccaaaacaagagaacagccaagaagtgttcacttctatcagtgccctgggttgtttgaaaaaagaagccgacctgagcacctgtgagctcccttctggcgaggagaaatctggagtgtagttattccaccatggccaaattcaagccactcggggtttaatcaccgaattgcaaattccttgaacatttaacagtaggctctcttggctgggcgcggtggctcatgcctgtaatcccagcaatttgggaggccatggcaggaggattacctgaggtcgggagttggagaccagcctggccaacatagtgaaaccccatttctactaaaaatacaaaaaattagctgggcgtggtggcaggtgcctgtggtcccagctactcgggaggctgaggcaggagaatcgcttgaacccaggaggcggaggttgcagtgagccgagattgtgccactgcactccagcctgggcgacaacagtgaaactccatctcaaaaaaacaaaacaacaataacaacaacagtaggctctcttgagccagcctgagcaggctcttgcatgctgctgaagcttgtcgggtcttagttacttttcctgtaaagtggggatgataaatctgctcattatgtagattctattacatagaggacacataagttctttgaatgcttaaagcaatgtttcctaaacttctttggtcatgaaatcacccagtggcttgtgtaaaataaacattcccaggacctgccctagagcacctgggttagaacattttgggggagggggctgggaatctgtattttaaataagcaacccaggtgaggccgggcgcggtgcctcacacctgtaatcccagcactttgggaggccgaggcgggtggatcacgagatcaagagattgagaccatcctggctaacacggtgaaattccatctctactaaaaatacaaaaaaattagccgggcatggtggcaggagcctgtagtcccagctatttgggaggccgaggcaggagaatggcatgaacccgggagacagagcttgcagtgagccgagattgcgccactgcactccagcctgggcgacagagcgagactgtctcaaaaaataaataaataaataaataaataaataaataaataaataaaaataaaaaataaaaaagtgacccaggtgactcttatgaccctgtgaaatgggagaaacactgctgcaaattactcttataattgggtcaggtgtcaggggtctttctctaacttcacaattgggcctgcttgaagagatgtgtgcagagttccacaacacactccaggcaggcatttaatccgttcactgtcttctctaccctcagagcccaaacttcccaaagaggaaaacctgctccttgccatctcttaggccaaggcttctgtacacctgggaagtccttcaatctgaggatctctgggttgttttcaagctactatttattgagaatttacaaagtgtcaggcacgttacagcaatttgtcatttctatgaaatagcttcttgtgctattcccattttacagagaaaaatcaaagaagttgggaaaatgtcgaagggcacacaactaggaagtgtttgtgctgaaaacccaccctaggcccaagccttggaactccaagcctgggttccatccctgcactgggcaattctgatctatgtgcgctagtttccttgtgttctctgttctctccgtagaaatcctgggctctcttctcccagccacaaggttaggttgaaaaacagagcagatggaggtagtttgtagcctacaggtgccctgaatgaagcttccacagtgctaaagtggaagaacgagggactccaagggaaggattcaaggctgggcccatgcacctgtgtaattcagaagagaccccagaggagatcagcgccctctaattagccctggtaaggagctctgggagttactgtaactctctcagaagaacccaaacatgcgggaacgtgacttcttaccttctgaaagtccacaaaattcctgattgccaccattaatttgtcacttatcatttgcaacaggcattgtaggttgtcttatgcatttgtcttctcccttcagctagtgtataaagtcttagggagaccagcagttcagagagaatgggctttggtgtgaaacagatctggtttgaaccctctgctacttactagctgttgggcaagttccttaaattctctgagtcttaatcttctcatctgtaaaatggagacataaggagtacccacctcattggattgttttaaggataaaattaaatagtgcaggcaaaggatttacaagcaactgctgaatgaatggtagttatagcctcctcctcatcatctgtgagcaaacaccctcatatttccttgtgtctcaggtagacacttaaggtattgcaagcattaagggagcattgtcacaaagagataaatgcatgagggcaagatgcagtctcaaagaagagtgttttatgaaagaataaatgtaatgctgagtgtcagaaaaaaatttttttttttaaagatgaggtatctatcacccaggctgaagtgcagtggtgtgatcttagctcactgaagcctcaacctcccaggctcaagtgatcctccagcctcagcctcccgagtagctgggactacaggtgccaccacacctggttaattgttgtattttttgtagagatgggttttcgccatgttgtccaggctggtcttgaactcctgggctcgagcgatcctctcatcttggcctcccaaagtgctgggattgcaggcatgagccaccacacccagcctgtcagaaaaattttaaggtgaaaataactaaagaagttgttaagaattttctcccttgagtggtattttagactgagatgagggagggtagaggtaggatgagaaggaagggatggggtccggttgaaaggcctgtgagatagtagcagtgcaatatggcagatgttgacagcctcagtgctaggaacacagaaactgaatctcttgcaaggaggcaggtgtgcatctgtatggaagtcagatgacctgtgttcctatgagtgcaaatctggaaaacaccctcaagtttccttgtcagcaaattggtgataaaatcaacattgtagggttggtgtgaacatgcagcatgatgtggccatgcaagttctttgttaactagaagccagtgtcatgccaggacagcagtcctcctagtaagctgtggctggtggcgtggtagaatacgtggagcaggctgaggaagcacttgacttgactatgagcagaaccattaagaagctagttagctaaactgcctggacagtagaaaaataatatgtgagaatgtaaaaggaagagaaacaatgtgaggggagaggagaatgcagagatcctggcccatggaacagcattggtgatccttaagtagctgcatgaactacttggagaagttcattttctgtttataattcccagcaaaggagaggactgaataagagagaagaaaacgattcctttctctggttaggttcatcagatcaaacggtgacatatgtgaaagaagcacgctctgtgcacaaaaaatcaagtctgtatttttataaaagccatttctgggctgggcgcggtggctgacgcctgtaatcccagcactttgggaggcggaggcgggtggatcaggaggccaggagatcgagaccatcctggctaccacggtgaaaccctgtctctactaaaaaaatacaaaaaaattagccgggtgtggtggtgggtgcctgtagtctcagctacttggggggctgaggcggaagattgtgccactgcactctagcctgggcgacagagcgagactccgtctcaaaaaaaaaaaaaaaaaaagctatttctgtaatgagcatcactggagagttagttgctatgggtctaaaggacaatatgaggcagttatagtaactttccatgatatgaacaaagaaattgaaaatgttagatacatttacaagaagatgtagaaaaaactttagtcaaaatttttgaaatattttttgaaatattaaactatgaaatcagacagtcttatctatggtctcaagccatgtctgtctgtaccttttttttttttatctcatttcagggaatattacactggctgacttattaatatcttctgagccagaaaatgtaaggaagctgcattttcagaattgcatttgagtcatttgtgaaattgcatattacaatttgccgccatttctaacagtcctataacttttttttttttttttcttaactgggtgttcacattcatgccaatgacctctaggggctagtttctcttctagctcaagagaattgctgcagagttggaagtaaggacaaaaatgtgtatgcttcatgtttgatttcaaatgcatagaaaattagaaacttaaggtatgcaagggatttgtgtggaatttaagtacctttgaggggcagtggacaggacaaaaagttattttttacctgtttgtttacaaatagcaaagatcaagactgaaacacatgagtgtgatttagaaagagttggctgcaggtgctgcttgctcaggtggttcatttaaactgcaggtcagagcaaccttgtctcatggtcctggtgcccaggtatcaggttgggtctgtcttgctgcttatgtccttgttaccctctgagggccccagtccaacgcagatcaataaagaataagttacataaatatgctcataggtggtcattcctagacaagaaattgacaacatttcattcaacagtatctgggctctacaggacagacatgcctccatttatgcaacaaataagaacagcatctcatgacagtggagaaaacatgggatgtgcaggtaggtaggtaaagttgggtggaaactttcaccctaccaaatgcacatgggtgactttataaaataaatgttagctctctgagcctcagttttcccatctgtaaaatagacagtcccagggaattttcaaggattaaatgaaataaaagtgaatcaacctatgcaagcctgcctactgtggtgtccaggctagaaaaatgctcaataaatattaggtttgtttttatttctacaaaagatgtgatcctaaagagctctatccaaattcaagtttcaaatgtcaaatcacattttgtgaactttatgttcagttgagatgatctctgacatattaattagtaatcctatctttttcattcatcaccaccaaaaaaaggtgttattgcacgttcaattaatctttcccctttattaattccataagtgtagggttttatctctcagattctcttaaaacagaccaatttatacccacataatataaataagcttgttcctataacactctggagcagataactatcccagaacccaaatcctcctacttggcttcaagctcagagaataaagcaacaatccaaaggcaccctttggcatgacacccttctagacatctgtagcattcctcctttccctccacttttcctattagcttttgctttcttgccttttacagggttttgttttgcctcttggtagtttctttcctacggaaaattctccctctgatctttccaagtcaaaggcttcagcaaacatttgttgaacgcgtggattgtgctaggtgggtgttatggaccatggagaatgctagagatgtaagacatgcgctgtccaatcgcagcgcaggttgtgttgacaggtaagatgagggctgtgggggagccaatgtgcacgttccactgggctaatgtgctcttcaccttatttaggctcttggctttgggatgtgtaagactttgctagacagagaaggggtggggtgagaagatgaggaaggtgcaccttttatggagaggctttccttcctcttcacagcaaaccatacctgtactacattgacttcctttgctttcccaggtgacatctagctcatgctgcaagctcatcttgttaatcataaatgctagtaagttaatattacccatcatatataacatgacttaattttaacaattcaatgctttatccccaaaagatgacttaatggtgacaatttcaatccccattgtaggatattttggagacaggcagtcctttcaatgtcatatgtgggtgcttccttaggcaggtcaggggtgaggtggaaatgaggctgggaccctgctcacttatatagcaggcatcgttctcaataccaggcttcagggggctttttggtctagccattggtatgaactgcctcaagaataatcccttcatcattgtggtcacaattcaggtagaattggaataatcatcctctccactctgcattaaaccaggcaaagtttccatctctgggtaccattgtctttcttgatggacagggtgagtcagaaggaaacttactcactcccattcattttctgcttattatttcctgcagtgaggtttccttgtataataaacagcttctgtgggtgtttgagctgctctgaaaagagaacatgctgttcctgtgtgtagaatgccttctgaaggaagcatcacagtgaacacagagcagaagcttggcacacaggtggcagaagtttgtctgcagtgttctgcatagagcagagagtcaagccattttcattctgattgattggaggcatggtatggaggtaaatgggtccttggcctctctcctggattcaagtccttcttagccactgataggtcatgtgaccatagggaggttgtttaaccttcctgaacattcattttctcaagtataaaatgggggtaatagaatttgccttataggcttgcgtataaaataagaattattgagagaaagcggggcataaatgtccaataagcggtagctgtctatgaagccactgttgttactgggttcctttctcactaggtggcttcaggtagctgacagaagctctgtgagcctcaatttcctcactggaaaagtggagtcaatatctcactgagctggtgtgaggattaaatgagatgctgtgcaggtgcttagcacagcgtcaggtatgatgttaatattgatagatgcattttcttcaccctcacctatctttttctgcctgttggcttatggttgaaattccttcatgacggtttccatttccagagatatcttgttaacaagtatataccaccaaatgaagctgatttttttttttttttttttttttgagacagagtctcgctctgtcgcccaggctggaatgcagtggcgcgatcttggctcactgcaacctccgcctcccatgttcaagcgattctcctgcctcagcctcctgagtagctgggattactggcatgtgccaccacgtccagccaatttttgtatttttagtagagacgaggtttcaccatgttggtcaggctggtctcaaactcctgacctcgtgatccacctgcctcggcctcccaaagtgctgagattataggtgtgagccaccatgcctggccatgaagctgatttttttaaaccatcatttaacattttctccataaggtggcaaggaggaagagcatatggggactgggtactttgagagaccccaggacaggagacagggaggctgagattggcatgttgtctgctgcagttatttgccagcgacacactcttcccgtccaaactaacttctctgcctcaaggacagggagactctgcctttcaacctgagagaaaccaggactctcagctttaatgaaaattggacttagggtggggcagtggagacttttcacagctattgtttagctgatgaagcagatgcttctccatctttggagcctgtcttcattacctgtggacctcatctttatcaacccagagcacacttgcgtctctctattttggctaaacaccaaacagctgaggctggtactgtaaaactttccctccaaatgccccccctcgtcttcctctattagagatctggatcacaaccctcaaaaaccatgtcccttatgccacctgagtagatggtttgatgattaattaggcacagatgtgacactggggggttctcacaatggcctgtgggtcacatgctactttccttttcattttcatcagcaacagctgccttaaagccagttaagactgtggtcctagtctcgcaccctggggctcctgctggggtgggtgaggggaacaccccattaagctgggggaactggggctgccaccagggggcgcgaggggccttcgcccgagaagaggggtgggcaggtgcctccagcggagaagggcgccgtggccggaggcacaggtctccccggtgccacttcaagtgagttcgaggaagtacctgggatctttgatctaacgcgaaaggccttcccagtgacctcttgagagctgagaacccactccctccacctctagtccacggctttgccactccagggcccgaggttacgtttgctgctggggatttgacaaacccaaagcctctctggtttcaccactggctccttagaatcagacatctgttctgaatgacacttatgtgagtcaggggctgaggacgtgatcctcgaagtgtggtccccagactggctgtatcagtgtcggcatcccccaggacctggttggaaatgcatattctcaggccctactccagacctcttaaatctgagactggggctgcggggagcgccatctgtgcgccactatccttgtgggtggaccaggagtcggttcgagggtgctcccacttagaggtcacgcgcggcgtcgggcgttcctgagaccgtcgggctccctggctcggtcacgtgggctcaggcactactcccctctaccctcctctcggtctttaaaaggaagaaggggcttatcgttaagtcgcttgtgatcttttcagtttctccagctgctggctttttggacacccactcccccgccaggaggcagttgcaagcgcggaggctgcgagaaataactgcctcttgaaacttgcagggcgaagagcaggcggcgagcgctgggccggggagggaccacccgagctgcgacgggctctggggctgcggggcagggctggcgcccggagcctgagctgcaggaggtgcgctcgctttcctcaacaggtggcggcggggcgcgcgccgggagaccccccctaatgcgggaaaagcacgtgtccgcattttagagaaggcaaggccggtgtgtttatctgcaaggtaagcgccccttcgctcgaggtgtggtttaattgtctcattttgtttgaaatcctgcggtgagaaaccagtcgtgttgagaacaataaaagaccaaaaaacgatcaccaaaaccaactgtcctgaaagctactggaaagttggaaaatgcatgctttgattaaatgtcttcattcaagacactggcaagttaacttatttagtttgtgccgtgagctctgggttgattgtgctaatatgaataactgaaaaacattttatttccctatggttttcctcgatggacttccccactatgggtgaaatgacaatggagttgaatacactttctgattgaactttgagggcctgggaagatgtacacgtctcaggcaagatgataggggttttaaaatgtattaattggcattccttagccatgtcagcaagctgcgttcctcctttcctgggcagaccaagctaagctctaactggtctcctttatttgctgaagaggagtccaacaactgccctctaacaccctgcgtgttattcttattggaaggacaatattaagtcaagtgaatgtcatttttgtgaaaaaactttgagtggacttctatttaggaagataaggttgatttaattttactcgctgtttaaaaagcaggattgtgttttggtgtggtaggcaacattttggaggacagactttgccttattttgttatatttctagtatttacatgggcattccattagaaagttttacttttgctctaagtttcgtaactcggtgtctagtgaggggaaacatgtttgtaatttaaaaagtgaacatgtgaaaggaaaggcttttctgagagtgttgtaaaacaaatgtaacgtgactatgaaaagaacatgattaacatctttgactcctattttttctgaagaaaatgtattttgatatgagttctagaagaaggaaactataaggatctgttcatcaacaggcattagagtatacaccgtaggattgcattttacgttcaagcatttttttagatgaatttctgaaacattcttattttaaaagccatcagatgcttgttaacacttaagtcttgctcaagacatagaagtttctgaaatcaattaacatgtttaggacacatttcgtagtgttctgagggatgtgaataaatctaatcacagtttacatttcttaatgtatttataattcagaaaaggtagaatttagtagtaaattcaactcataaccatataattaacatttaatagatattgatatgttcacttttaagaataagaaggaaattttctataagtgtatgttgaacacataataattcaaaattcatgtgataattttaggtgatgctttgagtcgttttatagaatataaatatggataaaatataaaatactgaaggctgaactcaaagtgtttaatgataagtttttgataatacatctagaaaccttgagaattgtatgcttgaacgttagatttcataattcagtgtctagcacattgttttatatgcaatagcactttaaaaaaattaggctacagcagtataatttacatacagtaaaatttagcctctgtaaatgtacctctatgaattctgacagatgcacagtcatgtaaccagcaccgcacacatgacacagaacagttccattaccccaaaagtcccctttgtacctctacctaccccactgcccctgaaaatcactgatcaaaactacataatgattatgtggttttgctctttagtacgtttttacttagacatattttcctttacttcttttgaaagaaaaacctgtttttccctttttataggatgagtcagtttgtgctatttttaattctagtaccttgggataaatcaaggcaaagacaatgctatttgcaaatgggaaacttgagacttggactaagtgttaaattcatatagggctaatagatttagttcttagcagatttagattctattgtggtttaagcctttggttatggcatatatcattagttatcctgaattgaaatacaaggccattaaaagttatttatatcatattaatagaatgcatcattcttttataatctttgaattttaaaacttctttattaaaaaaaaaactacttttcattatacctgagattaagaaagctacctgaaattgcatattatcaaatagtgagaagcaaaacagggattgaaaatgacaaattgaagacatttaaaatgcagagtgattacaattgctgaaggtaaaatatttatcttcataggggcttaggtctgtgtccaacttatttgtagatgtcaggatttttaaatttctgtgctcatgtcttgaagtctagattttcctgcagggtggagatgtataaccttttgtaaactaatatttttcactgtttaacacagtattcaattcagtatacagttaggagcctgttattggtaggtactgctaacatatatatatataaaattgatgtctttttcctttttcctttgttctatgaaaaacagcctgtattttaaatatgtaacttaccttgcatacccagttacagtggtagtaactaggatatgcagagtggcaagtttatgaggagctagcaaactggatagttggccttcctagctggaattatgacaggtcttgaaaatgaagggcttttagtggagaatctttgtgtgggtgtacttgagagagggcaggagagttagggtgacctagaaagatagattgctggacttgtatatgtttcctcaaagccagactgcagcattttgttagtaaattgttgtgtgttctactgtcaaacccaggcctggaaggggagttgagtgcattcagcctaacttctggattggctgtgtcatcttgaatcccttcactcggaattctctctgaccctgtcccaaatgaatatttgaatttggtccagttcctacagagcatggtctgtggctgttgttggtgttagggaagagcagaaacttgctgttgagagagaagacacttgagaagactgatgaactctctcccacccctgccttcgaggcttggtcctcctaccctattcaaacccttgaaactctttcctatccaactaaataagcgccaattggttactaggagaattagcttttcctcattttagaaggaaacagggtttccttatgtacatgttcttaagaattacatgcaaatcagttattaatgatgagttctctggtgattttggagtgttttatcttcctaatattaaattaattgagggccttaatattttgttttgaaagaatatatttaaaaaggctgggtgtggtggctcacgcctgtaatctcagcactttgggaggcctaggtggctggatcacttgagggcaggagttcaagaccagcctggccaaataatgaaaccttgtctctgttaagaatacaaaaaattagctggccatggtggctcaagcctgtagtcccagctactcaggaggctgaggcatgagaattgcttgaacctgggaggccgagtttacagtgagccgcgatcatgccactgcattccagcctgggcaacaaagcaaaactctatctctaaataaataaataaataaataaataagaatacatttaaagataataattggccaggtgtggtggttcatgcctgtgatcacagcactttgggaggccgaggtgggaggattgcttgaggcaaggagttcaagatcaatctgggcaacacagtgagaccctatctctacaaaaatttaaaaatcagctgggcatgatggtgcatgcctttagtcccagctacttggggggctgagtttggaggatcccttgagcccaggagatcaaggctgcagtaggccatgatcttgccactacactctagcctgagttacagagctagagtataacccccaccccccaaaaaagctaataattgtcaaacagctacttatgcacatcaaggatgcttgttgcttaagaaatctttttaaatcttttccatgaaattccttctagttgctgctttgtgagcgtgaattttttacttctgcaggacacacaaatgtggagcatttgaactgaatgcttgggaaagtgtgatgggcaggtggaagaagaatagggatgaggacttatcctctattcttatcctcctagacttatcctcctagtctgcaagcttgagaatatggcatcaggaatatgtggcattttgtccacacacacagtgttggcaggctaccagcagcccagctatctggactaggggtgatggatttctgtggacagaagtcaaaaagtaaaattaggaggcaaaaatcttcagggtggccataaagacattgtaacttgtctggaaattccaaccaacactaaatgtgtatccagtgatataccaatagactggcttcatcttcttggatgtgtaataataccttacagaatgctttctttttttttttctttttctttttctttattttttttgaaatgaagttttgctcttgttgcccaggctggagtgtaatggcacaatctcagctcactgcaacctccacctcccaggttcaagcgattgtcctgcctcatcctcccgagtagctgggattacaggcatgtgccaccatgcccggctaattttgtatttttagtagagacggggtttctccatgttggttaggctggtctcaaactcccgacctcaggtgatctgcccaccttggcctcccaaagtgctggggttacaggcgtgagccactgcgcccggcctcagaatcctttcacagacatcatctcatttcaccctcagagcaccgtgaaaaggtacagcaccaaataggtacctgattctactgaagaagatgtggcagctcagggagtttgtggatttgtctaagattgcctggctttcaggcagagctggggctagaatgaatgttctgctctatccattgatagaatatacataagaacaggcttgatggtggctgaccttttttttttttttttttttgagacagagttttgctcttgtcacctaggttggagtgcagtggcgtgatctcggctcaccgcaacctccacctcctgggttcaagcgattctcctgcctcagccttctgagtagctgggtttacaggcaagcgctgccacacccggctaattttgtatttttagtagagactgggtttctccatgttggccaggctggtcccgaactcctgatttcaggtgatctgcccaccttggcctctcaaagtgctgggattacaggcatgagccacccgcgcccgggtgactgatttcttattaactagatttacaggtgctttgataaaaaccagtctagtcttggctggcacggtggctcatgcctgtaatcccagcactttgggagcccaaggcgggcgggtcacgaggtcaagagatcaagaccatcctggctaacatggtgaaaccccgtctctactaaaaaatagaaaaaattagctgggcatggtggcgggcacctgtagtcccagctacttgagaggctgaggcaggagaatggctgaacccgggaggtggagcttgcagtgagccaagattgcaccactgcactccagcctgggcaacagagcaagactccatctcaaaaaaaaaaaaaaaaaagtgtagtctttttggagtgtttttctgccatttctagggccaaactttttcttgtccatgaatcattgtcaaaattgggaattttaaatactacttttttcttttaattcaaaagccatagtatgtttcccagccagtacattagaacaccatgcacgatcccatgtgtacaaaaagctttctggctgaattcagatgtgacctgagagggccaaatacaggggtgtgtgctgggagagagagagaggtctctggacagaaaacaaagcctgttcaccacccaggatatggaccaactattttaggttatggtgactaaagaaaattgacatgcaaataaatgaataattcttagaatcaggatgtctgggtactggttctttggttggccaggtgaaattccatgccaggcccaacaattaaactctttagagacaattttttcctgttgtaccagaacattgtactgaggccatgtttgaacattcaatcgatgtgttgggaaaactctgccctacaatgttaaagaaattaaatcttttggggagtctttcctttgaccagtttatatctctgttttagaggagggcttctcaaccagaatgggtttgttgacttatttttacagacctctggtagaaaggaggtctttttttgctacctgttctcctgtctcagagaactattacaatggtgtaagttcatcatttcttccccttattatggctctgcttaggaagaaaaactctttgcattggctaccaagtacctaactattcaagatgccactgacaaagagttaatctgtgaatcatgtgaatctgatatatctgaaatatatccaaacaaaaagcacctagccttttaatgactctccagaagtcagttctctaactttaattatcatccttctggggatatgtggaaattctacagaagttgattggtgatatgttgagatgtgagatctgtattttctaagcaaagttgccatgcacctgattgattggctaggtgtatcctggcatttgtcatttgttggtggggtctgatagttggtttcaccactgctgggtacccagagtcatcacatccatagagacagaatgtaggctggtggttgccaggggctgggggaagggaggagtggggaatttgtttaacagagagttttagttttgcaagatgaaatgagttctagagattggttgcacaataatgtgaatatccttaacactactgaactttatacttagaaatggctaagatggtaagttttatgttacatgtattttaacacaattaaaaaagaaaaaaaaaaaaacaacttcaggccaggcacggtgactcacacctgtaatcccagcactttgggaggctaaggcgggcagatcacttgaggtcaggagttcaagaccagcctggccaacatggtgaaaccccatctctactaaaaatacaaaaattagcctggcctaattgtgcatgcttataatcccagctaattgtgaggctgaggcaggggaatcgcctcaaaccctggaggtggaggttgcaatgagccgagatcacaccactgcactctccagcctgggtgacagagtgagatttcatttcaaaacaaaaaaccactttagaaactgctagttttggcaatagttatcactatatgttttatcctgcatattttctgttaagaataaggaattgtttatgttgatcaggaatctaagtaattaaaatacaaaattctggctggtggctctcgcttgtaatcccagcactttgggaggccaaggcgggtggatcatttgaggtcggaagttcaagaccaggctggtcaacatggtgaaaccccatctctactaaaagtacaaaaaattagctgggcatggtggtaggcacctgtaatcccagctactagggaggctgaggcaggagaagcacttgaagtcaagaggcggaggttgcagtgagccaagattgtaccactgcactccagcctgggtgacacagcgaaactccatgtaaaaaaaaaatgaaatataaaattccatactcattattaattacatatagtattaaaataaaacccaaacaccaaaccttccttgatcctatatccttctccagctaccattctctctcctctccttggtccaaatttttgatttacaatgttggttggaagtggtaccactttggtgttagttccttatcattttacctggtctgtcctgcctcttcctggtacattagctccctgaaggcagggtgtatgtcccagaactccttgaagtcccttttctcagcatactaccatgcctactgcagcaccccccatctttaatgtccttgacttggtgaaatattacattttgaacacatttcctcacttccttatgacaaatattgattgagtttcagtgcaaggtgagtaagaaatggtacttgctttcaaggagctaaaaatctgaatttccttttttttttctttttctttttcttttttttttttttttgagacagagtctcactctgtcacctgggctggagtgcagtggcacgatctcagcttaatgcagcctccgcctcccagattcagtgattctcatgtcttagcctctcgagtagctgggactacaggcatgcaccaccacgcctggctaacttttgtatttttagtgaagatggtgtttcaccatcttggccaggctggcctcaaactcttgacctcatgtgatccacccacctcggcctcccaaagtgctgagattacaggcattgactttacttcttactctcctatgcacctctatcattttgaagaagggttcaaggtagttctgataagcaggattaggtttgtatgtaagtgattaaaggggtgctatgagcaaaaaaagtgtgaaggtataacaagccaaccacctcacaatgcagtttgcatgtttcttaatggacatagcaggttttctgtaagaaaacagcaggagattcgtgtggaatgatgggttgaggcaacatagtggcatcccttgaatgctcgaagaatgtgacttagagtttggtgggaagcagagagctgggttttaagaacatgaatctgacaactctatggatctggaggagaagctaactggggacgaggagcagtaagaagcctgttacagatgcactgataagaagtaatgagagctggccgggcacagtggctcacgcctgtaatcccagcactttgggaggccgaggcgggcaaatcacaaggtcaggatttcaagacgagcctggccaacatggtgaaacgccgtctctactaaaaatacaaaaagttagctgggcgtggtggcgggcgcctataatcccagctactcgggatgctgaggcagaagaatcgcttgaacctggaaggtggaggttgcagtgagccgagattgcgccactgcactccagcctgggtgacagtgcgagactccgtctcaaaaaaaaaaaaaaaaagtaatgcgataatgagagcttacttcaagatggcagcaaaagacagtggaaaaaaggcattgggaaaaaaagccaatgtgccttgatgagtaaagttaactgagtcaaggggagaagtcaaaggtaactatgatgggctttttctattaacacaaataggaaatgagtggttttgggaaagaaagtgatgaattacccctcagatattgtattaattgtctattactgtggccgggcatggtagctcatgcctgtaatcccagcactttgggaggccgaaacaggcagatcacttgaggtcaggagttcgagaccagcctggccaacacggtgaaaccctgtctctactaaaaatacaaaaattagtgtggtggtgtatgcctgtaatcccagctactcaggaggctgagacatgataattgcttgaacctgggaggcagagattgcagtgagctgatatggcgccattgcactccagcctaggcaacaagagtgaaactccatctcaaaaaaaaagatttgcctgtaatcagccagcacccccagccttgtgctcactttacatacaaaaattctgttttttagagcataaattgaagggcacattcaaaactgatacgtaggccaggcatggtgacttatgcctgtaatcccagcactttgggagaccgaggcaggtggatcactcgagatcaggagtttgagaccagcctggccaacgtggtgaaaccccatccctactaaaaaatacaacaaattagccagtcacagtggtgcgcacccatagtctcagctactcgtgaggctgaggcaggagaatcactagaacctgggaggcaggaggttgcagtgagccgagatcatgccactgcactccagcctgggtgacagagtgagaccttgtctcaaaaacaaagacaaaaccaaaacaaaacaaaactgagaagcaacagattgataagtgacacagttacactggtcagtctcttcagctaatacccattgttttttattattggagattcataatgtgttttctttcttttaaaaacttttttcggaaatggtaatttctctctttttttttttttttttttttttttgagacagggtctcactctatcacccaggctggagcgcggtggcacaatctctgctcactacaacctctgcctcctgggcttgagcaatcacacctcagcctcttgagtagctgggacaacaggcacatgccaccattcctggctaatttttagtagagacggggtttcaccatgttgcccaggctggtctcgaactcctgacctcaagtaatctgcccacctcagcctcccaaagtattgggattacaggcgtgagccactacgcttggcctcatagcgtattttaatattggttgagactagccttgctcattgatcttctcttagcgtttacttggttattcttgcttatttttccataagaactttcatttttatttaatcctgtgttttttggttttaaagactattttataataaattttcgtgattaaactcttgtgcttaaactcttgattaaacaaacaagcaatgaagagatgaatgaagcagaaaatgtgagtttcatgcctcacattcccactcctctgaggttaatattttcatgtatatttttcaggatgtatttgtaatctcatacaaacgtatgtatttttttaatgaaaatatttaaattttcatagttaacagctgtagctctaacttggcaatatcttctgtgtttctttacagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacaggtaagtccagtcttcattctgaattatagttgctagccatttctcaaatcactttatggttgagtgagaaggaaataatatgttagacaaggtctttattgtattaattacatagtttacttacagcacccaaaacacaggatgccctgttctattctgatattttagttctcattaaaaactggtatgtgtacatcagtgttgtggggagaatttgctatcatgactattgtctttatacagtaaatactgaacttaagtcactccttttctttttttgagacagggtctcgctctgtcactcagactggagtataatggcacgattgcggctcactgcaaccttcacctcctgggttcaagcaattctcgtgccttagtctcccgagtagctgggattacaggcgcgtgccaccacgcccagctcattttttaaatttttagtagagacagggtttcaccatgttggctaggctggtcttgaactcctgacctcaaatgatccacctgccttggcctcccaaagtgctgggattacagacgtgatgaacactgtgcctggtctgaacttaagtcactcttaatggagttatttggatttgaaaaatgaatttttactttactttcagtttcaaagtcttcttatagtgaaaccacaatttaatgttcatgacaaattgtttccaggataaaagtaactgtgatagtattacaacttaaatgaaattctagacatgcgaagcatgaaaagatagatgattggtataagctttttaaccatgaactaaaataataacattatataaagattggtggaaactattgaagtttaggcttcagttgacattccctgaagttaaaaaggatatgtgtactctttaaatgcaaggtaacataatggattatttccatctaattattaatatttctaatgataatcataggtatgaagggaatggatagtataatgagaaaggagagggggagataaaaatctaaaagtactaagggcatgttggatattgaaattcactactttcaaatattatcataaaactttgagacagtaacattgcaccattatttttcttcttttaaaaacattttactcattggtaaagagaatataaacattgtggataacttttttaaagtaatggtttgttttttttttctccttcctcctttaaaggaagacatattttgtttctgagcatgaattataatcaaagttctgctaatttttgggcaaattaatccattatataattaccttcatttataaatcaataatacctttaccattccctttccaaaagaaccatgcctggcaacatcaggaactagccagatgtgttttggaggctgcctggggatcccttgttagacttttcgttcctttatgaacctcttgcctgtggtccagcattgagcctctgcttccttccaagcctttccaggccaggcacttgcttgttctctctcttctcttctctcttcttttttctctctccctttctcttctcttccccctttttcttgtctcacattcatctcaaggtaacttaaagtccatttgttattcctcttaaagttatttttattttatttttttgagatggagtctcactctgttgcccaggctggagtgcagtggcacagtcttggctcactgcaacctctgcctcccgggttcaagcaatctcctgcttcatcctccaaagtagctgggattacaggtgtgcaccaccatgtctggctaatttttgtatttttagtagagatagggtttcaccttgttggccaagctggtctcgaacttctggcctcaggtgatacgcccaccttggctccccaatgtgctaggattacaggcatgaaccattgcgcccaacctgaaagttattttaaatctagacctttatctgaaattgcagagtgtgagatgtttgttctccatttaaatgggaacttcaaatgtctgaagggctgcttagcaatgctgttgggaatgactgatgtttggaagtggttgaatgccttcacacccatccatgcagcattcgtgaactctagtaactacagaagaccaatgcatatcctgcctgtggttcagacctgtgggtaagatttgatctggccactcctttcattacacttagagatgtagctcccaccccatggctatgactggtcttcggcagtgacaaatgctcatcagcatcacgtggatgggcataaactcacctacccactttcaaacattagtcattccccacagcgtggctctttgtagatatgatatcagtatcaaaagctttgctgtatcagatttccgggaatatatttaccaggaaccctggaggaaaaagagattaaattaggcaatgttcatgctatttttttttcctagaaagcccttcctttcccttttatgctctgttcaatggatattttctttgctccctagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggtacaagagaattgttaactgcttctttagtttcctacttttgatttcaaacaattttgcagagatgacttggcagaaatgtcactactggcctgtttggcacacaaagtatttgatgagcagttcagaggatcatgtgtgtttggaagtgggttgggtggtggggtggaattgcagatttctaccccagaaccccaagattatacagccaactcgaatgggtcttacccctcgttcacccacatgggtgttggatagaagacatcgagttacaaccttgtgaagatgtctcttggaaaaaatgtgctcacaaggagttgcaaagattgtttctttcttttacttaaatttaatatatagcatgcttaacagtcatgatggtgggctggctcctgaggaagaaagaataaacacattttttggaaatggtcagaaatcaggaattcagctacagtggactttgagaattgatctagacacatttcttcccctaggctaggagggtctcagttcacaatccccttgttttctgggctgtgtttagattatttccctaactttctctaaacgccttctggatttttttttttaaatcaacttgttgatgaaaagaatcaaactctgtaaaatatttgaagagatttattctgagccaaatatgagtgacaaatggcctgtgacatagccctcaggagatctgagaacatgtgcccaaggtggtcaggccacaacttggtcttatacattttagggagacataaggcattaatcaatgcatgtaagatgtacattgattcagcctgaaaaggcaggacacctgaaagcaggggcttccaagtcacaggcagttcaaagattttctgattggcaattgattgaaagaattattatcagtaggaagcaatgattgggttacaataagggattgtggagaccaaggttttatcatgcagatgaagcctccaggtagcaggcttcagagagaatagattgtaaatatttcttaggggtcttaaagggtctgttctatcagtgattccaaaaggggagggagggtataatgaaccatgtctgtctcccttgttccatcatggcctaaacttatttttcaggttaactttgtaatgcccttggccaagaggagggacccattcagatggttgaggggccttagaattttattttttggtttataaacttcaagttgtgcacccctgatttcaaggctggtcagctcatctccctgcatgtgtctttgctacactccttctctcgtaccagccctgatttgctgaagtcactttcttgcttactcttgttttctctatttgccccataacctgtccctcaactgctccctcccaggcaacaccctatgtttccatctgaaagctcccttcctttttctatcaaagccccaatgctttgttctttgccagttaagaaaagcaacgttgagagaattcatagtgtgtaaatggcaaatagcaatttactaaattaactcacccattgataactctaagaggatgttttaccttaagcagagaaatactgatagaatccaggatatggtgaggagtgaaatgttggtagtcaccttcctacctgtcccctgaaattcaccctgtatgaatggcagcctctttgtcctggattttataattactagctctgcgacttcacctcctagcctgtttcctcctctgtgaaatggagatactcatagggattttctaaagatgaaataaggttgattatatgaaaacatattcagtgctcaaatattttatttgtgacaatcttaacagtagattataaggccaagtccatttcctggctatatgataagaacaatattgattttctgaaattctgaactgaattcttgatacgatgactattttgtatcttgctgagtttctaggattttaccccttaagaacgtttggacctattactactaaccatatcttttaaaaagagatccttcttttttttttttgcttttggggaaacattggtctgcttgaaacatctttgacccctgagactacagctaataacaattgaaagtaaatttcctttgcttctctatgttgtttcttccttcctgctgcatcagacaggaatgtcaaattctaaatgtgcaaagaggaaagagttaaagctgttacagttgtacagttgtagtgcctaaatgatcctttctttgcatgcttcctgtctttgatataagtgcattacagtaactgaaagtggccacttatttttaaaattgtctcaaataggccaggatggtacagtattgagaaattccttgcatgtaacttttttttttttttttttttttttggagatggagtctcattctgtcacccaggctggagtgcagtggcacaatctcggctcactgcaagctctgcctcccagattcacaccattctcctgcctcagactcccaagtagctgggattacaggagctggccaccacaccctgctaattttttgtatttttagtagagacagggtttcggcatgttagccaggatggtctcgatctcctgaccttgtgatccgcccgcctcggcctcccaaagtgctgggattacaggtgtgagccaccgcacctggcccattcttatgttttttataattttaaacttgtcttgctaacttgatttataagctaattgaccatatcttagtcatgtacctgtccccttcactgtacaaatgcactggaagctgtgttgtgcttgcttttccattgatactttgttggcttcttcacacaatgagttgccatcagagtgataagtgctgttgtttctctactgggttatggagcacagaggaaggaggacatagggagaaggacctcatcacttcatctggtccagatgacagcatggcttattttttgagcttatcctttactttttgttctctttcctattggtgttcatttaacaaatatttattgagcattgtaccaggctctacggatgcagtggtgaacaagacaatagattatagattccatgagggcaaggatttttgtccattttgttcactagtggcacttaccaattccttgaatatgatttttcaaaattaattgggcttatacacagagttctgtatcatttttcacttaatattgtcgtataagcatttctgttgttaaatttccagagacccttttcacaactgcacaactgtgtaatattctatcttatgatcagatttaatttatttaactctttattattgaaggccctatcaattattttcattgttttaatgctatggttactttatttgttcatgaagttttgaaaaaaataagtttctctggatatgtttttagaacaaatctgtggggtcagagtgcattaatgtttaaagttcttgacagatgttttcaagtgttcaagtcttaagaaggttgtacagacttgctcttttaccagcagtgtgagtgtcgctttttccaacctcttggtagcattgactcttatcaaaaagaaaaaaaccttgctacattgatacgtgatgtatagtatcttttggtttcaatttgcttctctttattagtgaggtaaatgttttctcataaatctatctgccatttgtattttctcttttatcttctttattcagagattttgcccgtttttatattgggttctggcatttgcttgataaatttattgtgtgctttatatattaacctattattacatgtatgacaaatattttttccacttgactctgattttgatatgcagaaatagttaatctttaaatagtcaaatattaccaactttgatagttttgtgtatagtttttaagcctaaaaaaagtcctttcatacccaggcattatataaacttttgcgcatattttgttatttaatagtttgtttttacattttattatttaattcaaaagaaatttattttggcatactgaatgaaataaccaaatgtatttatctctcgttaattttctccacatcattttacttaataaatccattcatttttcattgatttaaaatatgggagccaatttttaaaagttgagtttgagatataatatgcatacaataaaatttacctattttcattactggtaatagtaagtacatagaaaaccacagaataatataacactgttaattgtggtttgtaacctcatattttgagtagaaagtctaaaggaagaaccaatgaaaaacaataactacaactttttttttctttttttttgagacagagtctcactctgtcatccaggctggagtgtaatggtgcaatctcggctcactgaaacctccgactcccaggttcaagggattctcctgcctcagcctcccaagtagctgggattacagacacccaccaccacgcctggctaatttttgtatttttagtagagatggggtttcaccatattggccaggctggtctcgaactcctgacctcaggagatcagcccacctcagacacatgtagattgaaaataaagggatggaaaaatatttcatgcaaatggaaaccaaaaaagagcaggagtggctatacttagaccagaccaaatagagttcaagacaaaaactataaaaagagacaaaaaaggtcactaataataaagatgtcaattcagcaagagaatataacaattgtaaatatgtctggagcacacagatatataaagcaaatattattagagctaaagagagagacagactgatatggtaatagctggacactttaacactccactttcagcatcgaacagatcatccagacacaaaatcaacaaagaaatgtcagatttaatctgcactaaagaccaaatggacctaatagatatttacagaatatttcatccagtggctgcaacatacacattcttttcctcagcacatggatcattctgaaggatataccatatattaggccacaagacaagtgttaaaacattcaaaaaaactggaatcaaatcaagcaccttctttgaccacaatggaataaaactagaaatcaataaagaattttggaaactatacaaacatggaaattaaaccatatactcctgaacaaccagtgtgtcaatgaagaaattaagaaggaaattaaaaatttcttgaaacaaatggtaatggaaacaacataccaaaacctataggatacagtgaaagcagtactaagaggaaagtttatagcttaagtgcctacatctaaaaagtagaaaatcttgaagtaaacaacttaatgatgtatcttaaagaactagaaaagcaagagcaagccaaacccaaaattaatagaagaaaagaaatattcataaaaagatcaaagcagaaataaatgaaattgaaaccaagaaaacaacacaaaagattgacaaaatatgaaggtttttttgagaaaataaacctgacagatctttagccagactaatttttttaaaaaaaagatagaagagtcgaataaaatcagatgaaaaaggagatgttacaactgataccgcagaaatctaaaggatcattataggctattataagcaactatatgataataatttggaaaacctagaagaaatggataaattcctagaccacatacatactgttaagattgaactatgaagaaatccgaaacctgaacataccagtaacaagtaacaagattgaagctgttataaaaagcctcccagcaagctgggcacaatggctcatacctataatcccagcactttgggaagccaaggcaggaggatcaccttaacccaggagttcaagattagcctggacaacacacagagatccctatctctacaaaaaaaaaaaaaattacaaattagccaggtgtggtggtatgcatctgtagtcccagctcttcaggaggctgaggtgggaggatagcttgggaccgggaagtcaagactgtggtaagacaagattgcaccactgcattctagcctgggtgatggagtgtgatcaggtctcaaaaaaaaaaaaaaaaagtctctcagcaaagaaaagccaggactgatggcttcatccagaattttaccaaacatttaaagaagaactaatgccaatcctattcaaacaattctgaaaaatagagaaggaggagggaataatttcaaaatcattccgtgagaccagtattaccgtgataccagaaccaaagaaacatcaaaagaatatgacagaccaatatccccaatgaatattgatgtaaaaatcctcaataaaatacaaaccaaatgcaacaacacgttaaaaagattattcatcataaccaggtggaatttatcccagggatgcaaggatggttcaacatatgcaaattaatttgatgcaccatatcgacagaatgaaggtggaaaaccatataatttcaattgatgctgaaaaggcatttgataaaattcaacatcccttcatgataaaaacccttaaaaaactgggtatagacagaatatacctcagcccaataacagacatataacagacccacagctagtatcacacttaatggagaaaaactgaaagcctttcctctatatggaacatgacgaggatgcccactttcaccactgttattcaacatagtactggaagtcctagctagagcaatcagaaaagagaaataaagggcatctaaattggaaaggaagaagtctaattatcctagtttgctgatgatcttatatttggaaaaattgaaaaattccaccaaaaaactattagatctaataaattcagtaaagttgcaggatcagtagcatttctatatgccaacagcaaacaatctgaaaaaaaaatctaaagtgatctcatttacagtagctacaaataaaatacctgggaattaaccaaataagtgaaagttctctacaatgaaaactataaaacactggtgaaagaaattgaagaggacaaaaaaaatggaaagatattccatgttcatggaatggaggaattaatatgtccatactacccaaagcaatctacagattcagtgcaattttatcaaaataccaatgatattttcacagaaatagaaaaaacaaccctaaaatttgtatggaaccacaaaagatccagaataaccaaagctattctgagcaaaaatatcaaaactgtggaagaatcacattacctgactataaattataccatagagctatagcaaccaaaacaacgtggtactagcctaaaacagacatagggatcaatggaacagaatagagaacccagaaacaaatccatacatctacagttaactcatttttgaaaatagtctcttcaataaatggtgctgggaaaactggatatccatgtacagaagaataaaactagatccctatctctcaccatatacaaaaatcaagtccagatggatcagtgacttaaatctaaggcctcaaactatgaaactactaaaagaaaacacggggaaactctccaggacattgggtggggcaaatatttcttgagtaataataccacacaagcacaggcaaccaaagtaaaagtggacaaatggaatcacatcaagttaaaaaactgcttgcatggcaaaggaacaatcaatgaagtgaagagacaacacacagaatgggagaaaatatctgcaaacatctgacaaggtattaacaatcagaatatagaaggagctcaaacaactctacaaaaaaacttaaaaatccaatttaaaaatgggcaaaagagctgagtaaacatttctcaaaagaagatgtacaaatggcaaatgggtatatgaaaaggagttcaacatcattaattatcagagaaatgcaaatcaaaactacaatgagataccatcttaccccaaagtagcttatatccaaaagatgggcaataacaaatgctagtgaggatgtagagaaaagggaaccctggtatactgttggtcagattgtaaattagtacaactactatggagaacagtttgaagtttcctcaaaaaactacaaatagagctaccatatgatccagcaatcccactgctgggtatgcacccaaaagaaaggaaatcagtatatcgaagagatgtctgcagtcccatgtttgttgcagcgctgttcacaatagccaagatttggaagcaacctaagtgtccatccacaggtgaatatagataaagaaaatgtggaacatatacaccactattcggccataaaatgaatgagatcctgtcacttgcaacaacacagatgcaactggaggtcatgttaagtgaaataaccagacacacaaagacaaacctcccatgttctcacttatttgtgggagctaaaaataaaaacaattgcagtgcctcatgcctgtaatcctagcactttgggaggtcgaggcaggcagattgcctgagctcaggagttcgagaccagcttgggcaacacggtgaaaccctgtctctactaaaatacaaaaaattagctgggtgtggcggcatgcgcctgtagtcccagctactcgggaggctgaggcaggagaattgcttgaacccgggaggtggaggttgcagtgagtcgagatcatgccactgaactccagcctgggtgacagagagagactccgtctccaaaaaagaaaaagaaagaaaacaattgaacttgtggggataaagtagcaggttggttgccagaggctaggaagggtagtgggagtggggaaagtgggagtcccagctacatgggaggctgagatgggaggattgcttaagctcaggaggtggaggttgcagtgagttgagatcacaccactgcaactccagcctgggcaacagagggagaccctgtctcggaaaaaaaaaaagatgataaatcaaagtattttaataaaattgggccatactagagatgttattgtttgaaatcaaatatatgaagtatagttaataatataagtgtaatagaagaaaaggagccttagaaagcttgaaaaacatcgttgtacttcatatacatcttctttgcttacattataatggacaatgctgcaacaaacatggaagtgcagatatctctttgcaacatgagagattcatgtagatctaagagactgtgaagactgtttcaatattggagttacaattagctttttaattacctcttctggccagctgtggtggctcacgcctgtaatcccagcactttgggagaccaaggcgggtggatcacctgaggtcaggaattcgagaccagactggccaacacggccaaaccccgtctctactaaaaatacaaaaattagctgggcgtggtggtgggtgcctgaatcccagctatttgggaggctgaggcaggagtatcacttgaacccggggggcagaggttgcagtgagtcgagatcgtgccactgcgctctaacctaggcaacagaggaaggttctgtctcaaaaaaaaaaaaattaccttttcattgtttgctaatgtgtagaattctgcatgtaacatgtccagtttaaagaatgattatagagcaaatccctgtgtaaccagcgctcaaacaatgaaatagaatataatggcagcccagaatccctttgggtggtccctcctgccacacctacttccctccctgcagaggtgggacagtcctcctttctgccttccttgctgtgtatggttttaccacctacacgtgcatccctaaacgatgcaggttgattttctctgtttttgaactttatgtgttcatgtcttctacatatattttgtgacttttttcttttatgacttgctcatttcatttatcattgagattcatttattctccgcactgaaattctggttcattataggcttaatgtaagatgttgaggccatattgtttattagaaaggcactaaaatgccctattcactttcacttttgcttctcatctattttattataatttctatttcttaaccctttctcaaacccatgtagctgtcctcatcctccctaccaacaccccatccagacatctctcatttgcacaactacagcaggctgtcatctggtctcctggcctcatcagttttgctgcctctgattggttcttcgtactgcatctgaaataatttttgaaatataaatattcttagctcttccttgcataagagaattaaaagtaccattgtcttagagattgctatataactaacaagttcaaactcttaggattttactacaatgggccttattttctgtacttctgtgtctttgagttgtttagagtagctctacttcataaacttggttctgggcttttgtgggaggtcaggtctgttccacatgtccccacgttcttcttggaccagtggctacctcacaggagctcaagaggccaagccaaactgttggagcagcacatctattgatatatcattggctataaaaagtcctgtggtcaagcccaacatcaactggtagggaagtgtttgctctctgcgcactctagtacactgcagggtcgcaaggctgagggagagaatgaagaattgagaacggtaatccaccacaactcttgtcaatagcagtactttctgtcattatttagattgctaatttctttatttgttccttttgttattttatttgactatgaattcccataaaaatattgtattaaacccgaaagagggatatatgtaaaagaatataagaagttgaatttgatgacttgatttacaactcttgagttctgtgacttggagcaaatcaatttaatgttagtcttattttccacatccaaaggatatatttttatatctctcttttgagaattctaagaatatgcagagaataacatattagtaaaaaaccaggatattgaaatgttcctaggtctcctttactcattaacaaggtgacaatgtagcttgactttggctttgtacctgtactggtcattaagaagatgtcccctatctctcagctggaaagtgttatcagtgttgttgaccaggaagagatttaactaagagatcatagcaataatctttttttccctcccactctgctataggacataatgattatatttgtccagctacaaatcagtgtacaatcgataaaaaccggcgcaagagctgccaggcctgccgacttcggaagtgttacgaagtgggaatggtgaagtgtggtgagtgcttgcttcccttcttattgaatatgggccttgctaaaagccctgtcctctgaggaactggggacaggtagccgggaaaagagaagatttgggacatagtaattaagtatttgcgtgttgtcacattggagggggcattgacttatccacagtaactgcagaggacagagctggggtgaatgggaacagattatgggaggcagattttggccccaggtagagaagagctttctagagttcaagtggtctgaccacagaataggccaccagatgggttaggggacttctagccactggaatcctcaaacagggctgggtggccgtctgtctgtgatcttgaaaagtccagttctaaggatgaagtcgtggtaaatgtccatggttaaaactcgtgacaaaaaagtaggatatcttgtgggttactggggtagccatggggaggctcacacctatcccctcgtctagctttctagaagtagaaaaatatgtaggagtcagaaacataatggaactatgaaaagtacatacagcatagattttgttctatgacagtcataggtgtatacatatgtgtatttaacatattcacatacatatattcacatgtattttgtacactcacatacattcgcatatattttatgcacaaagaaaagtgagcactttggtatataactgacaaagatgccaacacccagctctctccacctggctagattttggttcacttgtctgtactcacttgcttgtttatatgtactcagagcagttctgcctgcacttattcttctgctagccagtattttacctgtggttaattgtaatttctctgtgtaattatttgaaaatttaaaacaaaaatccatcactttactctctgacaatttctttttttttttttttttgagatggagtctcgctctgtcacccagactggagtgcagtggcccattctcagcccactacaagctctgcctcccgggttcacatcattctcctgcctcagcctcccaagtagctgggactacaggcacccaccaccacgcctggctaattttttttttttttgtatttttagtagagatggggtttcatcatgttagccaggatggtctcgatctcctgacctcgtgatctgcctgccttggcctcccagagtgctgggattacaggtgtgagccactgtacccagccctccctgacaatttcttagtagctttgccttgtgagcattctctgcccttttcttttctctgtgtatgtaacagattagaaccctcagctattatagttcagttacagcagaagttctcttcatctgatcatgcttctctggcttcctagagtcactgatgatcttcatttcctctgtagaacatcctgccagtgcccatagcctcacagcgtgtattattggttattctctcaaacacctaaacatttccattcccaccgcttcacattatccttgtcagaaaccggtgggcttcttttcaaacctgtttctactcactgtaattgttacattataaaatttaattaaaatttactcaaacatattatgaataggaaaagacaagtttggtttttttctgtgaaagtttagttaaggccgggtgcggtggctcacgcctgtaatcccagcactttgggaggccaaggcatgcaaatcatgaggtcaagagatcaagaccatcctggtcaacagggtgaaaccttgtctccactaaaaatacaaaaattagccgggcgtggtggcatgtgcctgtagtcccagctacttgggaggctgaggaaggagaatagtttgaacctgggaggtggagcttgcagtgagccgagatcgcgccactacactccagcctggtgacagagtgagactctgtctgggggcggggggaggaggaagtttagttgaaagttttgaataaaatcttaaaggactaatagctattgagataggtatgggtgagactgggggaaaaaaacccataaaccttgggagatcctgaattcagaattctttagaagtatctaggttcttgctctgtttttgttttaaagaggctgaaactgaaaatccagagataatatcttatgtgtatgtttatgcagaaaagtgactttgtctaattggcccagatgcttaaagagaaagccttggcactctgacaaaagattgcaaataaatgttttaagttttaagttaaactattttaaagtgagtatgtgtgtgtgtttaaaaaatgatttccaagttagtcttaagaatgcttttattatactaggatccgttgcacagctattgccctcatggctcaaggcagtgtatgcagggaagagcatggaggttggatcccatagagtctatgtttcattttcgtttcatcacttcctgctgactgtaactgtgctcaaactactgaatcacctctttggcccttggttttcatgtctctgaacagagatatctgcttcacttggttttgtgaacaataagtatgaaaacatatatgaagacttagcacaatatctgacactcaattttagttttccttccattctctctccttccctgaaaaactcatatgagctttgatacaacactgtttcatgagacagagtacagagggatagttaaagaagctttcatagaaaagggaatgagagaaaggttgttgtatttagccagaaagtctaagaaaagactgtattctctttggagattatggaagaaatgagatgggttgttgcacatatacaatgggatattttgcccttcactgaccatagagaaagatcattagagatgaactttcttaactctgtctctctcctttcccatcactcttcttatctgccttccccaaaaccctctatgcatgctttttcttctatcaggtttggaggactagagattctacctgcttgttggatcctcctgcaccatcctgcttcttttattttgaaaccatgtagtctgttatcacccttttcttctgaatttctgatcttgtcttttctactgaagtatggatgtggtcatataatggtaggacaacacccacctagactaactttatggatgaaacttcattataaggatatactgaaatgtaaggagccaggaaatccctctgaatagccatgtatttggcctatatccccatattgggacaatagctcaacatattttgggtgccatatctttatatacctgctgtatactcttctgtgaaagggatttgataggtgggtagtataaaatagtggttaaaagcaccagctctggatttaggctactgcttgggtttagatcctgcttctgctattttctagctgtgccatcttagacaagttatttgagcttatgtttggttcctcttctgtacattggagacagtaatagttcctgtactgtagggtagctgtcaggacatgtgcaatatgcaatgcctggtgcatagaagcttccagtagacattagctgccatttagtgtcatttatcactacgatcatcatcatctttggctggggctatttaccactgcctaatatggagcactcgatttggtggagctgctcattaagctcactcagaggcagctgcctaggttacagtgtcaaagccacaacactagaaacatccttgatagaaaaatgagctccttgtcaagggctttattgagtctagaacccccagaattcactacaggacctagaatgttagactttgtcagtgaaaatttgtcaagtaaatttgaacgtatgaattcaaaatctctcactttgggtatgtaaagggtatataaatctgttttgtaaattccttatccttatatactctatactctacaaaagagaaatgtatgatcagaaaggtgcttttttttttttctttttttttttttgagacagggtatcactctgctgcagcccaggctggagtgcagtggtgcaatcttggcttactgcaacttttacctcctcgggctcaattgattctcccacctcagcctcccgagtagctgggactacaggtgtgtgcaccaccatgcctggctaatttttgtattttttgtagagacaggatttcactatgttgcccaggctagtcttcaactcctgggctcaagtgatccccttgcctcagcctctcaaagtgctgggggattacaggcatgagccaccttgcctagcagaaaggtgctttttaaaactatacattttgcagcaaaccgccatggcatgtgcatacctatgtaacaaacctgcatgttctgcacatgtatcccagaacctaaagtatattaaaaaaattaagaaaaacatacattttgctccattttatcctgggtgtataattgaccttagcattctgcttgattactaataaaatgaattgtattttaggcctttaattcttttagcagtaaatttggttcaaattttctgaataaatagagccctttcttctactataactagtcaatgttaagaggaaattctgacaaattttcctgggagccaataatttaaatttgctcacattttctaactaatatttatttttaaaaatgtaaacaattgatttagtgaataaacataatgatgggtgtataaaaccaagcattttgcagatttcaacttttagggtttctttttttaagggaaattcatataaaagttataaccatgctaatgacatccttacttacaacatgtctttcttaatttccattttacattttttgtctttaaccgatgaaaacttataaagatgttggtgctcaaatgtatagggatttggaagttatatttttgttgttgatttccatttttcttatcgtcagagaatatgatctgaataatacctattttaagattttcttcattgcctagcatgtgataatttttgcaaaatatctatggcctttgtagatcaagcttgttaattatgtggttcaaatattctgcattctgactttttgctctttcagctgttgagagagagatttaaatagcccgttataatactgcatctgtcagtttctctttttctttcagttactttttgtattgtgtttggaggctgtgttttattgtttgtctatttatttatttatttatttattttttcaacccaagtcttgctctgtcacccaggctggagtgcatggcacggtctcggttcactgtgcctcctgggtttgtgcgactctcctgcctcagcctcttgagtagctgggactacaggaatgcaccaccatgcctgggtaatttttgtatttgtagtagagatggggtttttccattttggccaggctggtctcaaactcctgacctcaggtgatccgcccaccttggcctcccaaattgctgggattacaggcatgagccagcgcacctggcctttgttgttttgaagtatatgagtttagaattatttatctttttaaaatattctagcgatgagtctccttatctataataataatttttgccttaaagtttatttgtctggtatcaatagagtaatgtcaatttatttggttaattttgcctgttaaatatttttctatctgtctactttgtttttctatatgttaggtatatctcttacacctaatctatgtctagatttaaaaatatgtataatttcagagtcactcttaaatggtcaatttggtattttttgtttattgtgataactgatatttgggttcatttctatcatcttattttttgatttaaaaaattttattatgtattttctacttcttcccttttaggagttgatcacatttttatgttttctttttcttcttttgctagtttaaaagtcatacattctgtttcaattcccttttatcttttgagacagagtctcgctgtgtcacccaggctggagtgcagtggtgtgatcttggctcactgcagcctctgcctcccaggttcaagtgattctcctgcctcaccttcctaaacagctaggattacaggcatttgccaccatgcccagctaatttttgtattattagtagagatggggtttcaccatgctgcccaggttggtcttgaactcctggcctcaagtgatccgtcccctcccgccccacccgccgaaaccacctttggcctcctaaagttctgggattacaagtgtgagccaccatgtttggccatgtttcaattcctttaatgacgtttatgttttgtaacgtgttcttgattaatttgagaatttaagcttctatcttcccaaaaaagaatcttagaaattctaaccaaaatcattcctctctgattttgcatgttattgtttgttattttggttccaccttgtttctatatcactaaaacttaattcttgggccggatgtggtggcttatgcctgtaatcccagcactttcagaggccaaggcaggaggatcacttgagcccaggaattcgagaccagcctgggcaacatggtgagaccctgtctttacaaaaaatacaaaaattagtcagatgtggtggtgcacacttgtagtcccagctatccaggaggctgaggtgggaggatctcttgagcctgggaggttgaggctgcagtgagctgtgatcatgactgtaccaccatacttcagcctgggtgacagagaccttgtctcttaaaaaaaaaaaaaaaaaagtaaatccaaagaacaagcatataaatcaactttgctagtaattaaaacatacaaagtaaagcgagatggtttagttagattagcaaacattaaaaatgatttttaatgcccaatgggttctgagaaaacagtcaaactattgaggactgggtaacatagtaagaccctagttctacaaaaaaatttaaaagttagctgggcatggtggcatattcctgtagtcccagctactcaggaggctgaggcaggaggattgcttgagtccaggagatgaaggctgcagtgagctatgattgcatcattacactccagcttgggcaacagagcaggactctgtctcaaaaatacaattaaaatagtgtagatactacaatctaattttgtgtataaaggctgggtgcagtggctcacgcctgtaatcccagcactttgggaggccaagatgggcagatcacttgagaatcaggaatttgagagcagcctggccaacatggtgaaatcacatctctactaaaaatataaaaattagccaggcatggtggcgggctcctgtaatcccagctacttgggaggctaaggcaggagaatcgcttgaacccgggaggctgaagttgcagtgagccaagaatgtgccactgaactgcagcctgggtgacagagtgagactccgtctcaaaaataaataaataattttgtgtataaaacgtggaaaaatatggtggcaggcacccatagtcctagctactcgggaggctgaggcaggagaatggcgtgaacccggtaggcggagcttgcagtgagccgagatcacaccactgcactccagtctaggccacagagcaaggctccgtctcaaaaaaaaaaaaaaaagaaaaaagaaaaataaaagcattaaaaagactgaaagagtttatgccaaaatttattctcttctatatttttcagattttttcacttaatttgttatttgaaatatacttgttttgtgtaagtataaggaaatatatacatatgcacacatgcatataaacattttaagaatgtgttataataaaagtatattatttgatacctttggaaatatccccatttttctacctgaagaaaattcctaatttcatggtttggaaacaggtttatgagcactctttatagagaaacggtgttagtatctatagatgacctggaaatggagacctaaaaagtttctgaaaagttatgtcgttggttttgctagtacggtcacgaccatagtaatctttggtacgtgccccacaggctccagaaaataaaagtcaagctgcttttgcttgactgcggttttaccctggcaattcgaatgactctgctttcctcttcaggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggtagggctttctggctatcagttttccatgtacttgtagaaaggccggccgctaatatttaaggggcaagagtacaaagtagaggtccatgagctgtgcctagatatttaacaggtcctcagctggatttgtaacttttaagtgcaatatgttccttccttctgtcttggcatacctaccttcaacaaggccgtgttctgatttagaattctgagactcttctgagttctgtacccaacatggtagtgcagaaagagttgtgcgtggcccagccatttctattcttgactgccttcttttcccatggctagatgcatcccataccaccttgcacaaaccctatcctgtgtgtccacatctgctacagacactcacctgttggccacctctcatgcctagaggtggtctgggaggatggacccagggaacctacctaggctctggaattgggcttggggtcatttgggcaagaatcctagagtcctggaacctggaacgtggttaaaatgatagactccacattgacccatttcttggctgtggattcctcaccttgaaaggaggggtggggtagagtacagtatgactagtttgaaagtgaaaggtttgtcagatgctaaatagaattttgtaaattattgttccagtagagaatcaatattatgtacataaatgaatatgtatggacaaacagagtaaatcagtggttgaagttacacgaatcatcaatgggcccataaacctggaatgccatcaagttaaaaatgagcttagttactcatgagttgtcacttggaacctgcgttttccatcctccaaagtgatcacttctctcaagcccatttgtaatatatatctgaagtgctgtatgatgctaaaattaccagctaattatcatttgacttggtgtttctgtggaggagtgaatctaggattctaacctagagtggcaacaccccacgatccccctgtgacagcttctccatgctgttctttacagtccttgaagaaatgaagtctcttataagttctgagccactgggggcattcccatggcctggagggcagcgactgcactgggcaagctgtaaagatgaggaggggtgagaagctgggggaagagaagttttgggtaaagagcctggggaactgaggcctatggtgacagtatcatttggggacttttgttggcctgggcccatttcttctgagcttcctgaggatttttggtttctagttgtattttgttttgtctagcatcttcacctttgccagaattattttattttctctgctttttcccaggggaggcaatactgatgcactttcctctagtttttgctttaaatgtattccaaacacgattttgcaggaccacacatggagagcagtggtgaaattaattattgctgaaagctgtgcaccttctttgtgccataagaaatctgaactcttaaactgcattattccttattcaagcctggtgttttgaaaagttttcaggaaacgtagacataatctgaaggcgtgattttttttctcctctcttagctggcatagtcattgtccaaaccaaaaaatatatattaaaatatcatctagccttgatcttgttgaatatctacaagattaagaaccgtgatctctcttgggtaggcttattgtcaatcactatgggtgagactgggaaggtatatacacattaggaacctaaactgagcaaagcatgtggatttagaaagtatttatccatctttacattcataacaccattacattctccttgaggcagatttgcgttataattgttcaaagacttgaaccatgtgtgttctctctgctgtagtttcctcatctgtaaaacaagaatgataagagatcctgcctataagacattctcagagataggcattgttacccccattttcctataagaaaaacaaagacttaatgggagattaagtgaacagctagaaagaggctgagctggggttcgaaccagagtccatttcactccaaggcggtgtcttttgttatcatatttatattacatggccctctctttttatcatggcttgtgaaggaagccccggtgttctctgctttgcttttgaagtgcttccctccccagagattacctgtttgcaaacagtactgtgaccaacatgggttattaggttgtcaggacctgcttcgttattatatttgctctttatttatttatttatttatttatttttgagacagggtctcgctctgttgcccaggctggagtgcagtggcgtgatctcagctcactacagcctcgacctcctgggctcaggcgatcatcccacttcagcctccagagtatctgggactacaggcacctgccaccatgaccagataattttctgtagagatggggtttctccatgttggccaggctggtctcaaactcctgggtgcaggcaatccacccaccttgacctcccaaagtgctgggattacaggtgtgcttggctatatttgctgtttaggatagaatcacccagaaacagtgcttctacccagaagaaggatcttaacactggataggaaattttaatcaatcagagaaatccttgcagttgaggccttggttttctgtgagggctggcactgctctctgcaagcctccaaccccaacctccacctaccccatcccccacctaccccatcccccaccccttctgatcccagtcaaggattgggtcagacaggcaggtcttctgactggcagccaagcatcaacattctcagtagtgcagaggaattatcaggacacagctaacaaagatcagttctgagccgaggtcgtagtgcttgacaaactctaaatgaagtatatttgtctctagaaggggtccaagactggaaactaagttgcgcagcttaacttcaaagttttcttcctttaatgagcagttaatcacatctataaaatatcaactccctaatggtttgtgttttcttagtgttttaacacttgccattctgtctctacacacacagggagctgaggaggaggggtgggggtgtctcaccgcctcttgctttccccaggctttgtggagctcagcctgttcgaccaagtgcggctcttggagagctgttggatggaggtgttaatgatggggctgatgtggcgctcaattgaccaccccggcaagctcatctttgctccagatcttgttctggacaggtgagaaaaaatacattgtgtttcttctctgacttgtttgagtaaggtgcttagtgagtgggaacaaagtcctgggtgctgcaattaaaatctcacacttgcagggcagaggatgatagcatcatcagctccttcactgggtcaagaaccagagaaggagagagttgggtccaaggattcagggtcctgtgactcatttttaatctgtggtgcagcagcatttacaggccagcgctttaataggggactgtatcccgtaggtatgtggccactatgtgtataagtcgacacagatttttctccattaaaaattccattttcaggttataatcttaagttgtcctgctgttttttgtacctatagtgaccaattatatctggagctttctggacaggtgataaaattcttagaaatgtgccaagtttattttcacatgctttaactcactcttttgtttttttttgttttgttttgttttgttttttgttttttttctgagatggagtctctctctgttgctcaggctggagtgcagaggtgcaatcttggctcactgcaacctccgcctaccggattcaagtgatcctgctgcctcagcctctcaagtagttgggatcacaggtgtccaccaccatgccaggctaatttttctatttttagtagagaagtggtttcaccatgttggccaggctggtcttgaactcctgacctcaggcgatctgcccacctcagcttcccaaagcgctgggattacaggcgtgagccaccatgcccgatctgctttaacacattctaatgcatgtactatatagcatttttggcaatagcggtggaaggaagggttactaaaactatatgaaacttaacagaaaatgggacatgatgctgtatcttggttgtgtttgattttcttttaaagatgacacagaaaaggaaacaatttttaattgacttaggtgaactgtttatggagggaaagctggactgtataaaaatactcaagctttttagcaggaaagtagaacaccctcttggtgtaaattcgagcagttcgaaatcttcttggaaattgatttccacatctcttttatggaaaaagtgctaggttgaatgttcagccacatctgactctgcatagcgtgggaggatgcctagtgtctaccccaactcttgcattataatcctgttaccactttagatcatcagaagaccctgtgttacacagatgaagagtgatgccccaaggtatcagtccccattctgccttttgtcatggttgacaatgttattaaaagagcactgttctgcataatggtgttttgatagagaacagatcctctgagaagagctggaggactgatgtgacttgaacaggagcaagcccaggtggtaaaccatggagggaggctctggaagaccagagaagttcagggcacaagacccttcagtaacaaacaaaatagttaacctattggcttgtatgtgcttggcagcaccttatgcatttaacttatgtcaacacatttaatcttcacaatcttcctgccccctttgagggagtaggatccattattatctctatcattcagatattggaaatgggagattgagaaacctgcttacaggtaggataataggtggtggagctggacttggggggttgccaaatggcaaactaactctctactttattctacctgttgttatgggtgacaatgttgacaaagagcacattctgcagaacagagatgttttggtagagaacagccctgttttacttgtaacacactgcagaaacccactctccccactgtcatctcagggtaccatgtcgcaaggcaggctgaaaagccaagcacctagccaagccattgctctcattcattcattgtattctgcttggtgttttaactggggccaaatatacatatgtataaatatacacatataattttccttgaagttagtcctaggaacacattccatcccttgacaaataatttgcagactttaggattattttatcttttgtcttgatttctaaattgatgccaaatttagtgtttatttttggtgactatttcattcctggtttttagtacaattaactctccactctcccatttctctgtatgcgttctttaattcctgtaattgtgtgtatacattactataagtggacacaaatcctggaaaaatattaggcctaccttttagttaatagaagaaaagttatttttcttacaaattatttctaatagacttacactgcctttataacttaagtgaaagtattatgttgtaaaacataaatctagtatatttgattgagtatagaagaggaattcttgggaattgtaaatgcattcatgttgagcaggcatttttttttttttttggaatgactactggtgtttatttgttgttgcaatttctagtagtttttgtttgtttgttttttgtttttgagatggagtctcgctctgtcacccaggctggaatacgatggcatgatctcagctcactgcaatctccgcctcccaagctcaagtgattcttgtgcctcagcctcctgagtaggtgggattacaggcatgtgccactacggctggccaatttttgtattttttttttttttttagtggagacggggttttaccatgttggccaagctggtctcgaggtcctgacttcaagtgatcccccagcctcagcctcccaaattgttgggattacagacgtgagtcaccacgcccagcctacagtctctagtatttttaacacattaactttctgaagtctggaacttgaagtctaagatagttcagttacttagtcctctcttatacaaatgaatatacttttatgtaataggtatatttgtagaggagttgctcattcaaaaagtcaggagtcatgctccataaagacttctattacgactcttttttgcaaagtgaagggaatcttcacaccatttgaaaataactgtcttctgctggattgtcctagcagagcttcttcaagtggtaatatggctgaataaacagtgaatacaactaacagttgcccatttgtggatactgaaactataatttctgtttccctttattcttgttgaggtgtccacaacaagaaaacttgtgtctactgaggatgagaggaaaatctcattacttcagcttatttctaagcatttagtttttcttttactaaccactaaattcatcataaattcacgtgaagatctaaagaacctgactgtctaattgctcaaaaaaaagtcacatatgcaaagacatttttgtgtccttagtatcaacaggcaactgactaatgttaaattattagtcagaggaagtttgtatctggcttggatcccattgtggacatttgcagataggtccgtggaattgtatatgtataaatgtcttgagtttacattcacattagttatttgtatgctaaattccttcaagataaccaccgaattttcaattcccaattctaagccttaaacactccctgccattgccatacacacagaggtaaaccatggtctgtacccaggtgtgtgctgcgagcagagatatatatatatatatacacacacatacatacacacacacacacacacacacacacacacacacacacacacacaaatagtgtacccctaagggaggcccactcattcaacattttgttgttgtattaaacaatattcttctttaggccaggcacggtggctcacgcctgtaatcccagcacttggggagactgagatgggtggatcacctgaggtcaggagttcgagacaagcctgagcaacatgatgaaaccccttctttactaaaaatacaaaaattagctgggtgtggtggcaggcgcctgtaatcccagctacttgggaagctgaggcaggagaattgcttgaacccaggaagtggaggttgcagtgagccaagatcacgtcattgcactccagctggggcgacagagcaagactccatcttaaaaaaaataaaaaataaaaagcaatattcttattttataaagagtgattattggccgggctcggttgctcacacctgtagtcccagcactttgggaggctgaggtgagtggatcacttgaggtcaggagttcaagaccagcctggccaacatggtgaaaccccttctctactaaaaatgcaaaaattagccaggcatagtggtgtgtgcctgtaatcccagctacatgggaggctgaggcaggagaatcacttgaacctaggaggaggaggttgcagagagcagagatcatgccactgcactccagtctgggcatcggggtgagaccctgtctcaaaaaaaaaaagtgattgtcaagtaataaatttgatatggtttggctctgtgtccccagcaaatctcatctgaaattgtaatctccacgtgtcaagggagggatctggtgggagtgattggatcatggggatggtttcccccatgctgttctcatgagagtgagtgagttctcacaggagcttatgctttaaaagtgtttggcagctcccggctgtcttgctcagtcactcgctctcctgcctccatgtaagatgtgccttggtttccctttgctctctgccatgattgtaagtttcctgaggcctccccagccatgcagaactgtgagtcagttaaaccttttttcttcatagattacccagtctcagatagtgctttatagcaatgtgaaaatggactaatacaaagatattccatgttattactgattttatttagtagtttatggacagatagtgtgcaaaaataaatttcctgagtaggtcagtttggttgatacattgtttcaatattttaacattcaaatcatatgccctgtttttgtttttgtttttttttttttagagacggtcccgctctgtggcccaggctggagtgcagtggtgccatcacggctcactgcaaccttgggctcctggcctcaagtgatcttttgcttcagccccctgaggaactgggactataggtgtatgctaccatgcctggtttattattattttgtagagacaaggtcttgctacatcgcccaggctggtctagaactcttggcctcaagtgatcctcccactttggcctccccaaagcacgaggattacagacatgggccactttacccagccagccctgtctttaattcaactcttttaaccctgtcctaatttcttactcataattcagtttcaatctaaaattataaaataaataaaatagatgtcattaatttagagtctttactaactttgttctgtgtaactcatctgaaagacctttactgggctgtcatttacgatgtcttatactttattgcctcttcatttctcatttattttgttgaaatgtatttggtttctgcagactgtggagtgaataaaaatattctaactttgccaccccttgaatgaaatggttgactgtcacacctgcttaaaaagaaagcaatcagacctagttctttagactttgtttagaaattaactttctccatgagttatgtatggtctgattactgtgagggacagcctttatcagggtttaaaatacctcagtatgccaaccctcctcccatttttggaacataaatttgcagtgaaaatggcatatattttaatgaggaaatgataccaatttcaatattgaggaactaaggcacaggtacttctggaaaataggattgatttcaggtgggttcccttaccataccacttggggaggggtgtgtgtgagtgtgtgtgtgtgtgtgtatgtattgtgcatgtgtgtataatcccacatcagcacagaagaataaagagataatcaaatatcaatgcaggagttggtgggtttttttgtttttttttttttttgccccatagagatattttcaaactagctttccttagtatcaaatgtccccaagtccaacagttacaatttccaataattaattgtccgcaggcaaggtgattcaggtgttttttgtgttatctctgtgcagggcttgtgttgtccttactggatgcctgcatcaggttgcctgggagagcctagagctggggaggtggaaagatgaggcttcctgtagatttggcactctttgcccagtgctctggattctctaagacggccttttcctatgagtgacttccagggggcactggtgttttgtcacttaacctgtgtacttatagaaaattgcaggtgtttacagaatttatgatttagtaaatttagtaactcagtaatgctcatataccaaagtgagcaatttgcatgcttgtagctctgtgtgagcgagtctgggtgggagagtgtgagtgcttcggaatgcaggatcccggtgagtgccatgtacggcaggtaatgggaaagacttctgcaggactggtgtatccagtggtgtcagaggctcttccctgaaatactgccatcgctggaaatgccctgagttcggggaaggaggaggggagcagccagctctttgaagacctcaaggccccttcaggggctgctagagactaaaaatggaactcgcataaacccactgccctttctgtgtgctgcaggcttttgggagcaaagggtggttttgtgacaaaatcatctaactgcttgtcaaggacttccaataaccctgtgactgacaataatagagtgttttgggggagcagtgaggtggaataatgtgtgtctggctggagtgaatagaagctggtattttccagataaagttcaagtaatttacttccaaagtatatttaaacatttatttctacaaggagtgctccaaagaattttgattagatggctcaaagtttaaagataatccttgcttgaagataatccttggcaagtcaaaaatttttccccacctccatgtataccttcttttcctgattctaatccatcttctctaattgcgatttctttctcatagtcagctttttcaaattacaggtaaatgtcttagttgctacacaagtttctaagtgaccaccaggaagtgagagttaagccctagatatggagttttattcttgggatatttgcttctgtgacacacggtcttcctcattaatacttcccgatgggaacatgaagtgtctcattttgaaatacgtgtcatatctggggctggttgactgatatggttttgattgaaaacaatcaataggagtggtattgctgtaagaaaacatttggtgaaaatgtagaaggaaaatattccaatgcacatttttgcctaaataatatttattcatatatttacttcagggatttataggaaatggcctatcttctttatatgaagacaattctagtaatttcatattgctgggtgtggtctcattaacaccctgttgtagttaaaatgatattatcagatgaacatgttacaagatgaaacttgagattaaaaataaaacattccttattgtttttttgatggtttcctgaagctatgttccttaaatttccaaacgaacttttgtagggatgaggggaaatgcgtagaaggaattctggaaatctttgacatgctcctggcaactacttcaaggtttcgagagttaaaactccaacacaaagaatatctctgtgtcaaggccatgatcctgctcaattccagtaagtaatcacacagctgggccatgttttatcggggagagatgctgtttctacaactagcgtgatattaagaagaatgttgaacttctattttatttgaaagggtaaaatggtttccttttggacttcgtttttattttgatagcgatttaaactgtaggtaacttttggtaacttggacataaattactcattaagtgaatgactggcaatcaatttaaaagtagctcaagccacttgctggaaaagaaaaaaaaaggaactttaaattgtttatcttttaaacttttttcagtgctcacacagacactttacatggttggcatgcatttatacttatgtctggggtcctccttttttacagattcattcgttcagtaaagatacaatcctaccctcaaatggctcatagtttaggcagggagagagagaaaacaaatcattaaaaataatgatttctgtgctatgataaagtctacacaaaatactacgggaaaataggaggagagatgctggagttgttgcagaagggaatgattgaacaaatcttcaggaaagagcagagggaagtaggtatgactttaaaatgcagtgctgaagattagaaactgctgcccaggctttgggcagcttagaagaggttcaggcaggggagtgtcatgcacagatatgcgatatagaaaggtcactctggcttccatgtggaggactagaaagggcagagactgaagccgggggcccattagaggcaatgagagcctgaactgacattatggcgtgaggtcagggagcaaaggacttgacttgaaggaaaagtgggaggtagaggagggaaataaggtgtctaggatatgcagatggtttcgttttgttggttttatcttatataaatatctgattattgttaataaacattcaaatgagaaaaacatacaaggaagaaaataaaatcatcaggaatacctgccctcaaaataaccaccataactttggtgaccattcctttctttctttttttttttctttttttttttttttttgagacaggatcttgctctgctgcccaggctggagggcagtggcatgatcatagctcactgtaacctagtactgagctcaagtgatcctcccaccttggcctcacaagtagcttggaatacaggtgcataccaccagacctggttaattaaaacaatttttttttgtagagacagaatcttgctgtgttgccagaggtggccttgaactcctggcctcaagcagtcctcccacctcagcctcccaaagttctggaatttacaagcgtgagccactgtgcacagtctgtatcttgttttttcacttttctttttgagacagggtgtcactctgttgcccaggctggaatgcagtggcacgatcatggtttactgcagttccgacctcctgggctcaagtgattctcccacctcagccacctgagtagctgagaccacaagcacctgccaccacacccgaataatttttgtattttttgtagaggtgaggtatccctgtgttggccaagctggtctcaaactcctgtatttttgtttttcttttcaaaatgctgtgaaaccattctgggtcaactaggagagatctaacacaatctttgatatgagggcattatactaaattgttcaaccatttctctgttattaaatatccagttcctcttcctttttaaccattataaacattactgcaataaatagagatgtgttattttgtatgaatttctaagtttctggatggttgtcaagactggtcatttcacgatctacctggtgtctaagccagccgctctagcagatattgatggctttgcttagccatttactcttgtcgagcctttaggttattgactttttttcttcctcaaacactgtatatccaggttttaatgttcacctgaagacttacagatatctctatttagacaacatattgggccttatttatccaatcttagagttcgatacttgaaacaacagggatatatcagatcatattatactacggtctttaaatcagccaaagtagcagttcctgaagccaagattcaatgcagaattcactgtggtcacatgtttccagctgcctcttgatctggggccagctgaccttcatacgtgtcttctctcacagactcttggatattggcactagtttttttgtttgtttgtttgttttgagacagagcctcactctgttgaccaggctggagtgttaaggatagttacttttgcaaaatataacaaaaatgaattatgagaaaaataaaagtgtaaaatacaagtcctagtttataatattattagttatcacattcaactgatttaaaattactctgtcgattgctaaaaatgttcctaaatgcttacactcaatttctacccatctctttgtaaatgggcaacagaccatacattagctctggagagagcacaggatactgtccaagagttgcttggatctagggtggagggtggggttagcccctgaagaactgggtgagggagaatgaagaaggaatctgaaggccatgtgaaggtacagagacctggaagacaacctttgagcatttcctagttaagtctcaatctggccttacctgcctaacaggtcatttcccctgcacccaacacacccttccctgtttattgttaccattcaccttttacagaataacatgagggcccagcttatactgatgattatgttgatgtgcatataaggaaagtccagccaggtgtgtttttttttttttttttttttttttttttttttgacagagtcttcctgtgttggccaggctagagtggagtgcagtggtggaatcttggctcactgaaacctccgcctcccaggttcaagtgattctcaagcgatgcctcagcatcccaagtagctgggattacaggtgcatgccaccatgcctggctaatttttgtatttttagtagagatgatatattagtctgttctcacactattatgaagaaatacctgagactgggtaatttataaaggaaagagatttaattgactcacagttcagtatggctggggaggcctcaggagacttacaataatggcggaaagtgaagaggaagcaagataccttcttcacaaggtgccaggaaggagaagtcccaagcaaaggcagaagagccccttatataaccatcacatcttgggagagctcactcactgtcatgagaacagcatgggggaaactgcccccatgattcaattacctccacctggtctctctcttgacacatggggattatggagattacaattcaagatgagatttgggtggggacacaaagcctaaccatgtcagacagggtttcaccatgttgtccaggctggtcttgaactcctggcttcgagtgatctgcccaccttggcctcccaaagtgccgtgattacaggtgtgagccaccacatccggcccaccagccaggatatttgaaattgatcatggaataagatcaaccctttctgaccttttccaaaccacctaccaacattacctcacataggtgctgccatttctgtcaaagggaggatctgcttgaagagtaccttcccatcttggcaatggaagatcatcaaatgccagatgatggggcttctctcactttcagaaataatttagatctcttttctgtgcaggaaagtgcttctcggaaagcactgtttgcttgttgttacaacactttacagtataaagccttctgtttggcaaggctccttataggcattttagcctcccagacatcatattgtgttgttgtcaaagctagacgcagcatctgtgcaaatgggaaagatgaaggctacagcattcccctgcagcatgacagaactgccacattgagataattacagaaggcgagggagacatgtgatgtaattaccacttgtggcagtaaacgagtaaaatttgtttactgtaaatccaagtttaagaaatctttttttttttttttttttttttttttgacagagtcttgccctgtcgcccaggctggagtgcaatggtgcgatcttggctcactgcaacctctacctcctggcttaaaacagttctcctgcctcagcctcctgagtagctgggattacaggcacccaccaccacgcctggctaatttttgtatttttagtagagatggggtttcaccatgttggccaggctggtctcgaactcctgacctcgtgatccgcttgcctcggcctcccaaagtgctgggccctcgcctggccagagatcttcttttaaggaagttcctttcttggtagtcataacaattgtcaaaataaattgatcctgttcagcattgctatggcgaaaatgggacaattttcactgctaggttaagtgagtcttttctatgctaggttttaaggatttgtaagtacaggcttttttcttctggattatttgtggtatttaaatttaaaaaaaaatagggatggaatctgcctccccgccttaaaatttaaaaccctgacagaatatataaaacagatattggacattggacaacagtgatccccaggaggagggacacaaacgaggagagccctttgattgtccagtttactgcctggagccagtttccaggttgcaaagcagggatgggtgtgttaggtttctccagagaaacagaaccaataggatggataggtaggtaggcagataaatgagaggggatttattatgaaaactgacttgaacaattatgaaggctgagaagtcacatgatatgcgtctgcatgctagtgaaccagggaagccagtagcatggctcagtgtaaatggaaagacctgagaactagggagctggtggtgtaaccctcagtttgagattgaaggcctgagaaactgggaggccactggtgtgagtcccagggtctggaggctggagaacctggagttctgatgtccaagggcaggagaaaatgggtgttccagctccgagagagagaattctcttcctctgccatttcgttctatctgggcactcagccaattggacggtgcctgccaacattggctaagggcagatcttccttacttagtccactgttctttctttttttttttttttgagatgaagtcttgctttgttactcaggctggagtgcagtggtgccatcttggctcactgcaacctccaccttctgggttcaagcgattctcctgcctcagcttccagagtagctgagattacaggcatctgccaccacgcctggctaattttttgtatttttagtagagatggggtttcaccacattagacaggctggtctcgaactcctgacctcaagtgatccacccactttggcctccgaaagtgcagggattacaggtgtgagccactgtgcctggccttagtccactgactctaatgccagtctcttcctggaacactctcacagacatacccagaaataatgctttatctgctatctgggtatccctttatccagtcaagttgacacctaagactaaccatcacaaagggtaacccaaatagacaccagtggtctcccttggtagcaaggcagctaggacttggaggggagagtactgagtgggaaagagctgcacaaagaattttggagatctatggagagtcctcttcaagtcttcagctgagtgctaatctgcccatgcttatgaggataccaaggacagggaaagaaccatcagaaaggagcgggcgaaacaatccctagagttcacacagggccaggaacagttcacattctcaccagccagtgggaaaaaccttgcagttcactgggtattgggcacttctcagccttcctatagtattcagaagggtattgcctcagtagtgggcctagactaaaagccattatgatcctaccaaacaaaaaagcaagcctggaggatcaaacaattgctaagtgatttaactgcatcccagcacaaagctcaagagtagagacacatcccatttcattacatgttgctttattgtgcatcacagatactgcatgtttttacaaatcgaaggtttgtggcaatgctgcattgaacaagtctgttagtaccattttttccaacagcatgtgctcactttatgtctgtgtcaaattttgataacactttgcaatatttctaactttttcattatatctattacagtgatctgtaatcagtgatttttgatgttactattgtaattgttttggggtgccacaaactatgcccatataagctggcaaacttaacctataaatttgtgtgttctgactgctccaccaactggtggccccaccaccatctggaattctgggagaattctaccatgcatttgaggaaggaataataccaagtgatatggtttggctctgtgtccccacccaaatctcatcttgtagtgcccataattcccacatgttgtgggagggacctggtgggagatgattgaatcatgggagcaggtctttactgtgctgttctcatgatagtgaataaatctcacgagatttgatggttatataaaaatgggagtttccctgcacaagccctcttctcttgtctgccgccacatgagatgtgcctttcaccttctgccatgattgtgaggcttccccagccatgtggaactgtaagtccaataaacctttcttttgtatattgcccagtcttgggtatgtctatcagcagtgtgaaaatggactaatacaccaagtttacacatactcttacagaaaattgaacagcatggaatgttttccaattcattctgtgaggccagcattactctgatagaacactcagactaacacactagaagaaaagaagacaacagaccaatttccctcatgcatgtataagcaaaagttctctaaatttttttttttttggtaactagaatccaaaactgtattaaaagaatagcacatcatgaacaagcagaatttttgggaatacaaggtttctttaacatttgaaaatcaatcaaaattcatattaacagaataataatgaaaaaccatatgattttatatatatatatatattttttttgtttgtttgtttgttttgttttttttgttttttttttttgagacagtctcactctccgcccaggctggagtgcattggtgctatctcagggctcaccgcaacctctgcctgctgggttcaatcaattctgtctcaacctcctgagtagctgggattataggtgcctgccaccatgcctagctaatttttgtgtttttagtagagatgaggtttcaccatgttggccaggatggtctcaaactgctgacctcaggtgatccacccgccttggcctcccaaagtgctaggattacaggtgtgagccactgcacctagccatgattatcttaatagatgcacacagcatttgacaaaatccaacatccactcctgctaaaaacactgtacaaacaaggaatagaaggaaacttcctcaatccattaaagggcacctatgaaaatcctacatttaatattatacttaatcacaatcaggaacaaggcaagtatgtccactgtccttaattctattcaacattttactgtaagttctacccagtgcattaaggcaagaaaagaggtaaaaggcatcaatattggaaaggtagaagtgaaagtctttatttaaaaacatgagaatctatgtagaaagtcctaaggagtctaaaaaatgtgaatttagcaagtttgtaaggtgtaagggcaatatatataaatcaattgtatttctgtgtggcaccagtgagcaattggaaattgaaatgaaaaaccactaccatttacaatagcatcaaacattgtgaaaccttgggaataaacttgcaaaagacatgaaacctgcacactaaacactgcaaaatatagctgaaggaaattaaagaaatcctgaataaatggagagagatgttaatggatcataagattcagtattgttttcaatctatagattcaaactgataaaaatcccaggaggctttttggtagaaattgataagctgattcttaaaatcatgtgaaaatgcaatggacatagaatagtcaaaacaactttgaaaaagaacaaactgggaggacttacactacctgatttagaagataatgtggtattgatgtcaacagaaacaaatagatcaatggaacagagagtccagaaataatctatacaactacagatgttcctcaatttatgatggggtgatttcccaaaaaacccatcttaagttgaaaatattgctagtcaaaaatatacttaacacacctaacctactgaacatcatagcttagcctagcctatctttttttttttttttttttttttttgagacggagtctcgctctgtggcccaggcgggagtgcagtggcgcaatctcggctcactgcaagctccgcctccagggttcacgccattctcctgcctcagcctccccagtagctgggactacaggcgcccaccatcacgcccggctaattttttttgtatttttagtagagacggggtttcaccgtgttagccaggatggtctcgatctcctgatctcgtgatccgcccgcctcggcctcccaaagtgctgggattacaagcgtgagccaccgcgcccggccagcctagcctatcttaaatgtgttcagaatacttacattaccctgcagttgggcaaaatcatctaatataaagcctattttataatacagtaatgaacatttcatgtaatttatggaatactgaaagttactgtactgaaaaacgaaaaaacacaatggttgtatgtgtactggaagtacagtttctactgaatgcaaaaacttgcagctgagtgtgttcattatcttggttgtggtgatggctccaccatgtatatgtatgtcaaagtacatcaaatcgtacacgcaaaatatgtgcaggttattgcatgtcaggtatacctggatgaatctgtaaacaatgtaatgaaagcaaaacaaaaagattaagagagcaaagtttgtaggctaaatggaaaagaaataccaccaagcggggaaccaaatcacagggtggaggccctggaggataagggtcaggagaggagaaatgggggtaggtctcttaagtcaaaaggctgcgaacttctctattccatgttaggatagcagagtttccaagcgctgcatttggttgctgctagatggccttgccaggctagataagcattgggctgtctgacgatggtctcctgcatagtttggtctcctgttttcctgtgtatgtgacatgcttaagttaggattatgtcactcaatcacatctgcagtggtacagcacgctagctggccaggtcgcggtttgtcagtagtcatgttttaaaagctgcccatttctgggttatgcatatctactaataatggctataatatggaatggaaattaactgtgtcatccagctaaatttcagctcagtttctggtatgtatattaatgacttctaaatactaaggatgtcaaaatgatttagatataatgcttttggtctagaatgggatatatactcaaatagttaatcaaaggtctgatccatggtgggcttaagtggagaggcacatatttctctcttggggaggcaagggaaaggaccacaacattctaactctctcagccaatcctcttccactatgcatatataggttgtgtggtacttggaattcctgtatcatacttagcctttgatatggctcttgagagtaagagacaacagaaaaatgttgcatttaacaacctgttacaatgcttgttagagtgtttttataaactctaaggtgttatgcaagtgtcatagttaataaaatagcctacccaacacccaacagacagactggccatcttgccacccaaatcctcccttggatagaattagagggggtatggaatttaggaattagagtgtaattaattacattgattatccatagtctttaaaatattttaaattagaaacaagtctatttaaacagttttaagatttacaaaggatgaaacttttcattaaatgaaagaaatagaggggttaagccaggaaatcctattttacattaagaaaattattaagagacactggcttaaaccctagttccctctgagtttatagggagagttcccatggagtgggtgggtggagaagacaaagacatagatggatgctgatgaggaaagatgcgggggtccttttctgttgaccaagaacactggggcaaagcacagttgaacagcagcctgcagcctcacaccatggcaccttttgagtcccatctgccctcatgtgctgggggcaggaggtggtgacagagggcgtgggtcatggccagaggttcctttcctcaaagcaaacaagcaaacgccacatacggctccccaaagccaggacttcttccctttggtcagtattctgggacttctattagcacattagatttttctcatttatttgccttcagtcaaggaaagcttatgttttcatcctttgaacaaatcagacgtggcaaatcttgaaggagaggtggctgtcccccaccactgtgctgctcagaatgtcaccaggtgggctggtgagaggagcacacagctgttcccagctgataaaggggagagaagattgtgtccttgattttatttcactttctttggtatgtgtgaggcatggtgccaagatcttggttttttttgttttttttttttaaactatacttcttccgtttcatcaaaagtaatttaattttgttttacagtgaatcctaactgatgtttttacttttgggggatggagagggtgctatatttttgtggttttctgtgcctgactgggcagagctttggatcttgtcccttgccccatgctgcccagggcctgccacttagcaagtactctgtagatatgtatttgatgagcaagggcctgagcatggatgtctgaggtgcaggcacgcactgctgactggagagccaggcagcagcatgggtattcttcagcacagttcttttctgggagggtatttcttttctatgtgatcaatgagaacaggagtctccaggataattttatgtaagtcagtctttttgtatatacactgcccccctaccccaccatatgtaaaatggatttcgcatatgcctttccacaactgcagtgcctcacctccccaaaccgctgtggctgatggactctgggccccaggtggagctgtgctgcccctacagcctgcagaaggcccagggtctggccttggcaatgactgtggttcgtgaagtgggtaacacaatgacacatacgtgttctctgaggggaaacttcgttgcacacagcccagggaatttatgttattgtaactttggttctgaggcgttcttttattattattattactattatttttagtaacagctttattgtgatataattcatttaccatataatttatccatattaagtatacagttcaatgtttttagtttattcacggtatgtggtgcaaccatcaccaccatcaattttagaacattttcatcacctgaaaagaaaccccatgcttcttagccatcatttcccactccctatcccacccacagccctaggcaaccactaatttgcttttctgactctatggatttgcctattctagacattttattataaatggaatcatacaacatgtggtcctttgtgtctggcttattttgcttagcctgatgttttcaaggttcatctgtatcagtacctcattccttttcgtagctgaatactattccactgtatggatagaccacattttgttgagccattcgtcagttagtggacattccacttttaggctgagttatgctgctatgaacatttgtttataatctgaggatttgtttttatattttcaatctttgtcactttgaactgagacatgtacaggcacacaattttggctccttttggaattcccagacatagtattgcttgatggcagcggaagtccatggagcacatgtcatgcagctgaacacactacggggtagttaaaaggaagtacttgtttatgcagatggggttaattttagggaaagtaagcttgaaataattttctctgtacttttgataattttctgtgtgtacctaaaacatacattagcatgcatatttaccatttcaaatatgatgtgtgtttggctaaaaaaaataagggtctggccgggcacagtggctcacgcttgtaatcccagcactttgggaggctgaggcaggcggattgcgaggtcaggagtttgagaccagcctggccagcatggtgaaacactgtctctactgaaaatacaaaaaatttgctgggcatggtggcgcatgcctgtaatcccagctactaaggaggctgaggcaggagaattgcttgaaaccgggaggcggaggttgcagtgagctgagattgtaccactgcactccaggctgggtgacagagtgagactctgtctcaagaaaagaaaaaaaaaaaaaggtctgtgccctcaaagcactcatgtccagtcttgctgagggcagaagggtggctgtggggtgtgtgtggggacaaggcagacatccagcatgtggggcaacatggtgtctctgctgaggatgaacagggcactgtcagagtatcaggggacacctcagaccagacttagggtgggatggtagggaggttgggggaagcttccagaaggaatttctgaccaggttggaatctacaggaggaatgggtataaatgagcaaaagaatcagggtagagaaagaggaaggagagagtttccaagcagcaagttgagcatgttcggagcaccacacattcagggagttgagagggggactcaaggcgaggtgtggtgggaactgcagatgagagaagcggggagggccctggtacctctgatagctgcaccaggtggtttggactctatcctatgagctgggaagtcattaaacggagccccatgagcagatctgctttttggcctctcagaaggggacacacggggccaagggtggggtcttgtttcccctgcggtgggagggcaagtcatctctggggcgacagtgggaggtttgaggctgtggggggattctggaagaaccaatgtggagaacaaagtgagcacagggattggagaagcagcttcagggctattgaaaagatgaatattttaaattcgtatcatcagacattatggaggtccctagggatgtggcaaagcactacacttacgtaattgtgcttcagaatgtcccttgccttacctgagttaaacttagttgaattgagctgccttaattgaactgaaagtgccaataaaaatagagaacaaaaactgccaaaacaaattctgtggttgctggagcaccagccatcatcagtctcatgacagccaagactcagcagctccctggttgatttcacatatttattcttgctttgaaatggaaagcctggaagagaagctaattattaaagggaatcaaggagtcaggcaggggtcggggggaggagatttatctgagctgttactttgctgccattgggatgccacagtatctcaatcctagagttggaggggagttaaacacagggcagggcaggatgggggaggcagcctacccaggacgtggctgtggggacctaagcagatgtgttcctgcatgcgttgctcagtgaggaactgaggctcagagagctccagatggtggctagaaagtaggtctgtctgactccaaatcagtggtcttcctgccccagccaggtgccactcaagcgagatgcagaggtggtagcaggggccctgccatggctggctgcggcacgtggtacacacaaggaggtggcagaggaggcttcatcacattggccattcctttgtttattaaactccctttagatggggagccctccgtggggctaaaagtagaattaatctcactttctgaccatctctgtatctgttgctgcagatgagaaacaccacgtaatgatttcgggagactagatatactcgccacggcaaggccacaattatgggcctggtggacacttcaggtggcaatttagtctgtctgcattaggccaggcttctcttctagctctgtgacggggctggctctcagggaagatcccctgggggaggtaagaccatgcttataagctcctgccacacatgcagctgtcaaagcaacccagatcacctcggagcaggcgcacggaacagctgagcacacgacttctgctcctttgctcagagcaatgacttctggcttttattctttgtccaggtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgaggtacgcgccctaaggagctgctctgcttgggcttgggatgggattatgtgctccacggagggtgaagtgatttgggaaaagtgtctgcaagttaaggaaaatgaatgcctgaaagggaatggggaatttgtcagttcacacacctgtaagcaaagatgggcacagagtgggcatggaaggaatgtcatgtggtatcttacaggctctgcatggcagccagtggtggctcatgggtttttcaattgctggggtttatagcctgtttatggagtcctaaaaggggcagttcctcccctaacacgaactgccacccctgtttacaccacccagggctgaggccctgaggccactttttgtggagaggctaagacccgctcccctagatggcccctcgagctggtgatgcgaagaagtgcacaaatgcttccctaagagttgttctttcggtggcatcaggaaattaaggataagacttaagagaagtggtggacccagcagatttaggaaggcagggctgtaggtagggcatgtttctgatcaggaaacgtaattgtgtgtgctgatgaagagggtgtgcagtggtggctactgttggtacaatgatgctcagtgcttggtgtcacccacgatgagggtagccttgccctggagctggaggaggggaggggagggtggaaggtaattaactggtcactgaggaggcaagtctagaggctgtggagaaggacaatatacacctcgagaatcttaagtgagatgaagacctctgcctttcccctttaatgattgctcagcacatagccatttgcagaacagatcctgtgtttgtagattccttcattgtgaatttatctgcttgctaaaatttatttgtaaccccaaaatcaatatttgtggtgtttttgaggtcatgaacagagtggcagaaattttgagttgccctttatgtacagtcccagctgagatggaacaagcagctgctctcatactgtcaacaagtgtcctttacttggtctacttagtgccatggttttacatttttgtgcttttggtgacttcactgtttaaaatgcccccctggtgtggtgctgaagacctgtctagtgttcctcggtgtgaaaaagctgtgatgtgccttatggagaaagtatgtgttaagctttgctcgggtgtgagttatagtgctgctggccatgagttcaatgttaatgagtcaatggtatttatcacataaggcatctttagaaagaaacacacataaaacaaggttttgtattgatcagctgatgaagatgtggccagaggcttgcaggaacctaaccctgtatttcccctatgagtgaggattcagtgttcacagtgactttacggaacataattaccgcaaacaatgaggattgattgtcctatgtgtcaggccattgtaggtgtgtggtgggacacagaggctgacaagacatcgtccttgcccttgagcctaaattatcagggggagctggatgcacgagccatggataaatgggctgggggaagagtgggtttaggggtggggtagactggctctgagcaaagagagccggggaaggcttcggggttcctgtggctgcctcggaggagggaatctcagcacctttttgtccccatagtaacaagggcatggaacatctgctcaacatgaagtgcaaaaatgtggtcccagtgtatgacctgctgctggagatgctgaatgcccacgtgcttcgcgggtgcaagtcctccatcacggggtccgagtgcagcccggcagaggacagtaaaagcaaagagggctcccagaacccacagtctcagtgacgcctggccctgaggtgaactggcccacagaggtcacaggctgaagcgtgaactccagtgtgtcaggagcctgggcttcatctttctgctgtgtggtccctcatttggtgatggcaggcttggtcatgtaccatccttccctccaccttcccaactctcaggagtcggtgtgaggaagccatagtttcccttgttagcagagggcacatttgaatgcagcgtttccacactcaatggcctcataggatctcagtgtggtctttcttactttccttcttccttcctcccctttgtgaaacatcttaaaggttttggaatgaatggtggaaatctgacttggaagggctgcgaatcagaaaggggagaggaagtgacacgcttacagaagtgggctaacccttcttgtgtggcacacactacccttccctctgagagttgacctttgctgttttccggaccactccattgtaagattgaaaacccctgtggcaattgcgtacttacctcccaggcctgtggggactgatcatatcatatgatgcttattctgtcaaaggccagagggactgtggttaagctgggatgtgagtcatgttctctccctgaccttgctgccagctgcacacagatttgtccctctcgatttgtattcacagagcctgccaataatttggggtatgtgtgtatgagcgtgtgatcattttcatgcaggactgtgggagatacaaatctcgctgcttctggagctgctcttccttaaacctgttgtcccatggggccagcgtgggtgctggagaaaggccgtgtttgcaggaatggggttctctcctgtgggtgtgggtgacagccacagtgtttccctggggcaatgtggatgcagtttccatcttgtacaacctcataagtagcagccacaattgccccatcagtcaccacaagtagtcagggatactttgggctgtggatgtgtgcagtgtgctgttttatggatggatgagtagctatgcaccccagtgtgtcagctctggggccacactgtatagccttgatgagtacgccccttgaacaagacccagtttgtgaactctccttaaagagaaatatttagggataattatttatagcaagaaagaattcttttacacttgagagctcttttaaaaatattttcttattggaaaatttatatggtgggcagggtgaaaaagaaacagtaaaaatattagttcttattccaagtggaacataaataggacatgaagaagggcacctctgaaatgacaactttaactcaccttttaaaagatgtgaaatttccagttttggatacacggtgaatatgtaaaatgagtaacagcatactatggaagccagcaattaaataatcatgtttcattattgcagtaacgttttaaacaattaccttgtgatatgatattaaatatattttctttttgaaaatatgttcactttgggtagcacatcctgtatttactaagtcattaggaagactgcattcagtgttaccaagactggtttttgctagtaagacctcgaataatccataattttgatattggtgcaattttactataagttgagcttagctgtttcagaaatgcttggacaagtacctagagaacacactgatgtctgtgttctgaggcagtctgaagttattcttagagactcagttacagctttagtaagatttagtacaggcaggataagcttggtttcataggaaccagggaaccagtgttagtgtcagcttctttcctcctggtcagcctagaatcccccactcccaatagaggggtttggaagctggagagtaggaagtaagaggcaaagaaggcagccttcagcaactcattatctgccagtgaaattctattaaatgtatttttaaaagagattaccaggtaacaaaaacataaaaaaccaaaacaaggccagatgtggtggctcacgcctgtaatcccagcactttgggaggccgaggtgggcgaaccacttgagcccatgagtttgactccaggctgggcaacatggaaaccctgtcctacaaaagatacaaaaattagccaggcgtggtggtgcaggcctgtagttccagctacctgggaggctgaggtgggaggatcacctgagcctggggagatcaaggctgcagtccattgcactccagcctgggtgacagagggagaccctgtctcaaaaaaaaaaaaaaaaaaattgccacgaaatatatatatatatatatatataattttttttttttgagagtagatcttaagacagagatcacttctactcctgggagtgaactggcaatggcaatccctttagagcctcgagtgggcagtatcaggagcgccgcacagtgagtttccagctgagctattctcaccgaatctcgctctgttctcacagcacccctctgtcaggcctgtctcatagtgactgcccaccaggactgactacaaaagacttgaccctaaaatagtcttgaagggatttttctcaaaaaattaaggcgggaacacaagacaaagctgtcagcctagtcacaaatctgaagactcaactgcattaaaaatagtgcaaaatcggcaggagctgtacagtgcgagtcttggtctggaatactccccctgctaactcagctggaagggcaactatcttagatttcagtaaggaagaaaaatcagttaccaatacttggcagagccatattatatatccatatatatttatgtatataagtggaattgaagcaattctagaattttctagcatgtgaaagcagggtttagttcttatttacgtctgctaagggacttttcaaattcaaagtgaaccttctgtttataggcctattttgaaacaaagtatcctcacttaataagatttgacacctttttttttttttttttgagacagggtctgactcctgttgctcaggctagagtgcagtggcgccatcatggctcactgcagcctcgacctcctgggctcaagcgatcctcccaccacagtgccccatcccaccccattcccgccctcgccgagtagctggggtgcacaccaccactcctggctaattcttttaatatttgtagagatggggttttactatgctccccaggctggtcctgaactcctgggctccagcgatctgcctgccaaggcctcccaaagtgctgagattacaggcatgagccactgtgcccagccccgccacatttttttttaagttgctgaaaatcttttaaaaagataaaaacacattatttagtatctaaagataatatctgtgccagacacagttctcagtgcctcagacattcacatttaatccttattataataactgctatttccttattttctggttgtggaactagacacggtctaagcaaacttgctgaaggtcacgtggggagtaggtgattgagctgaacacaggcagtccaagtccagtgctgacagtgaccatgcacttcaaacagtttaaaaatttaaagaaaaatattttaaaactgcagaatctatcaggtgcaacctgacatgcacggctgctgtgatttaaatggggcccccttgtgatacccccttacctcccaccacaatgtccagaacacccctacagacacagtaagtttgtaaacctctcacatcaaagttcaactccacctttcatatctgtgtaaattaaagcccacgggggcaaattcacctattcaaggtcataaaactactcatggcaaagcttggactggcacgcaagtcttctgcttgcctagcgggccagtattgctcctgccccaggacttgcttctgtgagaatctgctttgtgagctgagtcgcagcagaatggaggggcggtgaagttagggttgtcttctgctgtacctttagatcccatctcctcagcttagatgggtctgcatgagcctttacacaacagcagcaatgacagatggaaaaataagatgcataatctgttattcccattgtcccatctcaggttcatgagctctagtgggtactgtgatcacctcctgtctgtgactgctttccccaaacacgtggaatatgttccttggaagtgtactcatgtaaaattcacatcttttaggcactgctgcttccctgtggagtgtgatatactacagtgtgaaaacacgtgccacttattctttatagctctcaaacttgctggaattttggctccagtggcagctcttaagatgtgcattgtctgtgatgtatgatcgtagtgccatttttgttgctttggagtcagggaggttttttgtttgtttgtttgtttgttttttaattccgaggatcctattcacttgtagggccagccactggtaaactggtggtgggtttcctctatgggaagcacataaggagtggtgataccagccgcgaacagttcctgttaactgtacaatggatgtttttgcatttgtttcctctgttgggtgtctaaatgccttaactgttggtcctataccttttgtcattcaatgtgtacttcagagcctgttggttggctataatttgccattttctcagacgaatgctttgtatcattacactaatttgttgacttcatttgcaggctttacatttgggccttgtagaaatgaatgtttgctgctctgtgaaagcagattttgagacctgctttcccttcctccagggagtgttttccttactgtgtccctttaatgtctatggcactgtcgtagagagtttaacatgatataaataaagtgtttcattattttggctttaaaaatgtatttgttgggggttgagtgtaagaacttacagtaattaggctaagtagtgtctacattctattctgaattcttattgtggggttagagagtcctttgagaatttgatgaaaaccagggctagtcttcctgggaaagggcacctgaacacaaatgcttgagtacaatttcagaagagttaagaagctctgctttaatgtatcttcttaaaaagaacaatttcatctttagtcagctaatctcacacttgtgattgatttatgaccacaggtcctgtgtatacaagtaaaatgcagctcacaaaagtcctggtatccagtgcatcgattatttggatagattttctgtaatcattctgagtttgattagaattatatcctttacagatggggagaaaagcaattcattcatttgaagttatcttagtgccaagagtcatgtgaaaatgtcccttgcatgtgggcaatgaaagatttgcagacgatataaaacccagactacctcataaaagagttttgggaatacactgagctttgagtgaaagaagctgcagtggcctccctggagatggggagcaaaccagcttaaaggcccttatcctgaggaagagacaaaaattgacatgcacaatattaagctttgaaatgcagaccacacttcctttcactgcaactttgacttgtcccgcatctctacttaagggcagaaaaggcctctcaaacactcacctcatttggaatgaagatggagactcttttgcctgaagcaacgatggagcagtgaccctctaatcaactcggtggcctaaagaaaaatcttgggtaacattttcacttcagtttccctctgggatcattgtaatccatgaaaaaaataattttaaagaaagagttaaaatactttgaagttagttatgtggttaaaaaccaccttcctttctattatcaatccaacaatttgataactgtaaacgctaaagtgaagacggattctcttcagatggtctccttaactgcccagggcttgcagatgtctcacccatgaggggcaccaatgtagaaagctgaggcttcatctactgatgagcttcactggtttcccctgaggtttgtgctttggcagagaaggggaggaggggactgggattgtgtggtcagctgtgcctgccaacagatgcaggttaggaactgtgttcagtatcttccaataagaaaggggaaatgccgatgcctatcctctttgtttaggtagaaagtaaaatgctactggacttaaatgggcaacaaggggctttgcctgttcatttgccatggagagggctgggaatccaggtgcggtggctcacacctgtaatcccaacactttgggaggccgaggtgggcagatcagttgaggtcaggagtttgaaaccagcctggccaacatggcgaaaccccgtctctattaaaaatataataattagccaggcatggtggtgtgtgcttgtaatcccagctactcaggaggctgaggcatgagaatggcttgaacctggaaggcaaaggttgcagtgagccgagattgggccaccgcactccagcctgggtgactgacagagtgagactctgtcaaaaaaaagagtagagtaaactgggtataagatccttccctttgcgtccacctctcatgccatgctgcctttgccattccctacaatagctgagggtcacacgctgaataatttaatttacacatacacgagggtccagagctaagttaattctgtaaataagacttagaataaaaggccctctccaaatattttaaaaataataatttttgttttttggaagattaagcataccactgaactgctttgttacagaattcagtacaacagaagtctggctaattttgttttttaatgagaaacatctgagttgtacatatcacaaacagcttcaagtttctgtaccaaccccccgcccccacccccgccgtggccaaacagttaaaacccaaagcaaagcatcactttggatgtgaaaaagtcttagaaaattaacttacaaaaacatccctatcaagtcggtagtttggcatttactttacattagtcaaaagctccagctaaaatctaatttttttaaaaaaaaatcgaagtttacattattcatacagattgggcattgttaaaaaatatgcacaaataaccacatccatgcaatacaatttctttaaaaatttaaagcaatataaaagagcagagctaggtactgaacagaacattttggtgtataaccggcagctcaaaattgccagctgattggagtaaaactgattctaagcgtattaaatatgattgattgtttccatcagctaagggtgcctatgagtttctgaaccatttctagggtggaatgtcctcgcttgcttctataatatatgtgatggacaccactgctcattgaccatacctacattataataatgctgttttacaaacaaaccagaattcacaaagtgcttggctcttcaggaaactgacatttccagagatccctaaactaatcaactagttctgccaaaatacccggggcacctgccacacaggttccctgctcctggggaggaacacaatctgaaagctgccctgggctccagggagcccgtgctgggtaagcccagaagaagtctgcacaggtcccgggaccttgccaacactaagtcactcagattggtctggggccacgtgctgggcacccttggcaatcaggcaggtggtgtagcactgtggccagctatgccctctatgtggggggtggcccattggtgtacctcagcatggggtaaaaggaccgggcaaagttgttggcctgagtgcagctgtagtcttcttcggaggagggcagcaggcaggccaggagcagcagcagcaggaggagcagctgcaggggtagggctgcccggaccacccttgagaggaaggagcgctgtggccgtgtgctgccggggaccctgccaacagaggaggttgagagctgattgggaggctccacaggcacaacccactctattacctaagcccctgcttatgtaagtaagaaatccaagacctgagatttaaatagggccaacagttggggttcagtttcagaggagaaaaccagccctttccagacaaaagaaaaccagatttttgcaaggaccttgatagtggcattggcaagactgagtcagtgggagtgtggagcaggggaacgcactgctgtcacggtaaagccccgttacctgctctctgtctcctcctcgccttctgtagttctcactgctctgaactgctgggtaaagaaactccagttagtaagttgaagacagtttagtcctatcaatgataaaaaaaaaaaaaatcctcccttaaattatataccacctttatgttgtgttacagccaaactttggagactagagtaatacaattgagattaaacgtcacctgaagtaggaaataattaggttaatctactcagtttcagggtcaagtgtgttgaagtttttaatggcaaaatcagggaacccctttagcgacactataagagctctcattcacaacctactgtgatcccaaagaagagtgactagaggcagactgtaagcctctctatgggtcagcagagacctgtgctgtcctgaaatggctaatgggctcttggaatcccaagcttccctcatcttagtgactttaaaaaataaccagtgaggttctcacagaaggaaggggcttcttacctttgctcggggagctggcacggatgttgcaggaggctggtcccccgagtctacctcgtcgaagctgggcaggggtgaggctgggttctgaaattcagaccccaaaggttgagcacagaaatgtgtttcatgcatattcttcatgatatagctcaccctcccctaccttaaatcaatctttttttgttttgttttgttttagacagtctcactgtgtcacccaggctggagtgcagtggcacaatcacaggtcactgcagcctcaacctcccaaactcaatccttctacctcagcctcctgagtagctggaactataggcatgcaccaccacacctggttttgtatttttttttttttttttttttgcagagacgggatttcaccatgttgcccaggctggtctcaaactcctggacttaagtgatccacctgccttggcctccccaagtgctgggattataggcattagccactgtgcccagccttaaatctttcctgaaggggctcttctattgctctcactcccaacaacaacagactttttcggacaaaaaggaatgtaaacaaggaaaagccaacccatattaaaaaccaacccatagcacagagctggggagactgagtttagcagcagcagtttgagtagatggtgagctcatcacaggtcggtgatgagatcatgtggccatcaagagagtctagttttggctgcttaggagaaaacagacctgccctaagtctggtgaggccacagtctgggtattccctttgttttgagttggatcccattttaaagtaggccagctatggtggctcatgcctgtaatgccagaactttgcattgcttgaggtcaggagttcaagaccagcctgggcagcatggcaagaacccttctctacaaaaaatacaaaaattagccacttcctttaaaaaaagtttaaaaattgtcatcccgccactcccttttaaaaatgacaaaacagattcaaagagctcatgcagctctttaagtccacacagctagaaaaagggcacgacatgaggccccactcggaccacctggcccttgcttctggcctctgtcttagagcattgctacaacactgctgtcctgtctgcatgtaatacggcaatctttacagttaaaagctacaagtagactcacctgggttccctgcaaggccattaaatcttgggacacttgctcccgtaactgtttgagtttcttctcaataacatgcaccttttcttcagcttcaatacagtcttctccatgtcccttaatgagaaggctgtttgaaatctcctgtaacatgtccacttgaggttgacgttctaccagctccttttccagttgctgaaaacagataaagtgtgtgaaacagtgacctgtccaaagggaagcgagtgtggacacaggaggtttttctcagtaccagaaaaattccagaatgaatgatgggtagtactcaactcgagaatcctctatttctcatatctgcctgtgtcctccagcccagcactatttagatagcaagtgtattatgccctgcccctatttttaatttcttttcactctgaagacaattgtgatgctggagaaattagaagaaagaagtgaggcaagtggtgtgggaagaccaggtccctcatccaccacggaaggaagtaaagggaaactctaaagtcaatcaaccgagaaacagcagcgtaaccatagaggttcataccaggcaaacgggctttaattgttaagggtggttatcttgcttgcaatatggccactagacacatgtggctattcatttatttatttttttgaggtggagtctcactctgtcgcccagggtggagtacagtggcacgatctgggctcactgcaacctccgcctcctgggttcaagcgattctcgtgcctcagcctcccaggtagctgggattacaggcgcctgccaccatgcccagctaatttttcttgtatttttattttattttgtatttttagtagagacagggtttcaccatgttggccagactggtcttgaactcctgacctcaggcgatccgcccgtctcaggctcccaaagtgctgggagccaccgtgcccggcctacatgtggctatttaaattaactaaaattaaaaattcagtttcagtcataatagccacatttcaggtgctttaagccacatgaggttattagacagtgcagacacaggtcatctctatcacttcagaaagttctactggacgccactgctttgctttgcaaacattttaggaagctgtatttttaaacaatggctagcactctgattaaaatttaaaatatttaaaccacatacagatttatggatgaaaatgtcaccttgagcaccagtgagaatacagaaatctcatcttggtgtgttagtgacaaatacaccaggacacgactctcctccaagaagaaagatttttccatagtggatacagaaaacccattcagctcatcacaggtgtgaagcaaatgagcaccatatttctccccaatgagcaggattcacgagagaaaaatacttccactcaaatggccttaagttcctcaggatatcgagagcacctatgtcctcagttctgtggactgtggctctccattcctgcaagtcatttggcttcagaactacaaagggcagctcggtaaacaccaactggaggaacactagggctgaactcgtgcatttacaggcaaacaccactggcacagttcctgaaatactaggcgaggctacctgagtgtgctgcctctctggggctgacagaggctggtggcagtacagagcccttgggaggaaacttaccattagttccctccgacactctaggagagcccgggggtctgcctttggatcggtgacatgagccttctgcctccggttcttggcactcgctaaccacagcagcagattttgactcaactggtggaagtccttaaaaaacaacacatcagagcgcggccgtgtcttagagccctggaagagggtgtgccaggaacatggcttactgcttccaatccatcacagtcatttgcttttctggccttacccactgaatacgaggaccagctttaaactaaatgccagggccccaaaatgaggaagaggaaagaaggaagacactcagcacagtgccaggaggccgcgaataaaagtgccactatgaaggtagggctttgggatgcccagctgattttatatatgaaggccacacgcattcctcagccaatctgctgggttctctgctgggttccagtggcagagggaaacaacccaacaggacaggctggggtgggctcacgttccctgagacacagccagagctaggcagtggtgcagagctcacacccgctgtgcatttactgtgtcaggtactgggctaggattatacatactgcctcatttactcctaaaaagaacctttttaaggttctttctaaaaagaaaatgggaatgattcccattttcagatgagaacactgaggtctaggaggttcaatgctttgctcaaagtcacatggctattaagcagtaactgctcctctgcttcaaggccaggtctcttaatcactctggcaaaaggacaaaaagaggagttgtggggtggcatctctaacctacaggtcgcctgcaggaaccctgactccaggagtggctctgggcctgggcaacagagacgagacctgggacagggagtaggtctctgagatggccggtgagcctctgtggaaacaaatggtaaagcacatgtttcctgacaccagccacatttggctgcacggaagcagcctgatgatgataaaaatatctgctgctcctaccacgtgggcctgggtaccggctctgggaggcgggctgctgagtcagcgtacctggcactgcatgagcgactgtcgtaagccccctctccagctgtccactgcgccctgtgctgcttcccagagcaggctcagctggcggagtctactttggagctctgtggattcggggctctcggtttgcagaaattccttgctgctcacgttgacagagaccactaatgccttgtaagtgtcaaaggctttcagtatctcctaccagagagagaaaagatgaggttaggagctctgaaagtagggaggaggggctcattttgaacctcagtagggaacaaattttccacacacttttccaagctgcggccacagaaatgagagtgacctcgcctgggactggctggaaagcatcaggtgagggagctgccttaaggtctgtgaacttggccaacagggccccaaagtagaggcctgctggagggaggagaccctgctgacctctacaggccccgctctgcaactggcttaatgtttctggaccgactaaaggtcttccagataaagtatatgtggttattctgcatttgctcctagaaatgccagaaatgttattccttaggaggaatggtaacccctaatatattaacacagatagtaaaataaaagtacaaatatgaaaggtacctggatcctccaaaacccctgccctgggtctcaggctactgctcatggcacccttaaagcgcagggctcaaactgtccctttgcagctccctgggctagttccagtggggtcaggacttatgtaagtgacacatcctaattgcataaaagggtaatgaggtcaggccacgggattcatcagtaggtgagccggtcctttcccaagccctttcaaggaagattccaccactagtctttcgtgtaactgtgcagcatacagtttggaagagtggttttacactgcctgacagtgtccactagcacctccagaaaagtctagaaatgcctcggatgtcagatttttccatctctggagatctgagccacacctccccagtactctgggatcaggatcatttgcagatactcttccatgtgaaaacaaaaatctgcatctatgtccttgccaactatggaactgaaatggaagagagtgacctctacatacaccatctgcaagctgcgcctatgccacgaatacatgggatctgctcgtccagcatagcaatgcgttcacatgcacattctgaatccctcttccccaccacacctctaactcacctgcagtctcttcactctcagttctatttcctggatatcagagggaggctttgccatctttaacatttccagctctgcttcagtttttttcagccaagtagtgatggcgctgatatcagagttcagctgttgcaaattttgttttattttgagcttattgtgaagctcctgtgcttgaatcatctcccatctgtcgaaggcacctggaattaaaaaatcgccaattaaaaaaagcaataatgcaacagatttctctgcctccagctaattaggggtcagggtggttaaaaaaaaaaaaaaaaaaaacaaaaaaactgtaggggattcccctgacagaagggtctggttttgggagttctctcttctcctggaatgtggaatagcacatgatctgaggcgtacactcccacagaggctggaatgaagtggaaggtctatgtgctacagtttcaagctcaacagttcagttcctgctgaattttttcagttttctcctttggtccacaaatgaccaggtcgatgctgtcagctttagatttagttgagtaattacttttataattactgggctggtcgaatgaagagacacttgagataacactgatcatcatcctcaagtctgatctttacacacaaatatagaaagtgaaaacctgcacttcctcaggaggcttattttaccaacatttaaagaatagttttcaaattacactgaacagcctaggaatttgttcgtgaatgccaatcgctgatttaaaaataacattggttgttgtagggtaagtcccccagttctggcgaatcgtatagttggttaatatctaatgaatgttctcttgagcaaggacttaaataccatactctgcctctctggacgactgccagttacaggcagtacctgactgctgctctgtgataccggccagtcccccgtcttcctgctgtgggttgccattcaggactcgcgggccttctttgccaccatccgtgcctggaggtaatagtagctttccctagaatgagccagtttttaagttaccatctgtagatatgaaggatatctgaagaacaactggattcatttcatattaacagtgaagaaatgagatgggcccctttcctttgaagggtatcttgctaggaatacagtggtgctttagtgtctaggtagcatttataagctggcaaagctgatggcagaaataaagcctcagctaaggcccagggagagggaagcagatgagatgtcagtgatgggaagaaaagggtctgtttcaattggcatgcttccaaacacccctcaaatgatccacacgaaacaaatcagaacaatttgttgagcttaccagacggttactgcgttagcactttgaattttcatagtgttttacagaattttagttatccctgtcactctgtagaggtggttggcatcattatcacagaatcagaaatgcacagaggatgaatctgcctcccaggggcattcgttaccaagtgtttatctttcaccgcacatactgactcttctgttatcacacagccgattgggctgttatctcgggcctctccaaaaataaatgtgtcccttttagaaaagccctgctttctttgtctttcttctgtctgtatggcctatttgtgcagaatgaaaataataaaaaaaaaaccttcagatttgtggtgatacatctggcttcagacacaacaaaagggttgagattttgaaaccggccaggtgaggaacacaggcgtcatcacaggaagggatagccaagccacatgagccaaggatgtaaagcagaggtcagggactgcggtctttcccctgtcttattattctttttaaaaatgacacctgcttgttaagcaagaggaagtgtttctgaattggacacaaacagcccattatcagctgacttggatttgagcatgcaaaggcagaatctcctccaatgatgtaacaatattctctccttaatttctctcgctgctgccctaggctgccctcccaggagctgcctagccagagcatgccaagaactcaaggcagctgagggaaatgtaactaagaagaaacagccattgctataaacaacaaaccaatacaggaataataatcacgaccaatacaggaataataatcacgaccattacttctgaggaccttcttttacctttatacacaataatcttaacaactactaggtgaaatagctttagcctcaggtgagaaaggcttacagaagcaaggcgaagtgcctcaggtaccatggcaatggattggcagggctaggaatcaaatccgtgtccactgcagcacaccatcaatgattttttggaataggatgtatggacaaaaggttaacataacaaaggcttgaaggttggatgcagtggaccatgcctgtaatcccagcgctttgggaggctgaggcaggtggatcacttgaggtcaggagttcaagaccagcctggccaacatggtgaaacccccatctctactaaaaatacaaaaattagccaggcatggtggtgcacacctgtaatcgcagctacttgggaggctgaggcaggaaaatcacttgaacccaggaggcagagattgcagtaagtcaagatcgtgccagtgcactccagcctgggtgacagaatgagactccgtctccacaacaacaacaaaaagacaaaggcttgagagctcaggagcagtcaggaaagccagcaccttgcttgctcactatttgcacagacacctgactcgacagtaataatgactgttacaccacaccaacatacagaaagatggtttttggccagaacctatctctaagtctaatcggttttgccggggttctaatgaagtatggacagctcaacagagacactgtcaccataagaaaaccaactcaaaatatgcctggggaatgaatacacgcagtttacaccaaaatctctctctcttgcaaatgtaagtatgactcacagacataggctgtactcccagtgaagttaagacttacatagggtggtttataaggggtgctggacgcagggggaacaggtggaacattcctgtcaccttccatttgcttgtagtgatgctcgggacaggaagggctgtcgggaacatgccacgagtggccatccgaaatggatttacctgaaacgaaagacagcaagcgacagtctattctctcctactgaacgggtcacgggtgacatggcatcaggttacagtatgaaaatgagttctgcagctttccttgcaaagcatgcatgtttgcaaaatgtcagtatgtcccagaagagaatgagatgagtcatgcaactcagcaacactgtgccttcactagatgggtacacaacggagcacgaccaacatgatttgctgtgggatgagtggcgttttggagccagggtctcgagtggtagggacactgagtggcaaggccgggtctggggaccaagatggcagaaggcctctcaggagtgaggggaagagtgaacatcaagatggacttgggaaccaaaaggctcctcagggctctccccgacccaccatggcagatagggatggggctaaggatgaggattagagctgcaaatcaaggaaaggaaggttttttccctcctgtggcaaatcatcagcaccctttaccgccccaaccccccacccctttccaccaggggatcccagtaaagcaaggaaacagttccaaaccaagccaccatgaagaaagcttggcccatgccaaaggacttcagttagatggagaaaaaaatcatcaaaacaggcaccatgaaaaattccctctgcacaggcctgaagggaggagagggggttggcatcgagacggctctggcttggatggggttttgtaaggagcacgcagttatgggtgagtacggcagtgtaaatacaccatgacacaaggaccaaggcgcatggtgtccacagaaggcagaggtagacacgacatgggagcgaggttgaggatgcagtgtgcgccacaggatgctgccatgttgacacatgcatgggcgggggcctaccagaagacgctttcaaagtttttgtggtcattttaagatatgcctcaggattttcagggatttctacatctgaaaaagaacaatgtcatttgcctcactggaggtgcctgaagattaatgcccaagtattaacacacagtagaaacattgtcagctggaaggagaaaactaccctttatttttttaattaaaaggattttgaaaaccagaaagatttttttttccagccaactcctgactgtccaaagcaggacactgggtatcaaagggagaagctcagtctgcagacactctgagaaactcaactgaaagggagggtaggcacagtggctcatgtctgcaatctcagtactttgggaggctgaggcgggaggacttcttgagcccaggagttcaagaccagctctggcaacatagcaagaccttgtttctacaaaaaatttaaaaactagctgggtgtggtggcgtgtacctatagtcccagctactcaggaggctgaggtggaaggattgcttgagccctggaggttgaggctgcaatgagccgtggtcgcaccactgcacctcagcctgggtgacagtgtgagaccctgtatcaaaaaaaaatcactgatgagtctcccagacagccagagccatcactgagtaaccttagtgtctgaatgtgaatttcattttttttccccctttcattccacctgtgatgagagtgagccaattctcaggtaagttaagagatgggcaggatagagcacaggaaaccacagaagtcagggtcggccacaagatggactcttggtcattgagagctggccgtgttgctaaggggctaaaaacatagccaaacgggtcactttccagggtgctgggaacccagctgttacctgacagtgcgctgtagtatgggccctcctcgtcctcttcgtgagaggaggagccccccacgtcgcctgtgtggtcccactccagggggatggagtccacgctgacaggggtctcgcagccagaccgctcgtgccctggggccactagatgacacagggactgaggagatgacggttcctcgctctctccccgtttacgccaagaatcagtctggatttctctggggtcttccatgtctgtttcattctcagaggcctccttttcatcttccaagccctaaaccacagtatccagttgttagaattaatcaactcataggcttctgcaattagaagagcatgagaagtctgcctatctagcagtttccaaaaataactgccaatagtatttctaaggcagctttaaaaagatcaggttcccaggtcctgtttctggttattccagtttagacaatctggagtggggcctaaaatctgttattttcccaaacctccagctattttttcttaggaaaaaaaagctgaagtttgataatctaagttaaacaactttatctaggagataaggaaatggtggccaaagtttcattgatggttaatggcaggttcctccaagaatcagactatttttgaaaaggacatttgaatgttctgggtaagactcaaacttcaaccagatgcaccaggttctttctttcttatcctccaacttaattgctcagtgtctgtattctgcttgtgtcataacgtctctttcagtctaagaaaaatgactctaagtggctgtacttaaaaatgagaaattgtggggtaatttttgaggctgtgtctgatgaaataactacatttgaatgtggccagttggagacacaaaaaaagaaagagtggccagtcgtatcggtcaatggttgtcattcaagcttcaggcacacaaaggcagtacgctttgaacagtggccttaactccacctgaacttcccaaaagggcctttcgtctggggaaacatcaaagttgcttttgaaactcttgtgttttctcttccaaggtgagaacaaagcatcagaaaggcacaaatactaaaagcttccagcctctaagaaagagggaagggcaaatacattcctaagttactaatgtaataaaagccagaagagttcttcaagaattctaggggtagtgacgcatgccagacaagcccagccctgaggaatacttaaaagcgactcgtggagcatgcgcctcagaagtgccatgctttccactggggaatgggaacttgtaagttactgtggctctatattaataaaagtggaaattaaaatgttttgatata
